United States Patent 7,868,149 (PLANT GENOME SEQUENCE AND USES THEREOF) - sequence listing, part 53

SEQ ID NO: 28668 - DNA, 12499 bp, Oryza sativa
tattaccagcaaaaaattcttcaccattcttctgatcagtgtcatcatcggcattctgtttaggcacttcattggccacaattgtgtatgtagtgataacaacatcatattttgccaactcatttggatctttggtccttgagccaccatgatagaccaaaacagacaatttagcactttcaccaaccttgtcagtcaattcgttcgcccattgcttaagaacactagctgggcacaccactagagtacctgcagcaggccttgtcatggattgcatagtagatgatgtgcttgccttactcttcttcttacgttcaacatttctttcaaccgtcttatctggagcagtattcattaggctagcacatgtttcaacgtcaccagtaccagctgctgttgatgacgaaccagctcctagatccttcctgggttcatcattcttagtctgctcccccttattatccgcaacaggcgctgcctcatcgtcatcatcaaggtttagcgcttcagcttttaaacgatctgaatcaacagacataaacttagactgctggatcctctgtttctgtataagggcaattgtagacactgttttgccaagaccctgttaaaagaaaactgctcgactttaaggatggtaacacaataagaaattgatctttgtcaagaagttgtgaaatcagaagtaacctgatcatctgcaagaattccacctgcacaatgagagctattctccttcgaaaccatccaagccaatgccattttctttcaaaaagaaaaggtatgtaatgaacatggaatacactatcaatcataaagtaagccaataaataattaatattatgtgagaaatatttacctggtgcctaagcagaggtactgacagaacaccctcaggcagatcatcttcccttttatcctggataatattctgtataacatagtataaaaagaaatatcacaaagcagactcaaaataaagaccaacatatacctcaatcactaaagtacataacttctacctggaaaatgtatcctagactggataaaaacttgtcatggacaagataaacatacaaatgagaaatttatatgcctcattcaaaaaacaaaaatacaactttcatgattgcaatataattcaacaaaaaaaaatcaaaacaaaatatgaaacaggtttgaagtaaaattagaagtatgtataatcatcttcaaagaacttctatctttctacttgaagaatggagaataaatagtatgattttttcaaggacaaaacaggtcaaaaaaattgagggcagctatagtatgttcaaaggtcagaaaaccaaataatttgaggagcaaactgaggaacccaggagattgataatgagcaaatctaaacaaatttgcaaatttaaacaacttaacaccaaactagctatctgtggttctcttcacgtcacaagagtatccttttgattattgatgaactaggaaaaaaacattatggtgccaactgtttatattatctatcaaatcaactctccaatttgattcagaaaacgtagaagaaaaacaactcaatcatacaaaattgcctcaataactaggaacaaaggaacacatgcctgtagtgcttcctggtacaccgctctctcgtcagaatctataatcctattttccaggttcagacgaccttgcatatcaatgccattagcaaattcgctgtgattagcagaactattgcgaccaaaagatggaggaagaaccctatgtgaactggagcttccatatacatagacatcctctggcaaacacaaaaaggggaaacattagtttttcagagaaaacctggacagatttcaagcaactgtaagaatgaattacaatcatttgagactaggtatacaaaccattgtcactgtctgtgatgaccttcttgttgtcagtaccaaaagaacttcggctcggaaaccttgacgatgaaggctccccaattccattggcaacattttttcccatcctattttcagccaatctttgtgaatttccattggtaaaagatggtgggaatttgcgtgtctcacttgcaaccactggatgcatagcatttgttgtgcggccatttgaaaaggatgagggaagaatcctcttgccattatcattttcttccgatgcaaaaccattgtgcttcttgactacaatatcagttctgttggaagcaggagttgcccttgcagaatcatttggtgaccccctataagaacttgaatgcggataagctctgtcacctgaacctaacgcatgacgagcgttatcaacatgtctaccatttgtaaaagaaggtggcagagttctatattgaccatttatattttcagtaggcctagaagaagatgaagctagctcctggtccaaaccaccaactgaatcatctgagtcgaagtcaaaatctatatcactgtctgaactcaagtcaatatagttatcgttgttcatattgccagcaagcatgcgcacagcatctgtatagtcagaactccaattgtgcttagcagtacaaactgtgcataaacatgatcagatcacaatgtgccaactactagtttgaccccaaatatttccaaagcaaacccacttcctggtttatgcagatgattgggaagccaaacacacaaagcaaaccacagaggtcacaacagtagacggagttattagctatgctgacttaacctgcaaggtggatcaaataatggtgtagatgagtaaatattgaactgtgagaaaacactaaagaaaaaaaaaacagcaacgctaaacattttttaggaatttatttgcccttctcaaagtcgttatcaagcattatccatgaggggaaaaaaatactagcataggtaccaagtcatttcttccctaaaaattagtcatattaattaggaatggaagttagtaaccgcacagttcatacgaaagcagtattcacatggtacactcccgaccagttcaaatctaggaagcaatcacacatggataaactaaagcctaatctgatccagacagagagctacaccctacgaactggattgaattaatcaggtcatttcaaaaaaagaaaaacagaaatgcgcaacgggaccaaatctcgccgcgggacacccctaatcgacgggatcaaccaatctcccatcccaaccacacaccccaaacctcgctaacctcccagctatcccccataacccgatccaacaccgccaaaaattacacgcgaggaaaaaaaaaactcccacaccttcccccacacggcacgcccaaacaaacatcggggcctcaaacctcaaacccccccgaccaaccaaccaaccaaccaaccaaccccctcgaaaggagccgctacgtggggggggggaggagccatcatacgaggatacctcgatgaagccgtcgaatccgcggagatcgatcccggcggcgggaggacacgggcggcggcgagggaatcggcgggtccggagggatcctcccggattgggaggcggcgccggaggctgcggctgcggcggcggcggcggcggcggtgggggaggtcgccgccacggagtttcctgggagggggagggggagggggaggcgagacaggtggaggaggcgccccgagaagcgagcgagtgagagagagagagagagagcgcacgaggaggaggacgcggagcggggggtggctcggaggggggccgtgtcggatgttgtaaatgcgatgcgcctgcggtttgtttttctactgaatctactgctgtgtgagtagagtaggtgggtcaccttgtcagtgtcacagtggcaaaagaaggtgttcattttcttttcttttatttaagatgcaaaaggtgttcatggctgcccctctttaggttttgctattataccatctttaaaatgagttttgaaaaaaatatcaatctcaagcccgcgccggattttgtcattttctcattttcactaatttccgaaatctttttgtctctttttttggtgatcatacgaaatgtttttcgctcttcttcgacgagatgagtgctgccagcgtaaccgcctcgcctcacctcgttccatcttccaccaaacaccctcctcgccaagccctcctctccgccgcaccggagccctcccatcctcgtcgctgccggccaccacagccagtccagtccgcctgtgcgatgccgtcgacctagcctggtgtcagacggcatccgctacacggcaaacggtgatgacggtcgcatccgctggtaggggatgatctttgagggcgcttgtccaagtgctcaggccacggggggagcaagagggggtttgggttcctgatcgcatacggacctatgctagacatggagttgtagatggccataaggccaaggcccaacggcccaacccaagcacggcacggcccgatagttcggccatgcctgagccgagcccttggcacaatgggccggcccgacacgacacgatcaaagaaaatagtagagggatccaaatagacttaatcaactatagttggcaaggcccaaagagaagaggaatacaaaatagacttatttctagccatataagacatagcccaaagagttgaggaacgaaaaatagatttattctatggagaagcacgatgggctgttgtgcctttgggctgtcccggcacggccgcacggtccgagtcttattaggtcgtgcctaggccgtgtgtgtagtccatgggctggcacggcacggcccgacgtgtaggtcgggccaagccggcccgactgacctcagcctaggcatggtcgtgccaggctgggcgacccatttggccatctatacatggagtgcgtgcgccgacagcgcgctctccccgtcctgcagcacggctacgtcccccacgagctgtccagtgagccgctgccgctgggcatctacatgtcgaaggcaccatcgcctcgcacggtcagattcagagttgtcctcctgatgcaggggcccgccgtcgccgccgacacctagtgggaggtttcgcatctcgaggaggccgccactggttcaggtggatggccagctcaacccgaccaccctggcgccatgtacattggttcatcagtgactctatgcgtgacattccacatacttcatcaaattaggcaatttttgctacaggatatccaaattttgtgtaatttatttatatactaaaaacgtgtcacgacttaaaatatatctaaaaaactgataaaatatgctagaaaacactttcaactcaatcgtaaagataaatcccccctaggacaacatgcttcaaacgtggtgttagagtataaattaaaaattatgcaactttaaatttatcatcaccccaagtacatcattcatatacatcatatttcatcttctctccaatctcagctcaaaaacttttaactgtagaggcattctcgtttttctaaagaatttctttctccaattgaaccgaaagtatcctctagcaaattaccgtttttttagtgtcattttgccttgatagttttttcgatgtttactagcaaattacacatttttaaaatgtcctgtagcaaattttgccatctggtctagcaagataattgtgcatttataaaagttctctttatctacctatctggccaaatatctaaaacttaacattacatatcagacatttgtgaaacttatgcaattccagtttggctagggagagtggtgaatgatgcaataacagcatgcatgtgtatcaagcaagtaatttggacccagaaattgcactaagaaatcgccgaatcaaccagctaattaaaataaattgcgccggcacccacccagcttcttcttcccctccccttgcccatgagtgaagcagcacattatctaaataaaatgagtgaagcagcaacgattacgaacatagagaggaacttaaacctaccgtttgtcctggccgacgacatcagcagcgacgacggcctgctccgggcggcggcgcaggtagctgagataccttgtcccatccatggagacaaactttaacctcgagagaaaaaaaaacaaccgattttgtacggatttctggaggctgtgatcagcttaaggccatattttagttcgtgaaaagaaaattttttggtgtcacattggatgtttgaccggatgtcggaaggggttttcggacgtgaatgaaaaaactaatttcataactcgcctataaaccgcgagacgaatcttttgagcctaattaagctgtcattagcatatgtagagcacttatgactaattaggttcaaaagatttgtctcgcgatttttcatgcaaactgtccaattagtttttgtttttatctatatctaatacttcatgcatgtgtctaaaaatcagggccagcctttaggaggggcgagcggtgcggccgctctggcccccgactcagaggggccccacccccaccctgcaggcctgcgccgagcgtggcccaaaatgttacaggcaaagcatcaacatcgaacatatcacaaaccagaaaccgactcgtccgcgtcgctagtcagcgagattgtgccgccgcccacgtctcctctaagagcaggtacaatagcaggctataagccagctataaatatattttattattttataaagagataaaggaaaagagagaagagtagcgggctacagatatatagccagctgcagcacgacaggtgggactagatattaatattatagtaagtaactattgtatgaattacatatcgtggatcggacataagagtaaagttttgagaaattccattagcatttgatttgaccatgttatgtgcggacataagagtaaagttttgagaaattccattagcatttgatttgaccatgttatcacataaacaaactagtagcatgtgtgattgataggtataggagacatgccaattttggttctggattcagccctgctggactgcatcagctcctgctcccaagctgggattatggacagttgtttataagaatagattaaccattatgaatagggtttagaaaaagaagtattgtgtagaaacatcacaagcctctcagatttgtggggtgctagtggtactattcacccttggaagcaaaggcctaattaatcagctgccttgacgcccttcaccatagtcgatactgggtcagcatttacacgacattactcctcatggctccaaaaagagacattactcctcatggctccaaaagagttgcagcaggcagttcattcaaggaccagcttccagcagtcagcagagtgtacatatgggtgcattattgatttattgtccacccaaaaggagaaaagaggctcaaggaatcccattctgacattcatgtattaagccaccaacacacacaaaaaaaaatgtcatgaactgaacatgataggaaaaacagaaagcagctgctacccatttgcctgcacatctatcctaactgcacaagctcaaggtgaagcatatgttttctcctctcatgcgaaactttcacccagcattcattatcacagaccacttctgtatcactcctgcaaaaaactacttcctgaaacttttattaggtcaaacagctcgaaactgagcaacagaaatgcaacgtccacttcctacaatctgtaacatatcactggaatttaagattgctactgttttgcatttacacatgaatatccacattgcacattgggaggtgacaattctacgcaacgggaaaaggcgctacattaaatcaatgatggatctatcagttaataatggaacacatctctacaaggtaaggggaggagggggctgtacaaatggggaaggtgagagagactgttgttaccctgccatctaaaagctaaatccccatgattaggtaggaaaggtgtgagtaggaagaaaaaagaatggtgtctgactaaaatctccaaaggaaaaaaaccaataccctctgcctacaattccttggctagcctaggaagacgttggatcttgtcttgagccaatgcaccatctccttgtcaaggggggaattattcaatacggcatccatcattggagtaccaaagaatcttgggtcactcttgaaaacccatatccggtccttgggccatggcctttgtgcctggttctcctgtaataaaaccacgcagtttcattgagaaagatgggagtcagggaaagaaactgtaatatattgcatatatgaagagaaatactcaatccaacagaagatgatttaatattgtctagaacaaatattctcttttgttttccacactgaacgagttccaagaacaaaatttggaatattttagccacaatgacatataaaaggtaagcacttaccatgcgcgctaacatgaatctcacagttctgctgccatagactcgctcttgtgttggttttactgacttcacatagaaggaggatacatctggcaatgacatacaaccctttctagctcttgtcaatctagattcaggctccgcattctggctataccaataaatgagttgacctaagcaataattttctgggtatgtcttacagtactcctggaagcctggtcccagtttatctgcatatttgggacctaaatcaagaggactgataagaaccggtggagattttaccgtcttgtaatcctgcatgtggtgatccttgagtcagtcctttggtacagagaaaaatcacaaacatttgttgcaaaattaagaggaagttttcacttactcggactctgaaaaaacactttgtgtaagcatacatgtgaatcaaatcagcagcagcatcatgccgacacttgtatgtgcatgaaagagttctcagctcatcacgcaacctgaagaaaagggcggtcagattccagatacaggtgactggagggaagagtcagattaatggtcaaacaaaacaagaatatattctaaactcaccataaaagagaacttcggatttctccctcaatgtcctcggaaccagatggatcatgagcacgaattttggctttgaggtcagtaagtacatcttcctcaacatgaggttccattgactcaagaagttcatcaactaacgagccttcccctttccagatggcagaaactagacttctcccagttagcctcaccagtggaggaggagcattcttgggatccccaaatatgcatctcatgacatatcttacctgaacataacaatgatccataaaaatgcatcagaagagacttcttttgggttgttagtgcatagtgcatgttttttgttcacttatactgaataacttcaagctagggggcataaaatgcgcaccttgtcaagtgtatgagtcaaattctgtaatcttgaattcagaactccctcggcctgagtagtgatgacagaattagatcgattttatgtaaattacgttgcaacttgtagccgttcgaagacccacctgaacctcggcatcattcttctcggaatccatgtttatatctgtgaaaaactggcgcttctcgtccacattgtgtttaaagatctcatgaggaagtttctgtctctcaaagaatataaaccgcacctttgtttacaggaaaaatagccatgagggatcacgatactgattactgtatcaagaaaaaagaagctttaagaaaatggtaactacaattaccaggtgagcagtgtaagcaacaagccatccaggcaaaccagcaagcaaacaggtaccaagaccagctctccccaagtcaattaagtcttgttgagaaacagagtttgcttcacaagcctgtaacagaagactatgtcgatcgagcacaccatggaattccatcaagacctgttccaaatgatattagtagatgagaggaaatgatgcagtataaaattcagtgtatgacaatttgataaactgcaagtgtcagttcctaaattactgtaaacaagaatgaagtttaccttttcaaaagctccttccccagaaaaatttaaatagctgcccctgcatatttgacttccacagagacaaactgacgcttcgtgctcttctttactctggcataattagaatgtattcataagataaagcaatttacgttagaacttatacagaaactagaaatggcaatcacctcagtaacagagttgtaatcaaaagtgatttcctcgccttctgcaattggtcgaacagtgtaaattccaatctgataatgaccatccacagccgttactctggaaatatattttaataatcgtgagttattattacaggtataacatgtaatcttatgagtgcattttactaatttataaatttgactagcatggaaagtgggctttgtggaaaccaatatgggccagttctccttcaatcttaagagtccttcaatattaggtacaggtgtacagaaaatgcttaaactataaatgtgcagttcagtttttataaattgttagccatccattgattgctgcccccttccctgtttgttctcaatttctgaatttcactactggaacaacaaaaacaggccatcagggactttgttcagaaaaaaatacaacagcgcatggtgaaccaaatagaatgaagtagacatgcaggaagagtgaaatcgcattcccccactacagttcaaagcataggatggatccaccacagaatacaacaacaatgaagtcacaaaggcctttcaaaatatgaaaaagacaatagaaggtagttgcgtaaatgatagggccaagcatatatcacgtgcaaactgcaacaccacatatataaatttagttaacagagtaaaccccttccacaaatacagtccaaaagtacaggtcaacactaaaaaggtactccctctgtttcaaaacaaagggcatattttgtttcgttaggacgactttgaccaacaatcgctctattagaatatcatttgtgatacaaaagtataatcataagtacttctggatatgaatctaataaatttatgtgtcgtaaaacttatatcataatagagtaatcgttggccaaactcttgtcctaacgaaacaaaatgcacactatattttgaaacagaggaagtactataggaggagtgataaggcagtacacatacaccacacaaggtactaatctgaagattaagaagcttactttgcttcacagttagggttgcaggagtgacaaattctgctcgcatagttagccttatgcattgcatcaacgaaaaccaagtcatacccatcacggtctccctttttatcataacaaaggtaaaacgatcagttatatgtaccttgacctggaataacataagtcacatgcaaggtcacattaaaaaatttgagattgcactaatacctttggccgttctagcataatgttgtaaaactcaggagcttgatcgtcgctattgttttgtatatgcttaatgccatcttgtttttcataccatctccaagaagggtatacctgcagatattgcaatttcacaaatattataccattgttatatccctttgcatgtcatctaggaagatttgttgatcgtaaaaatcacatacctccccaaagaactcgatgacaaagtcgtctacaccaaatccacccgttttgttacaaacaactccaagaccctgaaagaaaatgcagagaaaaagttaaaaagactgaagttagttaagatggtatgcagggattagttatcacgaaatgcatgccttcctataggcgacatagttatattctgggtggttcctcatggcctttagcattccaaggcacatctttgaagtccgtctgtcaccactctcctctgcagacttttggatttcttcaattacaggtttaagggggtaaaccatgggagtatttccagaaccagtgaactgcctcacttgcttattcaaggtgttcagaagcaactgcagtgaaaaaaaaatagtacaagtgcaaagaattaggcctgcatgtaaactaaaaacgaaattaaaatggctattcaccaggacaaacctcttcaacaaaggtatgtttgtcagaggatggccaatcaagttcagtaggcatcatttcaagtaggagattatgtgtatatggatctattccatacacttcttgctcaagaacttcatccccaggtacttttctaggttgataatccttaacctctggtagttccaaattttcagtgccgttcttctgcgagagcagtttctctgaatagtcatcaggtaaagcgacccgcatctttctcagtacttcctcctcatctgctacaattaggtacttctcaataacctcatacttcctagtcactgggggaacaaggcttgcttttgtcatgcgagcaccccatccacgatcatccgtcaaagactcgcttgattcaaataacttcataccatttccctttaaatcccatgctcccgaatttacatcaagatcactctctgtatcagaaacagtagtttcact

SEQ ID NO: 28669 - DNA, 1355 bp, Oryza sativa
ctgtcccatctctatcagaaatcaaccttgggttctcaagtttctttgctagctggatgaaggccacgacaatctgtttcatatctcccaagtcacttcgacctttatatctgtaatggcatatcaaatgtcagatagtgcattatcacataaaattcaactactttgcaagccttcatttcatttagacccactttaccttaatgcatcttggcacatagaacggatgtcattcttgatataactaaagccatggcgagcatagtatccatttttcaacctaacttcaattttcgcaacctggaatagaaaataaagtaccgtgaactattattagggtcaaccaaaacatcaaggttcagaaaattgtattaaaggatttcgatagtacctttggaacaaaaaaatcaaatctactgctcttcatgatttcttttagtttgttgatgacaaactcttccatcttccggtagctattctcggccttccgctgcatcaaacgcctcatctgtgcatcccttgacaaaaccgcagacgactttctaatatcaagccactttgatcgtttatagaacccttgtccaaaggaaagggtggaactctctctatttgaaatatcagcaaaatagccatcaagctcatcagaaccacccatctgactggtcaagatccttccagctttggatgtgctgttgctcccatcatctatctgcttcaagcttctaattttctggtatgatgcatctggattcaaagagctcttaatccattttacatgctgaaatttgtttttaagatcccctagctgactgcaaccttgaatgtgcacatatgatatgtgcggaaaacgcttaagtacttccgcaagggcaagagaactaagatttgaacaccctgttaaaacaagtgttctaatattttgcatgtcataaccagcctgaaaggaagatacatgattttgagcccgaagttagaagatgacaaaggaaacatcttgaagttagaaagatgagcgaatataccatgatgtcgtggaaaacattatcagtgcactgagggcccaaagaagacaaatcaatgaatctacaaacactcctgtaatacttggctgcagtgttccaccagctacaggtagctgcagaagaaataagtgacttcacgtctgccctcagaaaatggaaaattcttgctaacacatgttcatttaataaaccccagctttcactttccgttctggaattcagagggctttctttaacatgagcagccccctcaaataagtcttcaaaacaacaatcatccttctgactggcaagaatgtcctcagacatatcagtatattcatcactttgatc

SEQ ID NO: 28670 - DNA, 512 bp, Oryza sativa
ccattgacggagcagcacgtcaccgggctgctgctgatctccatgggcatcgtgctgaagctcctgctggagaacaaggagaacgtcccgcgcaggcaggtgaggaagacggtgcagcattgggacgacaagcagcgggagatcagagaagtagaagaggagaaagctcccttggtatgaccatttttttagttggcccaagcaaaggctgaacgaatcacaatacaccaattgcaggacaggatagaaaatgctcaaaaaagagtaacaacccctctccctctgtctctctcatgtaatgttttgctgttgtgagattgttttgtgggtctatgccaaaggattcgattgacgataattacagattaatttggttggaggtgatatcgcatcactgccagttcttcattgtttctcgacaattttgcactcaagtaacgtcgacaggatacccggaaaaaaaaagagaaaaggaaaaacgagtgacgtcacagaccacaaatgtgtgacgt

SEQ ID NO: 28671 - DNA, 1208 bp, Oryza sativa
  unsure (1)..(1208): unsure at all n locations
tgccctggacgtgttcgagcgtgtagccgttgtccggcgtgacgccggcctgaaggaggccctcgcgcagcgcgcactgccaccgcggcacgtcggggcggaacacaagctcgcgctccacccacgggtacgacgcgttgacgaggcgggggtcccagccgacggcgcgcacgtagccgctgctggcgcgggtgtagaagccggcgttaagccagctgccgccgccgagcacgcgcgcccgggcgttcacgacgccgtcctcggagacgaaccgctgggccggggacctcggcgacgtgtcggccagcgcgtcggcgaagtggtactcgctggacacgttgcggttgccgtaggggaggccgccgcgctccaggaggagcacgcgcgaccgctccgacagcgtcgccgccagcgggcacccggccgtgccgccgccgacgacgatgtagttgtaatatgacaccagcggcgcgtcccgcgcgtgcctcgcgaaccgaaaattgtaccctttttgcgctgccacgacacacgcacgaccacattgtcaaagttctataaaaaaaacacaacacatgagcaacacgtacgtgatttctcatgtaccttcgggtgaagcggtgaggctaaggcagagggagccaagcacagtggctactagtaggagtaacaccactggtggcactgagccgtgcctatgaccaggcgccattttggcagagtaatcttgagatttgaagataaaggaggaggtgtggagttaatttatacatgacgagttgcgattcgattagatgaggagtagataccaattagggtgcagcagatgtcaaagatggacaccgaggaatacgggcaatggtggtcgaaatatttgagatcagcgtcgatcagagcctttgcatgcgttcccatcaagcaacgagttcaccaacgtggagactatttttctgcgtactctgcagagtacttactagttcctggactgggccaaatcactcaattattgggcccaaatctactattcctcgaaggctcgaaaggccgcagccatggcgtcgagctcaacgtcggcagcggccagcaaaaccctccgtggactgcttcccggaggagtccgacctccaccgccgctaacttcccttcgtnnnnnnnnnnnnnnnnnnnnnnnnnnnnnnnnnnnnnnnnnnnnnnnnnnnnnnnnnnnnnna

SEQ ID NO: 28672 - DNA, 575 bp, Oryza sativa
ccggagtgatcaaaccttcccaatccgccgcgtcggtttgtgtagtccgtcagcagtgaggtattcatacgaaggtgatggattttgaagattccgtcttcgaatctgaaaatcacatgattggctgcacaaagtttcggttttaaagctgtcaaagttttcatttcgatgactatatgtgatgaaactgtatttactgtgtctcccagagaccagtaaatgataatgttactctatgtgatgaaactgtatttgctgacagtgactgcgcctataatgtatgtgatgaaactctatgtgatgaaactgtatttgctgatagtgaatgcgcctataatgtattactacaagtactatattgaactagaaagtaaccgcggcttcgcgcggaagaccagtccaattggacgcagtgtatatcgtattaattattaagccttatcagctaaataaggcattaatcatgttctgattgccatatgctcatattgcaaagcctaaaatcccttagttcacctcggaaaaaaaacacactgtcagttccatatttatcattgtgctgttctacagaaatg

SEQ ID NO: 28673 - DNA, 479 bp, Oryza sativa
gagtgttttcatcttgactgctatgcgtgtttagagtttagacaagctagagagatcttttgttgttcataaattatagatatagcatgctttctcccagttctttatctttacttccaataagttgacactggtattcacaatttaacagcatccagaattaaacaagtttgatgcatctaaatttgctccctttggaacgaaattgtgagaaatatgagggaagaggattatattaataacacgtaagtaaagtttcttgaatactatgttactgttctttcaaacgtcttaattagatatgagttttttctgatctttcatccctacagtgaactggatttactcttgatgcctaagaataatggatctcttccaattgggcaggggcctctctttttgcttgctagcaaggtcaaaagtcaaaacttattttagcttttaaaaagctctccctgcatgatttgatgatttccgca

SEQ ID NO: 28674 - DNA, 703 bp, Oryza sativa
tatatatatatatatataaaccatgcatatatatgtttcaatacatatatatgcatacatatatatatatatatatgtatatatatatatattatattatattatatgtatatacatgcataatatatatgtatttatacatatatatgtatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacatgtaatagccgcacaagttagttccctgcttttgctttgcgcactacaaataaatgacaaacaacgagagatctaattaatatacacttgtatgtatttgaat

SEQ ID NO: 28675 - DNA, 688 bp, Oryza sativa
atgcacgtgcagcatgcagttgtgacatgcttgatctgaagtttctgaacttctatctgaaccggccagattttattttagaaaatagattaaaacggggcctctacatataaaacagatgtacacagccaatctaaactaagggtgtgttcgctaacagcagatgggaactttgcacagtgcacacggaaaacggagcagctcattagcacgtaattaattaagtatttgctattttttaaaaaaattagattaatatgtttttttaaataattttcgtatagaaactttttttaaaaaaacataccgtttagcagtttgaaaagcgtgcgtgcgaaaaacgagggagaggggatgggaactttagcatccgaacacaccataaatgaggtgcgagatgccaaaagcgcaagcatatctctccattattcagagttgcagatgaggatgaggtcatgaggaggagaggatcctgaattcctgattcctccagccttggagattgatgcacgagggaggccaccatcgccatcgctatgctttgcttggctgcaggaatgtgcacgacaggaatctccgtcgtcctcctgctcctcccctgcgtcatctacgtcctcttcgttgccgttccggtaggacgcgacagcgcccgagagggcgagaggtcgacccaggagcggcgtctggg

SEQ ID NO: 28676 - DNA, 940 bp, Oryza sativa
ttcaactttttcttcaactccattggcaactctaatggagctttctcttctttgcgtagtcctcgtcgaacggaatgcctttaaacaattacaagcatgaatagttgctctagaattaatccaccatgtggatctagagtaatcaacataatgagattcatttacaaatgtaataatgttctcacctttccttgccatgatcattttcaagaagtctggacaatctttcttgtaatgtcctgtcttcttgcagtggagacactgatctttctcaacagcgaactgttgttgctgaggtagatgctgagactgtttagcttttgaggtgggagacttgtggttctttttcttattatctgtaacatagttaattgaaccaccatttgactctttgtttctctcctcctcttgcacacagttagcgatgagcttttcaaagtttcatttctctggacttatgttgtagttgacaataaaattgtcaaactgctttggcaatgaggccataaccaaatggaccagaaagtcatctgttatgcccaaatccattggcttcaacttgaaagccatgttgctcatcctaagtatgtggtctctaacacctcctccatagtacctctctgtcacaagctgcttgatcagctgtgtagcataagtttttgaagagccagtaaactgactcttgattctttcaaggtactctgagacagcgtcacactctgggattgagcccaatatggtaggctcaatcgtgttctttaccacagccaaacatttcttgttagctaaggaccatttcttttgttcaatgtcatacgacatgacgagaggagcatctgttactgggttacttggcagatttcagagtagtccaagcccagagcactggaaattggtaaagaaagtcttgcgttatttgcaaggaacaaaatgcctcatg

SEQ ID NO: 28677 - DNA, 708 bp, Oryza sativa
cgccagagttcgacttttcatccctgatgatacaggctaaccattcagtggccctgccacgaagtgcttgcatatcttcagtcatcaaggcgtcttgtacccttgtcccgccatgtagttgcgcggcggcgtaccatttgccaacttgcgctaggtcttcaatagcgacttggctcaccttggccctctgacattagactacgtccctgatttaccgagccttttaggtcggggcaatcgccaatgcatttgatgttgaagtttttacaactgcatggcagggagcatgctctaggtgctctaatacacaataacttgagtgtgagatgaagaagacgttttacgagtttttcgctggcgggggcatggctcatgccggtctcggttccggctggacttgcgcgtttgcaaatgactttgatgagatgaaagcgtctgtttacgcagcgaactgggggaaaaaaaatctcgtgggtcaggatgtcgccacgctactttcatcccagcttccggggcatgccgacttagcgtgggcttcgtttccctgtcaggacttatcccttgccggaaatggtgcaggactggatggcgagcgaagtgggacgttttggccgttcatcaacctcatgggccaattgaattttgagggcaggaagcctagtgtcatagcactcgaaaatgtttacggtgccattacgggctgcagga

SEQ ID NO: 28678 - DNA, 418 bp, Oryza sativa
tccagctagagtgtaatctgttggaggaaagtggtatgtgttggttattgttgacgatttttctcgatactcttgggttttctttatggcaactaaggacgaagcttttcaacactttcgtggtttgtttcttcgattggagcttgaatttcctggttctttgaaaagaattcgaagtgataatggtggagagtttaaaaatgcttcatttgaacaattttgcaacgaaagaggtcttgaacatgaattttcttctcctcgtgttcctcaacaaaacggtgttgtcgaaaggaaaaatcgtgttttggttgagatggctagaacgatgttggatgaatacaaaactcctagaaaattttgggctgaggcgattaacactgcttgctatatttcaaatcgagttttcttgcgttctaaa

SEQ ID NO: 28679 - DNA, 9259 bp, Oryza sativa
  unsure (1)..(9259): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaccgaagcacatcccaaggttttacatggagcacatgcgaaagttttcagacatgcatctccgatcggcaaatccaaataatcaacgtagaaaggacttaaatttcggccataacagaagtgcatatgcacacaatgcggacgtactctgctgagttttcctaccaatgagctgctgagatggtcaatgtcactctcatcggctcacagcctgacacacataccagaagggactgcagcaacgatcacttcccttgtcgttgctagagaacggaagggagttgtacaggactggaatgcgatcagctaacatgaactggaccatactcagatcgacgcagttcaccttgaattccccatgaatcccattcttaacttaagggcatgctatcacttctcgtcgtcgaaccaccgccggtacgctgatttctcgtagaaatgaccagggttcgaattttgagtattgagcgatcagcgtgacttggaatattgagtgatcgagtgtgacttggaacttagtgctattcattcaattgtattacaatgtgttgaatagtttcatattagttgtggaagagtaagagagttaatatatagaacaattttacggttcttgaggaggtaccactttttctattgtaaatttggtacttcttggtacctaagtactatgaggtaccaaatcttacactaaatttttggtacctcatagtacctcattaaggactataaaatgtaaaatcaaaggtgtttttgattattattctgtgatgaacaattggcattggagattattggttttgatatttggaatttatttacgaagtggttttggagatgattgaatttacaggtgaattacaggtgctgtcattttatgtgaccggtcagaccgggaattgtgtgctggtcagaccggcggtatgcgcgcggtcagaccggccagcccgcggtctgaccggctgactctgtgtcggtttcggtttcgggttgtttgtttggatatccgtgattatttcatgattatggcttctagatggatactatacatatgtaatactgttgtttgctactaatgagtcaagttggagatagcttgttctcggaatatggtttctttgtttatttcatgtgtaggtgactcgatgcctcgggagagtatttgcggtgatggaccgggagtcggcttggggataagacgacgttcgtggtggtcagagatcatgcgggatacttaggctagagttgatgcacgtggttgatggagattccatatggcatacgatggaggtattgtgtgcgtatgggatgcggagttaaatttggaaggagtccaactttggtacgattggttatgtaaagtttgtttcttgtactagagggtttcctaaggtatttagaactctaagtatgagtttggttcgtggctttaggctgcctaccttgggtataaatagtgggggagcgtgaggcttcccggtatcgcttttgagagcaattgagttgagttttgagttagggtttcgagtttagttgaaatttttgtaaggagtgctgttggtgcactttgtaaacacagatagaatcaataaagtcgtcatccactttaagagttcttcgatttgtgtttcactgagtttcggcggtccaaccggcgatataccgacggcaagacggcggtcagaccggcgggagcaaggcggtcagactggcggaggtagcaggtgcggcaggcgacttcggcggtcagaccggttgatctataccggtcagactggcggcatccgagcggtcagaccggcggcatccgagcggtcagaccggcatatcaatctcggtcagaccgacttccgtcgaattcgagagtaacttttatttccgctaaaagttttcggtttttgggtataccaaccattcacccccctctggttggcttagttattgtgattcgatcctacataaaattgctctaatatataagtggggggacctctcatctcattggctagtttttaggatgagaaaaaccttttacgatccttcaattggtatcagagactggctagttcaatatctctggtccaagggacacagtatgtgaaggcccgatggaccgtgggtgcctgcgagatccgtatacctaaggaactgttagtgtacggtgaacagctgagggacaccaatgtgtctcacctcattggctagcttttagggtggaaaaatctctttacgatcttacacaatgtagtgttcatcgttgatgtgaagtgctgagaacttaagattgcttgataatatggaatgtgtctctttggtgattgtcagtttctcgttgacaaatcacaagtgcaactcattatctagtatatgtttcaactgtacgcatttttcatttataggttcaacaagcaacatataaaacgacttggttagacattttttggagggttaattaaaagggagatgaattgcatctcggcctgtgccaaagttcttctaattaaacaaatagaataaagtcacacgacactaaccccatatagagtaaattaggccccatggggattaagaagaaaaacgaattagctaggcaaagtatgcacctatatacttcctcctgtgcttgggagttatggtgtctattgattgcttgccatctaacggtctgtgataaaaggtactccctccatccctaaatgtttaacaccgttgacttttttaaacatgtttaaccgttcgtcttattttaaaaaaattaagtaattattaattgtttttatatcatttgattcactgttaaatatatttttgtgtatacatatagttttacatattttacaaaagtttttgaataagacaaatggtcaaacatatttaaaaaagtcaacgacgtcaaacatttagggaaggaagaagtatgtctcagaaggtattaaaaaagtgagttaggtattaactcgatgtttaggtggaaggttagattagtaactttactttcatacatattagaggtggggttctaattaatcagtaaaagaattaggatcgataagccctgcttgctgataagaacatctttcttcagcaagtgccgcacggacaaaacaccaccaccactgatgatccacaatgaccaagaattttgtatacatacaaagattcatcaaactagttgatcgagccatatttgtctttgtgtatggacgaaagaggattatatgtgtttctttggactctaaatttagatgagaacctgaagaattaattagggaaattggattttggacaagtgttaagatgtgaacgacagaatcgaagataagtaacaaaccggatgcaaaaaaagagagagactgttacatgtaaaaggaattaattatcgacttttataatatattgttttctattcctaagttgtgcttaactgatcaatggtgggtgattaagtagtgagggaggtacctccatctggtacatctcaagcaccttaaaaggtttcggccgtcgttttggccggaagtggacaagcgttgggcatgtggactcggtcgatcgaggtgagactcacaatccatgacaggtagcgacagcaccaaccacttcctagcctatgcacccaaaatgggatgggggcagtgtagcacaacctttgactatacaaccacattgtcatcaaatacagtgagccgtgctgctacaattggatcctattcacatcacggaagttcttctcgaattccccatgcatcccattctcagtgtatatctagtatttggtttgtcgaaccagcaacacatgttctaactctccttatcaccgatttctagtagtcagtggaagagatggtcaaggtttactgattttggagtgcgggtttgtctagagaagtagcggttatcctatttataggcactaggcacttggcgaggtaaacgtagagtgatctttactccctccagttttataattcttgacatattgaacaatgacacgatctttaaaatatattttgactatatttttattataatatataatacaataaaaatatttttacttattgtagcactttgtaaaataaatcgatatattgttctagcacttgacctcaaccttatttaaaacgtcaagaattatgaaaccgaagggaatagttattagcagttcaacactacactaccataccatcttattggagaaaagaaagtgtaacattagactccggatatttagtaacacgcatttgactcgtcacaatactgatgtacccaacaaagtataactatttcataacaacctaataggaggtggaaaaattttcatacatcctttgcccaaaattggatgctaccgtcctagcagtataagtggttaaaaaaaaagcttggctcaaaatccatgacccaagcatacataacacattataagtggtcaagaaatgagtttgactcaaaatccattgtccaaatatatactatacatttcttagcgaacaaatgttccatgtgaaaatgatataattggagacaagattacatcgtctccgccccacgaaagctcaacggactcactcttgtatggttggcaaatggcaaactaatgtagtggccattaaggcccactgaatctgcatcagggtttacaaaaccacgcgattatcacgtgtggtaaccttctcagttgttaaaactgtggtaatcctcgaggtaaccactgtttttatgataaccgcgcgggtaccgtgataaccgctttactatggggtgatggtaacctcacctaaaacgctttggtgaaccctgatctggatcgccacaattgcagtgatccaaactggcctattgtgaaatggatcacagaattagtttgggcccacttgcccatagaagtaattgccatttgaagatagttaaactagtcattccatttttatatataaaaaaaatagtcagatctgatgctcgccttgaggaagccgagattgacggggagttgccggagctccagcgagtggtgtcaccaccggcggattttcttcgccgctgtatctctagaacatcattttctatccattatcgttgaccgtctcgacgctgttgcgcatcatttgcatcggagggctactgtctattgtggctcccaatcgcgttctaaattttggaaactagatgtccctggtacgaacccatttgttccgatgtgtctttacatatgaagatagtaacagagtcagtgcttgtataccatttgaggtttccacctattttttaaagatatatacctcttcatacttaagatctctttttataaacggagttaccaaaacaaatgttaaaggttagaataagattgaaaactcatttttttaaatatcctttaatttttatttcatttttaaagcacaagtatatatgtcggtcaggaggtatatacctcataactaacaatatgtggcatatatacctctatgtactttccaagaataaaaaaagcttcatcattactaatcataaatttatcttctaatcagtttagtcaatttatttttttatcactaaaataataaggagatatatatacctcttcaaagatggaagaataccttatatcagtttccaacaagtttcgaatttttatttacaagtgcataatcgaagcacatcccaattaagatattcactgtcgaaatgtttttttttatcctcacaacaaatctgaggatcaacccaaatttcgagaggatcacatatgtgtgtcttgcgacgatgatttgctgaacacgatctttttaagcgccggcgtggtgccctgatgccgcgccaccacatgcacggctgcggatgcgggtttgcctatgcccaattctttttctgatcaactccaaacttcaactttttcgttttttcgttagcatacttttcaaactgttaaacaatatatttttgacaaaattattatggaaatagatgcacaatggagacacgaattttacgtggaaaatccttgcggaaaaaaaccacgggcgccgaccggcaatgatcactatagaggagttgattataaacatagggaaatcacaatgggaacgtcaccccttcccgtatgacttacaagagtatatataggggataaaagaaaggcacctaatagggctcctactagaaaactaatccgaatatattgtggacccaaaattcggatcacatatttaacaatctccaccttgagatgaatttcctcttgtagcataaaaatatcaatcaccaaaaatacctcatgtaggtaaaatcaccgcgcgccaaatagtctctaggactatactgtgcacccaccaagcttgagcaaagctcaaacttagtagtaggaactggctttgtcatcatatcagctgggttatcatgagtacttatcttgcatactttgacatcaccttcagcaatcacacctcgaataaagtgatatctcacatcaatgtgctttgttctctcatggaacatctgatcctttgtaaagcatattgcactttgactatcacaaaatatattaatgcaagacgtaactccacaaagctcagtgtacaaacctctaagccaaatagcttctttacaagcttcagaaatagccatatactctacttcagtagtagataaggcaacagttgcttgcaaacttgccttccaactagcagcacatcgtccaatagtgaatacataacctgtgagcgatcttctcctatccagatctccagcaaaatctgaatccacataaccagcaagtccatctctagatctcccaaactgcaaacaagcgctagatgtaccacgtaggtatttgaaaatccattgaacaactttccaatgctctttgccaggattagccatgtatctactgacaacactcaatgcatgtgataagtcaagacgagaacataccatagcatacataagtgaaccaactacacttaaataaggaactctagacatgtactcaatatcataatctgactgtggacataaatctgaagataatctgaaatgtgcagctaaaggagtactcactggttttgcatcatgcatattgaaacgacgaagaactttttcaatataacctttctgactaagatataacttgccagaatgtctttctctagtaatttccataccgagaattttctttgctgcacccaaatccttcatctcaaattcactactcaattgtgccttcaacttttctatctctgatttatcttttgcagcaatcaacatatcatcgacataaagaagcaaatatatagatgaaccatcaacaactttaagataaacacagctatcataattggatcttctaaacttctgagaaaacatgaaagagtcaaatctcttataccactgtctaggtgactgctttaacccataaagagatttctttaacctatatactaggttctcttttccaggaacaacaaaaccttcaggttgctccatataaatgtcctcttctaactccccatgtaaaaatgcagtcttaacatccatttgctctagttcataatcatgcactgcaacaatactgagtaaagtgcgaattgaactatgcttcaaaacaggggaaaagacatcattgaaatcaatacctggaatctggctataacctttagcaactaaccttgctttgtaccttgcctcatcacttggagacatacctttctttcttttgaagatccacttacaacggataggtttcttctcctttggcaacttcaccaattcccaagtatgattcttttcaagtgactccatctcatcatgcatagcagttatccatctattgcaaccatcagaaacaatagcctcagaatatgtagaaggttcggcattaccttcaatttcttctgccacgctcaaagcataagcaactatgttcgcttcttcaatatatcttcgaggaggtttaatatttcttttgggcttatcttttgcaatagaacgttttggagactgctgaacagcagaagaatctgaatcttcaataacagatgcatcttggttaatagcaacatcttctttttctggtgcatgccctgaactgatcaagtgctccacctgcacacttgctttctcctgactctcaacaggaacattagtagaaggtttgtcatgtaacataactgattcatggaagacaacatttctactaatcacaacctttttggttttaggacaccataacttatagtctttcacaccagacggataaccaagaaaaatgcacttaatagctctaggctccaatttaccattatcaacatgagcataagcagtacaaccaaatactcttaagtctgaataatttgctggggaaccagaccatacctcaattggagtcttcttatcaatggtatatctgggtgatcgattgataagataacaagcagtggaaacagcttccgcccaaaactatttaggcaaaccttcattagacaacatacaacaggcctttgatataattatcctgttcatacgctcagctacgccattttgttgaggtgtgtgaggaacagtgtagtgacgcacaatgccttcagacttgcaatatgatttaaatatcatagaacagaactccatcccattgtcagtacgaaggattttcacctttctttcagtttgtctttcaaccatagttttccactctttaaacacatcaaaagcttgatatttgtgcttcaagaaataaggccaaacttttcgcgaataatcatcaacgatagtcatcatgtaacgagcacctccaaaggatgtcttacgagcaggccccataaatcagaatgcacataatcccagaatactttcagtagtatgtgtagatgtgttgaactt

SEQ ID NO: 28680 - DNA, 417 bp, Oryza sativa
catttgtttctggcgtaaaatgacataaacagtgtacaaaaaaaggggagaaattcatcagttgtaacttgcaaagacatatcatcgttgacaggcaggaacaaaatccagcacagcttctcccacgagctcctcccagactccaccctcaatttgctcggtaatgtcaaccaactgcgtcctcatcgttttcacccagcctgttccttcaacctcctgcttcacaactctctctatcatgatcccagcattatctctcctgctcaccacgaacatccgtgccccgtaaatccaatctttcaggatgctccagacttctatccccaatgcaggagaggaggcgtccatccatgttcttgagtgtgctttgctccatgggaatgtacttagcaaggtgttctcgccgatctcaacaag

SEQ ID NO: 28681 - DNA, 371 bp, Oryza sativa
atttcagttaaaattcacagatgataagtgtgttcttatgaaaatacaacgttaacaaagattctaagctcaccttgttttgtcttcatcatcatcaagtttgatcacaaatgtttctgacacaatagggagtgcatgtgcagtatacaagctttttctagtatcaaaaacaggtatcttgtttctgaaaactctttctccatgcaatttaacaatctctgaaagcacagcttttttagtaactcctaattttggctcagggtggatggaaacctaataaagaagttcaaaaaatcgtgaaacaacaatcatcagaaaaattattcttatgaagtctaagttgagcaaagtacaaaatatatcaaaaatca

SEQ ID NO: 28682 - DNA, 462 bp, Oryza sativa
cgaagatctaataaaatgctgtgtggctgatgcaatgagtgaggtagggctaacaccatccatttttcctgacttaagtcaccataatgttcagtattaattattaaatgcctgaaaatttgttttgatgttattcttgtgccgtgttgcaaatgcaggtccgtgcaactgcaagatcttgctataggatgttcaccaagacatggcctgagcgctcacgtcggctttttatgtcatttgatcctgcagtacaaagggacaagtaaaacagatgtacatctatactttcgattttaagaaggataaattttggattgtgcttttttcttggaaacagagtatcaaaagaatcggtgtcaaaaaaagaatatcaaaagaatcaacatgctcaaaccactagaacattagcctaaaagaacatatgcagcatgcacaactctgagcttttacccaacaatatag

SEQ ID NO: 28683 - DNA, 657 bp, Oryza sativa
attcattggagatatcatggttgtcttttgtatcgctcaaccagtatatagtgcaagtgaggcactgttatccaaattgaacttggatattcgtctgttttaaaaaataaaaactactcagctacatttcacacattagataatgtgaagcttcatttcgtggcatgcatctttgttggcaaccctatacattgcgtagtcatttaggcatatgaagctctcctgttaaccgtaatgattaatatttgacattatcatccctctaaaaaactcatcctagttatatttactgcaaatacaaattgccctaactgcttttagctgatctactatttgctttccgctgaaggatgtaatgcatggagcacctgttatgccccaaggatggtctcttcctgcaccattgaactcacatcaagctagcctccagaagttccaaggtaaaaatcgtactcattgtcgactgcttcctttattttaatggaaggtattaaaatgtttattttatttattcattacactaatcaaaacattttacttcgaaactcttcaggcacagcccctgtatatgtagccccacctatcatggcaactgggaacctgccatttgtggtaccaagccctgcaccgcttgtgcaggcattccaagccgttcgt

SEQ ID NO: 28684 - DNA, 13062 bp, Oryza sativa
  unsure (1)..(13062): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccctcttatgctgccaaagatgcaatgctcacaaaatttgagcttcccgatgctttgtccatctagcaatcctcgcttgcttaattctgccaaaccaatttcactcatatgcccaagacgcatatgccaaagattagtagcatcggaattatataatgaatcagaaactgcagcaatattacctaatatagttgtacctcgcacatggtacaggttggcagatttaatatcagctttcatcacaacaagagagcctttagttaccttcaaaattccgtctccaccggaatatttgtacactttgcgatcaagagtacataaagagatgagacttctcttcaaatttggaatatgccgcacatctgacaatgttctgatacaaccatcaaacatcttgatctgaactgtttcaacacctgcaacctcgcatggtgtatcatcacccatcaaaacagtaccaccttgcacagcttcataggtggcaaaccaatccctattcaggcacatgtgataggtgcatgcagtatcaagaatccactggtcactagtttgtgcacaaccagcataagcaacaagcaattctgcatcagacttctcatcagtaacaactgcggctttaccttcctcttctttctttccttttggtacatattttccggttctcttgtctttatcctgtagcttccaacactcagagatatcatgtccatctctcttgtagtatttgcatgacttatacctgcctctggactttgatctcccacggtagctacttgaacttttatctcttgatttgctgtttgtgttcttctcctgttgcctgccccgaacaaccaagccttctgcttgtgaatttgaaccttcagagggtaccatcttctttatcttttctttggcatgcaaagcatcataaacttctttcaaagttagagtatcacaactataaagaatagtatccctgaagtttgcatatgagctaggcaatgaacacaatagaataaggcataaatcctcttcatcatactttacctccatagactcaaggtcagcaacaattttcttgaaagcggagagatggtccattacagacccatcatcttgcaacttgtgcaaaaataacttttgcttcaggtgcatcttactggtcagatccttagtcatgcatatctgttccagcttcaaccacagcccagcggctgtctcctccttaagcaccttcctgcaaaatattgttagatagatgaagatgaatatatgacatagtcttacgatcccttttcttctcatcgttggaccaatcctgagtcctcttgtcaaatccagaaagcgcatcatcgaggtcttgttgtgcaagaacggctcgcatcttcacttgccaaagtgagaatcttgtgtctcggtccaggagcggtagatcatacttcaaactcgccatgggaattaatcctgaatttgctagaaagaaattagggtaaatctagcaaaaaaatgcgaaacctggtacgcttctcgtgtgcacgtagcgtagatctgaaacttcctggtacacaagcttgtgtgcgcgtagcaattccacgtgaatagaaaatcacgtgaacaggaacctgatcgcttccatcgttgacttccttttcagcctcgggaaccgtgcgatttagttggatgtattgacgccgctgctactcctggacgtgcgcgtagacggcttgctgctgctgcttgccaatcttctgatgcgtgcgccgtttccaggacgtgggctgctgctgccctaatttcgcgcgggcggtagggatgacgccgatcagatcgatccggcgcctcgacgaaccggcggcggctgcgtgacctgtagatcgatctccaaagctctcataccacttgttatggaaatagatgcacaatggagacgcgaattttacgtggaaaacccttgcgggaaaaaaccacgggcgccgaccggcaatgatcactatagaggagttgattacagacgtaggggaatcacaatgggaacgtcaccacttcccgtacggcttacaagagtatatatataggggataaaagaaagacatctaataggactcctactaggaaactaatccgaatatattgtgggcctaaaattcggatcacatatttaacaaaaatgattcctatgcacaagttatttaaaaaaacacataatgtatttttaaattttataataattaatacttaattaaccatgtgctaatgaaattaatcatatgataatgagaaaataatgagttttctcgtttcttatgcgctgaaaatatccctatgtaccattgaatcgaacggagtcgtcggcactggagggataggcacatctagttccgtatcggtgtgtctagcaagccattggaactcaccctgcagggatcacatcatgtggtgtgcatgtagaatgaactaaagcacagttttcagtggcagtgtgaatctgcgaggggctaacgtgagcagtggttgggtaactggtgccagccaacaccaatgctgctcatctcgaattctcggcacatcccattctcaaagacatttgcatcgttgaatcgccgagacaaatgttctaccctctcaccgctgcttttccacatatagaggaaggtgatggccaaggtttacatttactggtagtgctatagttcttctcaacctgcgctagtttatttataggcgcttgacgaggtacactagctagcatgcacttaaagtaccacaccaaccagatgagaggctttgatcgaacgatatcactgacaagacatgaagtcagatggattactcttctgtcttaaaattaaccaaacttacaattagatgagacataatctaatacaataaatttggagaagatcctgtttagattcgttgttctaacatgccatccaatcctgattgatttatttgggacatagagaatagctgatagtatctgattggaagtttggaactgacaaatcatggacaactcacgaagacaaagaggtacatttgtagcgacatgcatcatccattcataataagtgaaatcgaaacgatgattcatgtgagaatatatcatacacacacaaaatctaaaaaaaaaaaaattcagggaataaagtactcatagagtttgagtttcacaaaatcttgtgcccaccagttcatcccgattgacattcttctcaacaggacgatcaacagatgtgtttgaccttcggtgattattggttttactagctgttttctcgttcaaaagatgaaactttgctatatattggactctatggtttagtagaaatgatataatttttgacaaatcctcaataaaatcttatatgtatgtactatttagggcaacgtattggttccagttctgagcacaactataaatatgtgacgaggacaaggaacaaactgcgtgccgaaatttagagacgtcatgcagatatttgccaatctcggatggaaatttacaaacaaacttgaatagtgttttctctattttgtgttggtattattagtcattgtttagtcatttcctggtttttatatgttctttattgagtaaagtatgtaataagtggctctaactttttttgaagcaaaaatgtcagaattctttccattatctaaaacaaggaactttgcagattggagaagaatgaagaagacaaatctcttgatgatatcgccagcgagacaaggaccaccgagtagctattatatcttattggaaacctggtttagcaattttgtatttgcacatttcaaagttaagaaaagttaaaattttcagctacatgagagtgtatatatcagtacccaacatgcaattctcatatacatagagaagatcagaactgaagcacatcccaattaagatttgatatggtcaaattaagttttccttaacgctatatgttcacaaatcacaggaaacaaacccagattggagacgataggatcacaagatgcgtgtgcctttgcgagaggatggttcgctggataagatcacttgtgcacggctgcacgctagttgggcggaatcccctactcctgtttacccagcaacgccagcatcaccatacgttggggcctgaggttgcacgccacacctacgtactaatttgtccaatgtgtgcacgcgacgatgcgctggatgtcgcgacgacgatgctcgtgccgatcacatcgtatgctctgcacacagactgaactaaactagagcacggccatctgcgacatcacgaatctgtgagaggctaacgggcactggggtagcaattggagccaatctagatcaatgttgctcatcttaaattccccacgcatcccattctcaaggggcatcgtattgtctactctttctcactgttgattttccacttacagcgtttatatttactatgtatggtattaattgctatagttctttctagatggtagagtttatttataggcgcttgacgaggtacactagctaatatttcagtgccacaccagctagatatcacaaacaaggagtgaaaaggactacgacattcatctcaaaatgttgctacctagtatagcatgtgacattttctagtataacgaatctagacagtaataacaatattttaagacggagatagtagctgatatttgattgtaagtttggaactgataaaccatggacaaactcccaaagatagaggtacatttgtgcacaacactatggctatatgcctatattgcgcgtctagccacggacatggctcatctgtttataacaagtgaaatggaaacatggtgcatgtgagaatagatcatatacccacacacaatccacccaaaaaaatattgcattctgagaaagctgaaaattcatggaagaaaatgctaattaatatataatgactccaattggtacagtgcatcagaactgctcataaagtttcacaaaatcttctacccacccgttcatccggattcaccttcttctcaacatggcgatcaattgaagcgtttggacctcggtgattattggtcatactccctcccactagttccattccatgacacttctcgtccaaaagatggaaccttgcaaactggagaagaacggaaaacgcaaatctcgtgttggtgatatcgccggcaagacaatgactactgagtagctattatacttctaatctgattgaaagcagggtttagcaatttcgtcttgcacatttctgttaggtgatatttcacttggatatcatcaggaggagatggggggtttgtccaataataacctcgagtatgttttgtttatcttttctttcttcattagctacgtgtgctcctgcaatttcaaagaaaacaaaaaaagtggatcctcctaaaggaaaatttcctccacttttgttgtgtactggtgtctatctctctctctctgagagcttctgagatggccaatgtcactctcaccggctcagcctgagaaagaccagacgaagcagcagcaccgcccgcttccggcgtcgtgcatagagaacagaagggacccgtactggactgagaagcgagcagctaacatgaactggaccatactgatgtcaccaaagttcatctccaattccccatgactcccattcttattaaggcatactatcacattttgttgtcgaaacgccggtatatgttgtgttgctctttccactgccaatctcttgtagatagatgaaggaggaggtcatggttttatagttttgttttaggaagaaaatagaattatagtttggttttggagtgctgattctatatcataggagtagcatctatcttatttataggcacttggtgaggtatattgtatcatatatatacatggagtggcccgaagttggtagcacttgctttacgagccctttggagaaattgaaacaaaatattagtaatacgcgtataatttcttttagaagcgtagtacaaatgtaagcgctcataatgcactcacacccacccctataaacgcacacatgcctcgccctatcccaataagcatccaaaaaacctggaccgatatatattgagattaacgaagtcatcacggacatctcgttgtcgatgggtacgtcgtctaccactgaaagaataattagcaataaatgtgagcacccgtgtcaagtttaggactataacgcgtgtgggttgatttcatcacaagaaatccaaccagttaagctaagctcattttataacccatatgtttaatttgtcacgtgcatacaatgaactcatgaagcataacaaactatttatatttcacaatgtagtgggaggaggaaaaaatggacgctgtagttaacttccacaacttcttttctaatcaaaggactactctagatttcgagatcaccataggatgtgtgtgccttgcgatatgttggtttgctttatatactacatcatctcactcgaggtgtgctcctgccttacttttgtttacctagcacagcgctgccatttatttatccagagcaacatcacgcgttgtgaccacatgcaacaagtggcctcgcgtataggcggcacactcactgtcctgggcaagccgagggaaagaatccccgtgtctagtggccgatctagaaaactgattcgttagatgccataatatatctattgatgtattgttatagcatgtcaattatatttaaattataatgttagtataatttatggatagatccgctccggttagggccgatcgatcacatcattgtcagcatatgctcttcacacaaaataaactagaacatgatctcctacgacactgaatacgtggctaacgtgaccggcggtgtgataactggagcatcaacgttgttcatctcgatttccccatgcattccattctcaagacatgatatcatcgaatcgccgtgacaaatgttctattctttctcatggttgcttttccgcatatagaaaaaggtgatgggtacggtaaggcttaaataaatgtgacagtaagattttatattttctagtgctatttcttcgcagtagagaagcatcagttagcttatttttatatgcgcttgacgaggtacactagctagcacttcagtgccataccaaccagagatgtttggagaaattaaaggctcttaatgatatcaccggcaagacaatgattaggagtagctaattaatttttcctccgttcctaattaatcatcgtattacatgagtgaaaaaagaacaaggaaaactaataactctcactatatttactcggtaacaaatttgacgcattaaaaaaacaaattcgatgcatgcatcatccacatttcttcccagccaataacaaatgaggacattgcatgaaaaaagattgacgattcgaatcaaaatcgaaatagcatctacaagatgcacgtaaattctcagctgaaaattcattgaagaaatgatgtcagcgactagagtttatttcacttctagcattcaaaatctgttccaaaatacaataatttctttacttatttcttgatcacatatgtattatccatgctcatcgggaatgtagtcttttctcaacttgtgatccaggtgctagacctacgcactctgattctcggttagtttggccctcttcttttcgattaatatatagatttatctttattttcattaacatgcttttcaagttattaaacggtatattttgtatgaaattttttttatagaagttgctttaaaatatcatatacatctattttataagtttaaaataattaaaacttaattaatcatgtattaatgattttccatagcacattgaattgttgcagctcttggaatctatcgcgactaataaatcgaaacacatcccgatgcttgggagggagctggcttcccgaatctcagaaacaatgatcatggtagaaacctagaggaagaaatccatgaaatcaacaccaaatgtgacaacatacgagtacaacatctcgttttgagcgttgatattgcactcatcttgtatgtgaaatcccaacacatcccattcctataaaatataatcatcgcaaccatcaaagaaaataaaaaacaatcgctatgggcaagttttgcagttcgcaagtaatgctgatccttcaagggaacgagcagtagtagaacggtgaactattatattaatcgagtattatttactataaacttgaaaataaaattatttatttattgaaagaactttagtatagatttttttttcaaaagcactctatttatcgttcggggaacatgttaacgattaacgagagagtcgctcaaagcagtacagtcgaaacgaatgggcccttagggtgtgtttgagaataaggggattgaggagattgagaagatacgtaaaacgagatgagctattagctcatgattaattgagtattaattttcagtggcaacacttcccttaaaaaaaattcgagggctgcaacaatcatgtgtggtagggacgataaaaaatgccgcgtgcccgttgcaagccaagcggacaggagcattactggtcactgatgagctagagcacacggtaccactccatcacattgttggttcctgagaggctaacgtcaccagtgatgcctcctctagagcctctctatgtcgaattgtcgaggttgtttgtgtcaagttcccaatgcatcccattcttagggcaccctcaatggttatctatatgctatctacaagagatccatgtcagcatattttcctacttggaagagattaaatgaagagagagagcaaagttatctactaacttagagatagtctatagagaaaaacgaggcaatgaattagagagctatagatacccatgtagacataccattgaagtgatttactattaatctagtctattgctgagatgtacatgttttatagatagcacattactttaccattgcgggtgctcttagagatatcgcttataatgttctatctactctttcttcattgctgctttccgacagtcgacacagaaatgtgatgcatgatcagggtttacttttctggtgctagtgcatagaggagtactccctccatctaaaaaacccaatcctgaatttatttgaatctgtccagattcaaatattgggttatgttttattttgggacggagaaagtaccaagctagcacagtatatctgtatatgggcactgacaaagtactagcggcacaccaaccagatgagaggatagagtctccgtccccatataagtgcattctagaagagaatatcagttcaaattcacagtcctataatatgtcacatcctcttcaaaatacgtttatattgggatggagggagtacattattttctgaatgatattggtatcatccggtaggacaaagaggtaagtgattcaggaaccaagctacatcagagaaaaatcatgcggtgttggtccgttcgatccacatcggacggaagctagcgagagcagccggaatcaacggcctcaccttggcccacggcaacaaaattgccccacggatgcacaactcaacaagcacttccaaacttcacgatgcctccttcctcatctcttttctcaccttgccccatggccggtagccgcgctcgccgcctccacgagcctcggtgtgggcgcagctggagcatactgccaatgaagcccctccaccacaaccctcctccctatctcttgtcccagtggcctcgccgtgtgacaatatagagcactaactagcccaaactttagaaaataatgacaccttaattagaacccaagtgttacactgagtcaacaaccatgtgtagttgattcaagtgtaccatgtgtagttgttttaagtgtacaatatagtataatatatgagaattttatgtccttgaggtactaaattttacactaaatttttgatacatatagtacctcatcaagaactgtaaaattgctcataatatatattgttcatcatagtgtgaattattgtgaatttgtgattgcttgatagtatgtagtgcattacttgtcatcaactttagtcatccatagttatatggggcctatggcaattctcaatatctcatacacaacatgacggatgctgatgaggatgatccgtattccgtaagtaacctagcatgtttctattgtactcattcttcattggaagttctaagattgaagcataccccaatgtcaattttgcatggagcgtctcgtgaaaggtttttgtcacgccctgaactagccccgaacggaacttgcccgtgacgctccaaattaacctgttaatcgataccagtcccaggaaacagtgctgatatcacaggaagacagaatatcacagcaacagaggtctctttattacagagtaggagtacagtcatgttgggctgcggatagatcccgagctcacaactgcattacaaaagggaaagcggaagccaagacttggaccaatcatcacaggcgcgacttgggaactagaccgaaaccctaaaactcatcgtagccgacttgctcctggaagaactcctcatcagcgggatccacttcatcctcttcagcgactgggggggtattatttatatagagcaagggtgagtacaggagtactcagcaagccatgggaattaagtgtttaatgcaggcttcaaaggaaaggctgttgtttttgcaattgattttatttaaactcctttttgaaacaactaagcgagtgcttctcaaacgacacgaatgagacagtgcgtcttgtccggtcggagtatgtgcagtgtatcagtctttgaattgatcaaggttggcacccggccaacagctttcaaatggccacccaggcctagctgatcctatcagccgcagattttccaaacatcgatcccattccacaacagcaatttcacaaagtagtagtcaaacaaaactacgctaggaatcacctcacatccgcccatgaccgtgggcacggctgttcgaacaatttaataacctctgcagagggagtacactttacccacacgacgttactagccttggtcacctagcccgtgtggaacggccacgtctggagaccttgaggctttcatgacaaggcatttcgaaagccgacacaggttcaccatatgccaacgagaggggtcctagaccgacatcaggttaggtcccagaccatactgtgccaggaagcccgggggttctccccggcaccaccccgttgaatccacatgtctcttggcatcatggctcccctgattagctaattactcagccaggggcgtcccatttcacccatgtggtcgcacttgtcttatgttcggatgaaattcctagggaaacggtccttaagtgcaagaacgggaaaccgtactcccggtacgtcccccggtctgcggttttggaaattcatttagttcgcaagcaccgacccatgtgtcgggttttccaagtcttttgtaaaaccccaaattttacccatagttggatattttaaatttgaggggaggtgttctgatgcccgtgcccgaaggcccgtgcatcgaagcacaacagttgacaaaggaggttcaagtgttcaataattcacggagggtaattgcagcaattaggattggggccggcaggctatctcacaagccgcggccgaattacttgtgttaaacctattcatgcaacatttgcggaaaagaaatacttagatttaaattataggtgcaagatgatcaaaagtgacttgccttgctcgagatcttgagcttgatcctcgaaatcctcacactgcgggtcttcgggctccgaaactacacgcgaaatgggacaactcaacaaacggcgaaaacaaagccctattattgacctctaagcgtgccattagatagatcttgagatttgaggaattttggaagttgaacggagtcaatcggatgtacggttgagaagatattgaatttctaagattattggatttttgatctaaaggaaaaaggatttaattaaacccttttggaaaaagaaagaaagaggaaggggaaatagacttccctcgggcggctagggctcggcctgagagaaaagggcggctcggtcgagctaaatgggccggccggcccgagaaggcggcccaagggcacgcgcggggagagagggagggggaaccggtgggccgagtccaccttgcatggccccgagtgggacccgcttgtcggcggcttggctcaccgtgagcggggagcaggcagcgcggcgctagggttcggaggggggcgcagctcgtagaggacgcggatgcggcgggcccacgcgtagcctcacggctcgcggtggaccgcgggcgcaagcgatgcggaggggagcggtgggccgaggtcggcttgacccggtcctggccgaggtggcgccgacgtggcgcctacgtgactgccacgcgggccgacgggaggttgaagaaggcgtcggccggaacggacggcggacggcggctgcgaacggcggggcgaaccacggcggtacaagcgaaagagagcacaccgggaggtagcacgggttgagaggggacgagccaacggcttggattcggcaggggatgctcgatggcggcggattgcggcggcggcattcggcggcgagaaaagggggaaacggcgacggcgcgacgggaggtcgattccttcggaacagagcatctacgcggccaacggagtccgtttctagcgtcggattgggcggagctaccccgagcgaggcccgcgacgagaggcgctactgagctcgg

SEQ ID NO: 28685 - DNA, 12558 bp, Oryza sativa
ctgcgcccatggatgcggcggcgcggctctggcacgcgcgcgggctcgcggggcagggcgcggcagagcagcggctaggcggcgcaggcgcggcacgggcggcgaccgcgcgggcgcgcgcgcgaggcaacggtgcgcggggaactcaaaaacgcggcggggagcttgccagggatggagtggggagagagaacaagagagggggagagcgctcggctcggcgtcggctcacgcgcacgcgcgtgcggcgcacgggtagagcgaggggaaggctgagggagagagagagagagagagagagagatgggccgagaggggaatcgtcccaccgaacctgagggaggcaaactagacttttcacttgattaagcggctcccatagccttttcattttctcggactcccagaggccaactgcccagcagcacaacaatccgcttccactcgggaagcctagtctatgatgcccgtagacatcccgaatcacacagattcgtttcttgaccagtcaggtcatctatctgccacataggctgattctggtaacgattcccacaccacaacaacttttcacaaagcacacgcaaacaaatacgattttcacaaacgcagaagacttaggtggtgtattccagctggtatcccaactggtctaacaccttaacacggactaccaaacaaaactcacgcacgcactagtttaccaccactcctaccgagcgggtgacggagctaaggtcttcttatcaatggggcttaactaagacacctagaggcttgagcacacctttcttcaactgggtgtgaagacaggtttattctaggtcaaaagtcaaaacaaatgactagcttctaccttttggacacgaaaagatttttcacaaaattggagctaaaggggaacaacgacaccttagttttcacaaatagtttttgtactcaaataatgccatccttttcaggggtttcgatcctagggccaactaatgctctgataccatctttgtcacaccccgatctggcaccgccgtacaacggcacctgacaggagcgtgtcgtaggaataacggcgcgaaccgctttctacgaaaccgcgatctcagtaccagtcccaggacatagtgctggtacccacggtgacaaacatgaatcattgcaaatccttaaaataaatagatgacttatttaccttaacttaggttgcagctcagaacagcccgagaatgcaaccgacgacacagacgaggaaacaccaataacaacagcagcagcggaacaaacgaactaacacccaacaccacaggcgacggctaggaaccatgacgaaaccctaatcttcactttacttcatcttcagctttaggacggaggaactatatatatttatatagagcaagggtgagtacttttgtactcagcaagtcacgggaacttaggtgtttaatgcaagcttggaagagaggcaaggttgttttgcaaatcttttgttttgaaatcattttgaaatcactaagtggtttacttctttctaagtttgggccgaaaagaggcttgtgtctcgattcgactttaagagatgtttttcaacaactcaattggtaatgtactgaccccccaggtcagatcattacttctcggctctcagagcaatttcacttgattaagcggctcccagagcctttttattttctcggactcctagagtccaactgcccagcagcacaacaatccgcttccactcgggaagcctagtctatgatgcccgtagacatcccgaatcacacagattcgtttcttgaccactcaggtcatccatctgccacataggctgattctggtaacgattcccacaccacaacaacttttcacaaagcacaggcaaacaaatctacgctacaggaaacacctcacatctgcccatgaccgcgggcacatctattcgaacagttagttaacctctatagagtgggtacactttacccacacgacattactaacccggatcgcccagcccgtgagatcagccacgtcgggagaccctaaggctttcatgagaccctaaggatttcatgacaaggcatttcgaaagccaacacagggttgccatatgccaacgagaggggtcccagaccgacaacaggttaggtctcagaccatattgtgccaggaagcccgagggttctacccgacaccaccccgttgaatccacatgtctcttggcatcaaggcttccctggtttgctatttactcagcaaggggcgtcccattgcacccgtgtggtcgcacttgttatatgctcggatgaatttcccacaggaatcggtccttatatgcgaatacgggacaatgccacataggcacaactcccgcatcgcgagttttcacaatttattttattttcaaacacgccgacaccacatgtcgggtttttcaaggtttctcaaacccatttcccaaattatcgacacacaacggtgtatgtggaatagttggtatacgcgctcagagagcacgaataccgaagtaccacaaaggtggagcgacaaggaatcacggtagtacagccgacaggaattagtgcgattactgggtaggtctatcggtttggcacgcaaatcgaggccaagcaagttaagtgtgtgattctaataatgtaagttgcaaacaaaataataatgattttccaattataggagcaattggtcaaaggctgacttgccttgctcaaggtcttcacaaagcttcacgtatcttcgagaaaacccgcgatcgacaaaaatccggtaaccgcaactatacgcaaacaatcaaaacctaaacaaaagaccaagaaaaagatcctatttagactaaataatagtgccattaaatagatctcgattttacagaaatactggaagtggaacggggtcaatcggacgaacggatcgagagatatgaattttggaagtttaatagggttttctggacaaggagatgatttatcggaattttctggaaaagaatattcccaagaatattctttaattactcattgacatgtgggaccaacaagggaggaaagatggacttatgtgtagggaagctgatttggtggagggggaaatatggacttgttgcatgtgtgttaggctcggcaaggaggcaggacatatgaacttcctttgtctcaaaaggccgaggaggggggggggggggacggctggtgggccgagcccatgagcgggggagagagaggaggcggctgaccggctgactgggtaggggcgggcccggtcaacgccacgcgggcagccacattggatggaggaaagggagccaggatccaacggctcgcggcggccgagaggcgccgacgaacggcggcgaaccggaggaagcggctggcaccggtggcgagaggaggaggaggggaagccattccacggcttggatcggggagaggatgcgcgacggcggctggcggcggcggcgaagctcgccggatgccggacgcggatgcgcgagagaagggacgagggggcgcggggtcgggcttagccgaaccaattcgtagttgcgacacgggggcgcgggacccaatggtcgccgcgttcgaactcgcggcggcgctatgcggcggcggaagaggcggcatggcgtgggagcgggtggggaggccggcaactggggcggcagtctgggaaggttcaagaggacacggggagggtcgcggcgcaaggaatcggcgagagaagggccgacggcggcggattgcggcggcggccatcgccggcggagaaaaggggaaaactcgccggggcaacgggagtcctattcactggggaaggagcttctacacggctccgggaactcgtttcaagcgacgggcggcgatgagctagcctagggagtcatggcgacggcgagcgacctccggaacagagcaaaggcgcgcggtggctacgacggcgacggtggagccgagcgagcgtctaggcgcgaggggacaaggacggtgaagtcgcctagagcctagggaggggagaggacagggggcgctcactgacgagagaggagcggcgtcggtggcgggcgtggcgcggcgagcgatagtggaaagtggttcggtggggagctcaccgacgagagaaacgacgtcggtggagtgtatggagtcgcggcgaggcggacgcgatggcggggcggcgtggcaccgagggtgcgcggccggggaagaagggagggagaggtggcgatgggcagcctggagctcctcgtcacgcgtccacgcatgcaccggctcctccggtgctcggcggcggacggcgacggcgagagaggggcgagcagcaataatggcgcggcggtgatggaagttcggcggcaatggcgcggtgggtgtgaggcgagtgaaaacgagagaggaaggggtttggggcggcttgggttttatagatggtggtgaagtcggtttggggaggaaactgacctatgcggtcaaggagcgggagatggtggtcgcgctagcttggctggcggtcacgggcgacgcaagagcggcagacgacgaggatgcaaggggcggcaaaggcggtcgatcgggcggtggaaatcgaaccgcgggagtgagaggagcagcgcgggctggcgcgggggcgagctggcgctcggtgtccatggcgctaggtgccacgcggtggagacagggcgccagtccgggaaggggagaaaggaaaaaggggaggaaggaaagggggctctgcccatgccattttgggagaaaggaggagggagagagaggctctgcctccgggatttgaacgcacgtggcttggagcgaccgagcatgggcggctgcggggcgcaggcgcggcggggccgacgcggcggcgaccgggtggttggccacgcgcgagcgcgcgcgcggatgcgagggcgcggccggattcaaacggcgacggcgggaaaccggcgctggtgggagagctcgacgagagagagaaacagagagagcgagagagagagggaggcgctctctctcggctcgggcacgatgcgcgtgctcagcacgtgcgaaggggaggggaaacaggctgagaggagggatgggccaagggagaggaattcggcccacaaaaacaaagggaggcaaaatagacttttccagaggaattgaattggagagaattggagagattcagggtttggattcgaattcaaatttgacattcgaactcgagggtttagggaggaatcaagggagactcgaggagaagtcaaggaagagattcaaaatgagattttgatatttttgggaacgaggacaagtatttggcgaggatttaaaggagacgtttaagtttcggagacttgaattggaaggaggaagtcgaggtggaggattttgatggtgacgagggtgaacaacgggagatagaattgagatccatggcacgacttagactctcacacaaagaacgaaattttcgcatataggattttgccgaattagttttttaacgtttcgcagaagcgtagcgttacaccactacaggtattaactcctataaagctaccctattgagatttcagagcccactctattaaaaacttcttgaggtgaagccacgtcatcgttattttacagtcgtaggatcaagtgatatgacgctagatcaagtgccatctggatggatacattcaacagccatgcacacaaacgttacgatgacccatcatgatgtacgacgagatgggctcccagcctcccacctatgacgttaatctccctgcccacctcctaattaatcgcgtggttagccggcggttcgagacgacaccacccctccacctatgcgatgccaggacctgctactcattcgcgcagtggttgatggcatacctcaaccgcgtggttcaagacgacgacggcggcttcaggtgttgagatccagttcggcgtgctgagatccagttcggctcacctcatccagtgcagattgcagttggtgtccagaaatgctaattttagtttgaagttttctttgttgctgaatttcacactaaactttaagtgatgtgcttctatgctcctcagaaaaaaaaacgcacgaatattaaagatggtgaatggtctatattaaaaggtgattaacaggctaaacgttattaggaagggcaatttcgtccttgaggtggttacccgtatcacgggcgttcaatcttgacgcagcgccgcctcgcctgtcgccgcactcgatcgcaagtacgagagaagaaaagaaggcattccaagattccaaaacagcgaatcctcctctgttgcagctacacatgtgcatcacctcaatccaccatttgattagcatccatgttcaggctacggttcttgccaaatcaaaaaatgagatgggtagagataagaagcatgacaagaaaaatcagaaaaatcagaagtggacgaaggcagggagcacgccgcggtagactaacgggaaaggcggtgtggcgagagaagaagggggtggctcagcaattagaatgccggcgatacgagtcatcaatttgtaactcctcatcggctgatcgagtatgtgataacttcatccaggacaaaactgccccttcctaatgacttttactctgttaagcaactttttaatctaaaccattcatgagctttaatatccgtgcgggttgttttagtgaggagcatagaagcataagtgttagttcatttcatatattatccttaagagcttcatcaaatcaattctattaaattcccaccgcaacgcgcggggtctcgtctacttactagcactttgatgccacaccaatcatccatgaggagaaggggaaacattttagtttatgaacattagagaggtgaatctaactagtatagacccacttgcctataaaagcaatgaagtaactatataacatttaatatttttttatgaaaaactttcaaatatagctatattataattttaatataattacattgtatctagcatttaattagattgcaacttgtatgtaactcgttctcatctatgataaacatacggttgtgcgcatggctaatgctgctagtgtgctagcaggccatcatgggttcaatcatatcttatttttctcttcctccctaccacgaatcttgaatcacatatatatgattgtcaaaattttagaagttttaaggggaaacaatctgccaattgccaaatgttttttctgagattccgtagaagtaattgtaatgtgaagattaattaattgattagccattgtgaatggttcatgtagagtttatactactatgaccttttacaaaagaggaagggagcactacatggatgaacattgcatgagcctttgccttctcgtctttcagcacagagagaatgattcagtcatgcagctgatcgacgaacttagagaagttcttttttttttcacgctgctttcttcagtcttcaccaactcagaagcaaagcttagagaagagacaacctgaaaaaaataaaccaacggatcatctgcacgagtagaccacgcagcggctgaatctcttggccataaattaacgggctcagcataaaggtgttccgttgatgatcaattaatttacgagcaattctacggtttttaagaaggtactataaggtacccaaaaatttagtgtaaaatttggtacctcatgacatctcatagtatctagataccaagaggtaccaaatttacaataaaaaaagtggtacctcatgataacttctcaaagaccgtacaattgctcttaatttgcaggtcgaagaagctgcgccttgcaagccaactggacaggaacatcacttatcactctgcaatcgctgcgtacatagtgaactacttcctccgtccaagaaaaaagacaaaccctgggtttccgtgtccaactttaactgtccgtcttatatgaaatttttttataatttgtatttttattgttgttagatgataaaatatgattaatactttgtacgtgacttgtctttttaattttttttatattttttttaaataagacggacggtcaaatattagacatagaagtcagggtttatctttttttttttacggagggagtagagcatactactccactatatcgttggttcctaggacgctaacatgagcagtgacgtcttgtctgaagcctctctatctcgagattgttcgtattggattcccaatgcatcccattctcaggacatatcgcatcgtcgaaccagcgagagagcgagacaacgttctatctctactcttttctcgttgctgctttccaacagacacagaaaggtggtcagggtttacttttttctagtgctggttctgcacaaaggagtaccgagctgtagcctaatttatgggcccgataggacaacactcctaaaaactaatttcccacagtgtaaatggcttcaggtggtagtctcaggctgtgtttagttccacgccaaaattataagtttaaaaaaattggaacgatgtgacggaaaaattgaaagtttaaagaaaaaagttggaatctaaacagggcctcatattttaatttcagcccctggtgttttttattttagtcatcacaattttccaatttatatatagaagttcaaattttaaactgaacacccaaaaatccagaaattaatataaaatctctcctccctccctcttctccccaccgacaccccaatcctccaccccactcctctccatctgtcgacaccaatagcgacacaactacctcgagctccactcaccggcggtcgcctctcctctcccatcccctccccggcagcggcggtagctgcattggcagcgatgcctctctccttcccggtggggcagtagcgtcacaggcggatctgtggtggagcggggcggcggagcgcggcagaggggagcactcgaggaagaggggagcacttgtgtcggtggctgatgggcttcccggtgccgacgcaaatcgatgcgtcggtggccgacggagcttaaaggcggtgtcttcccttgacaaaggccaccacctctatacccccatcgtcttctcctccctcgtcggccaccgtggcatgaaatctcttcccgacagagaacggaggtgaagaagaagaaggaaaagggctggatggggatccatcacaaggagacaacctcgccaacacacttccccaagcgtgccttcgctgttctcgagaccgggcgagtagaggttgtcacgccccgaactagtcccgaccggaactagcccgtgacgctccaaattaacctgttaatcgataccagtcccaggaaacagtgctggtatcacagggagacagaatatcacagcaacagaggtctctttattatagagtaggggtacagtcatgttgggccgcggacagatcccgagctcacaactgcattataaaaaggaaacggaagccaggacttggaccgaacaacacaggcgcgacttgggaactaggccgaaaccctaaaactcatcgtagccggcttgctcctggaagaactcctcatcagtaggttccgcttcatcttcttcagcaactggggggggattatttatatagagcaagggtgagtacgggagtacttagcaagccatgggaaataagtgtttaatgcaggcttcaaagaaaggctgttgtttttataattgattttatttgaactcttttctaaaaacaactaagtgagtgcttctcaaacgacacggttgagacagtgcgtctcgtccggtcggagtatgtgcaatgtatcagtctttagaattgaatcaaggttggcacccggccaacagcttttcaaacggccacccgggccaacaactttcaaacggccacccgggcctagctgatcccgtcagctgctgattttttcaaacatcgaacccctttccacaacagcaatttcacaagcagtagtcaaacaaaactacgctaggaatcacctcgcatccgcccatgaccgtgggcacggctgttcgaatagtttattagcctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccttgataagctagttactcagccaggggtgtcccattccacccatgtggtcgtacttgacttatgtttggatgaaattccaaggaaacggtccttaagtgcaagagcgggaaaccgtgcacccggtacgttccccggtccgcggttttagaaattcatttagttcgcaagcaccgacccaggtgtcgggttttccaagtcttttgtaaaagccaagttttacccaagttgttatttagattttaagtttgaaggcatccgtcgatactcgcacagagtgcacgagcaccgaggcgcaactgggtggttacaagggaacatggtataacgattaacaaaggaaggatcaaatgcaacaaattaggtaggtcccgccaatctgccttgcagacgagacaaacagattaagtgcgatcctatcaatgcataatatttttcaagcaacataattaaattcaaatataggctcaagatgttcaaaggtggcttgccttgctcgagatctggagcttgatcctcgaaatcctcgcaccgcgggtcttcgggctccgaaactacacgcgaaacgggacaactcaacaaacggcgaaaataaagccctattaatgacctctaagcgtgccattagatagatctcgagatttgagaaattttggaagttgaacggagtcaaacggttttacggttgggaagatattgaatttctaagattattggatttttggtcttaaggaaaaggatttaattaaatcctttttggaaaagaaaataaaagaaaggaaaataaaaggaaagaaaagagggagggaatatagacttttctcgggcggctagggcgcggcctaagagaaatggagcggtccggccgagctaaatgggctggccggcccaaggcggcccaagacgcgcgcgcgggaggcgaggagagagagagcgccggtggaccgggctcactgcgcacggtcccgggtgggacccgcttgtcggtgacacggttcaccgtgcggagcgagcacgcggcgcacgcgcgcgggcgggggagggacgcggtgcacgcgcgtggttcgcggagggacggatgcggtaggcccacgcgcagcctcacggctcgcggtggaacgcgcgcacgggaggggctgaccgggatcggcccgacccgatctcggacgagctggcgccgacgtggcgcctacgtggcgcctacgtggctgccacgcgggctggcgggaggaagacgaaggcgccggccgcgaatggacggcgggcggcggcggtttctccggggcgccttgcgacgatgaggggcgacggggcgtacaccgggatgacgaggaagaaggagagggagcgagccaacggctcagattcaccggagggagtccgttggcggcggatttcggcggcggcaaccggcggagggcaaagggggaaacggcgacgaggtcacgaggggccaattcccggcggtgagagcatttacgcggccacgggaatccgttgctagcgtcggattgggcggagctacgccgagcgaggccggcgacgagcgggtgctacggagctcggcggcgacggcggcgagcacacggcgagcgacggcaacggtcggggcggcgccggctagttacggggaggctactcgagctactaccgaaaactaagggcgagagatggagcgaggaggacgaacggatggaggcactaccgagatgaggaggggcgctgtgacgagaggccgacggcgtgggagtaatctctccggcctcgggccggggaagaggaggaagacgagcgcccggagtccccttccgcgtccacgaacgcaccggctctcccggcgcttggcgatgaacggcggaggcgagacagagctcggaaggcggcggcaacaatggcgatgggaggagaagagagggagggcgcctgggctttaagggcggcaatgttggtttggaaccgacttgggcggtcaaggcgtgagctggcgctcggcgctcgcgtccaattggcgacagggcggagggaggatgacgccggcgggaggaaaaggggaaaaggagggagggaaaggggggctcgcccctttcttctttgggaaaaggaggaggggcgcgggggcgtctcggcagagggaggagggctctgcctccgtcccttggcggcttgcgcgcggagtggcggggccgaggcgatgactacggcgatgacggcggggcggtgtggagcggggcggcgacacgggcgacaagcgtgggcaggcgc

SEQ ID NO: 28686 - DNA, 52621 bp, Oryza sativa
  unsure (1)..(52621): unsure at all n locations
agggctcggctcggcgcgggcggctcacgcgcacgcgcgcgggcagagcgaagaggtaggggcgctcatcgcgggcggctcacgcgcacgcgcgcgcagcgcgcgggcggagcggatggggagaggcagagagggagcgcagccgggggggggggacagggccggggggagagggggagatgggcggagagaaattcggcccatcgaccccgggggaggcaaaatagacttttgcggaggaatttgatttggaaggatttggattcgggattgaactcgacgatatatcggggatttgagatcttgagatggcacggacactagacaacaagcaaggaaacaaatttcacaattagggtttttaagagataatttttccgctaggcgccacgacggaacgggcgctacagaggtgctcggagccctgcagaggtccgtgattctttgtagggtgatggcccctagccgaaaagtggttcggttcctacctggcgagctagggataccctccacggtggagcgttggccatggcctgaggagtactagctagggatgcagatcctctgcagtactgctgatgcaatagcagacactgactcgtgggtgtactgcagacaatccacactgactagctagcacttactgaaacaataaaactttacaatatttcctaatggtaatacatgttcgttttttggatgaattgagcaagcagattaatctagcgagtgatacatgtttgcacacaacattatggctgtagggagaaatttgatactgtaccattgtctcaacaggatttcgttggatttccactccctaaataggtttcggtaaactgccactttcaaccaagacgtctacgctgaagtgccatttcctccatttcttcccaattaaaatcattctttttccttttttccgttatttgctaaccaaaatacccctgtatgtccactcaatatgtataaacttgtgccattgtgatcaatgctaccaatattttccagccttttcgtatctatttaagatgcgtgcaaatgatgagtacaattgatcacaatggcacaagtctatacacaaacattaagactgaaatcttctataattaaagaaacaataaaattagattattgtgaataatacctctccagcacaaatataatttgttatttttgtttctttatctgtaaattgaatttcgatgtgcatgtttgtatagtggttttgtatcatctttatccatcttatcaaattttatgaaatatttacataattatcttgtaaaaaatgctttcccagtttcgacagttttcatctaaagttgaggaccaaagcacatcccaatgttttacagtgtggtgaagtttctcgatcaatgtggccttctctgcttcgcaaatccatttttctttggagaaagggagcaaagctctcccattttttgagggaatgaacagactgtttaataaataacaaccgacaacatccaaattaagtaaaacaaaactgtcattttgtttgatctaaaccaaaaaccatcacatccagtagacattgcaagtagagtgctgacatctaaccaacccctatcctcttgacttgcattcgtctccaggcaaatcttgagctgaaaacttcagcaaccacctgcagcgttccctcttgcaactttcttcgatcctcttccttgatctgtaggatggaccaagaattgatccaatatatagcatgcatcatgcattagttcagtggaggatccaaagataatttaatcaacgtagtagaaagcaacacatggtttcggcagcaacgctgactgacctgcggctcaggtttgctccggcgagcggcaccggcgccggccgtgcggatcactcacatcgtgtcagctcgcgggtgatgtgaaagagagagaacgacatggagcatagtagagcacggccgcaccgggctgtgatcagctaccatgtgaaccggagcaaatctgtattggtgttgttcatccctgattccccatgcatcccattctcagggaagaatggcatcatatctcgtcgaaccaccgatcgatgcaatgttctgctccgatcctaacagcggatttcttaccaacagagaggaaggagatgatcaggatatttacagttttggagcgaggcgagatcaggatttattgttttgaattgttgattcctgcctagaggattttgcctcaaaaagattctgtctagacgagcagtagctagcctgtgcgaggtagagtcttatattcataattttagtataaatatgtgaaatataaggtaaatttatagtttatcttataataaaacaagccgtaacaaattaaataacattgatctatctttttagtaagatgaatgattaaatgttatgttaaaaattaacggcctcatacatttgaaaacggaggaagtaatagctatagcactttcagtattcagttcagtgccacaccacccagacgagaggtgatcgaaaggaaaacactgcaacgctatgactagctaatagtactatctggttggatttaaagtttggaactgacgaacgatggcaactcgaccacgagcaattaagcagataagtcaatcgtgtcgttaatcatcgacgctaggtgtaccatgcacgagccactcttgttgcgttgtgtctttacacatgcagacagtattaacaaaatcagcatcagtactatctgacgctatttcaacagcaaactttttgttttttgaaaagattagacggcaagggcattgccggatatattagaagagaaatagagtataggctacaagcagctcagttttcctgggaaggagaaaccgaaaggaaccgaaattacataaggtataaattctccctgatcaagaaggctacttgcagcggcgaaagcgatttttgttggaagagacgccaatttcactctagccaaacatgccaccaggaaattagcagcatccctacaattttcttacgttcacttgttggtctgatggtagccagatactccatccaatccgcaattgattgggaatcggtgtgcaagtgttggtagccatgcaacatgactagtagaaacttgtgaggggctaacatgactagtagttcctcagctggagcttctgtaggatcaggttgttcgtttcaaattccccatgcatctcattcttagggcaccactggtttctcacaaatcagagtaagggaatggtctgagatttgcagtttccgaatgcctggtttgtccagagtagtagcagccttaagaccccctgatttatagatgggcaaatggagctgaaggggtactagtacttcattaccacaccaattaacaaataagaggagaaaggaaaacattattagtctctaaatatatactcccttcgtccctaaatatttgacgccgttgacttttttaaatatgtttgaccgttcgtcttatttaaaaacttttgtgaaatatgtaaaactatatgtatacataaaagtatatttgacaataaatcaaatgataggaaaagaattaataattacttatttttttaataagacgaacgatcaaacatatttaaaaaaatcaacagcgtcaaatatttagggacggagggagtattattagtaatgcacatttttttcatgtgtatataaccgaagtatgaaggatatgtatcaaggtttcgtttttgctatatttctaactactggccaaagatgaatgctcgttcaggtgaacaaacatcaatacacacatgtggagatgagtaatagggtgaactaaggctgaatatgggaggtggagttcacacggaaaatggtgttatccattgaggcgtgaatttaggggtggatagcgagccggctcggctcggctcgttatcctaacgagctagaaaaccagctcggctcggctcttttgaaagctcgagctaactcgttaggctcgcgagccaatccaacaagacagaaagaaccaaggaggaggggacctgcgaggctgcgagtgcgagtgtgcgacctgcgccggctggggaagtgcagcggcggcggccctcgcgctggctggggaagtgcgatggcggcggcggtcatagtggcttgcggcggcggcggcgcgagctcctggcgacgccggcggcagccctagcagcttgcggtggcgtcggcgcggtctcatgcggcggagccagagagagagagagagatgcggaattgcagatgtgcggtttcgacttctcgtctcgtgtgctgcggcggatgaggattgaccgagtgaggagaactagggttttgcacttttactattgtcttaggcttgggcctgtgctattgtattgggctgggccttcgcggttgtctgatgaagtcctggctcgttaaggctcgcgagccagctcgagctggctcgttatccctaacgagctaaaatgccagctcggctcgctaggaaaatcaaacgagctgagccgagccgagccaagcctgtcacgagtcgagcgagctaacgagccacgagcttcctgtccacccctacgcgtgattaattaagtattaacctaaaaaattaaaaaatggattaatatccgattttttaaagcaaatttcctatataaaaattttacaaaaaagtaccaattaacagtttgaaaaacgtgcccgcggaacgagagagatgtgagttagaaaagaagtgagaagaacacaacctaagtagcatgtacgctaaccggtcactagttattcagacctgataatcttcatgtatcacataatcaaagttgtgactttgccgtctgttattgtagatgtgaaatgttgtgactgcttgaaaatatggaatgcgtttcttctcagtgtctcaaagacaaacgtaacaaatgctgatgagaagagtcggtatctcaatatcgaccatctcttagcgatacgcaattttcatctacaggtttagaagttagaagtgaagcccatcccaaggttttacatttttttttcatgttatcttcacaaatcctagaaggattgtacataattcctagtttttagaccccaatcaaaatcactggactcgtactttccaacgcacagtacatttcattcatttttcctctatggaagatgaattacatctccgtgtctgcatcatatccaaattaaatcaatagtgagatttttgttttaataatggacatttaaattaacaatgaaatacataagctgtataaagtaaactaagtttgagtttgaagtacaattatagttgtttggcggcttgaaaaacagtacggatcattagcacataattgtacgctgtaccataaatgaagtcatagggtactcaatttgcactagaaattttggtaccacttaaggactttaaaatttctctcaaattttatactattttttttatttgagatagaaaatatgatccctccagaatgataaaattactcctaaagacgaacatagatgcaatgatgcagataaacagccgtagagtggtcggaactgccatatttattttcaccactacagaacagatcggtagccagatctctaatatctactttcaattgtgtcattaaccatgttaattgtatctctaacaatatctctttgttgagacgtgtttttacacatgtagatagtaacagagttggtatcagtaatacctcagtgcttcaacagcgtgctgtttttcatttacaggttcagaagggccacacgctacacggcgatgttatcctcacaaatcgcagaagcaattgagcaacgaggatagactgatacaaggagcttggtggctttttcccaacctgccaccgtttctctagcaaggctagaaattcagaccacacgccgataatttcatatgcttgatctgcagacaaaatgatctaaagcacaacacatgtcgactggatagtgaattggtgagaggctaacatgactactgctgcctcagctagacattatctaggatcaggtggttcgtttcaaatctccaatgcatcccattcccaggatattgcattgcattggtgatgcatagcatactgtcatactgagatggccaggatttgcagttctctactgctggttttgtgtagatgagtatatatataattcactaacttagtataattcactaagttattgatgggctcttggattagagagaggcactcattgccacaccaatttagacaagatgagaaaagaaaatcttacaaccgtgctatacatacgacttcagtgtatgactccatcccgattcacacatctaatgcaccccgtactaccatcagggcataggggttatgggcaaaggattaattaatctacgctggagatgcattgtcgtacgtctcagtcagacgaggcaatcatatgtgtagcattattcaaaatcttattagtctttgaacatattagctcacagtttgtcatgactatataacagaagtataaagaaagtattgaagtatagtttatattcctagagtgaattttatttctctgtgtagaggccctaacgagaaatattactgggaggtgaaaaaaaatacgttcgtttttcctgtattgctcctagccaaagatggatgctgtactacggatttcacagtctcgatcaatttgattcaggcgaacaacatcaattcaggtcctgttttattgatgcaatcttcacttggacaaagtctggagtactagtagcttgctcataggtgttgtgaaggcacatttggacccaatcacaacactggaacctatcgatttattttgaaaaacaaaattacatatgaagtcattgtttgaatattgtcaaatcactatgatttcttctccttgttcgtagcatactccgatcagaaccaaatttatttgtcgatcgaaccaatccacgaagcaactatgaagatttctttttttttaagatagagaggtcgaagcctctcccatttccattaaagaaatgtacggtagttttacagacttgaaggaaagcagcaaacggaaaaaaagaagaaaggttttaattgctaacctctagtggaatgccatcccatcacactttcagctgcaagaagaaaacaaaagaaagtaattaactgaataacagaagctgctacatgcgactctgaagattgcttcatgcacaacaaacgacaaaacataactctctataatggcatcaccaatatatatggcaaaatgatccatatagatgagacccacataaatagtttatctctatgtcaatgttcacaatgtatatagatacaaggtatcattaggagaagagagaggagtaaagatagataatataatttattccatatatatgggtagtccatatgcatatgggtatcttttgttattttttttatatggactagttgtacaatggtaataggtggctgaatggaatattctattgcttatggactacttttacaccacattgtggatgccctgagacatttttgcgacagcaaacagcatgtcatgtgtttccggcaatttttcttctcttgcaggtgaataactgtgaagatacaacatatttctctagattttctagatgatcatgttaagcgtttggaacgaattgaccaatagataatagtctgctattggctattaacaagaacgataccacaaattaaccaataaccatgtcatcaccgtccggtgcaccccgtttaactcaaattcccaatacatcccattcccatggtatcttgtctttcccaccccaaatactcccccacttatatattagctctctgccattacacaatcaatatgagattatttgatgatatcccccttcctacatcagtgcattgatgagctttcacacaatgtaaattctacgtgtggttttgatctaaaatagattgtggattttagatcggctagcagttaggagggatggccatacagcgagacatgcccctctgtcacaggacaaactgagttagcgagtcgtcttcttatctattaatgtatatatactagaaggatctagagcctgattgccgcctgggcggcctacaagcaactgctacctggtccattgatttggtgatttaattttccaacttgtagatgcattgccgatcgattgcgtactaagcgccacaagatcatgtaaccatcggatcgtatcaacttcaagtctggaagctcgctcagctcgtattccacatgcatccaattcttaaagcattgcatcgatcgtcgaatcactgaaataacattctactatttttatttttatttttgcagggaacattcgactcatttttacggctgctttcacatcgtcgaatcatttgaaggcaatcagatagttggggtttatatagttttagagggggcacctagtcggcgcgtgtgcgtccccggtgcacgttttccgggactaaaaggtagttaactaatcaattagttttagataattatagtttgagataatgatagtagtagttaggattttctttttccacgagatttttttaactaataaattgaaaagaaatctatatttgaagtcaaatttttaaaattttaaatccagatttaaaaattttaactcgaaatttcaattttttaagtcaaagtttgaaaactttcaacttttcatctcaaatttgaaaaactttcaatttaactttgaaaacttttaaccctgatttgaaaactttcaactctgattaaaaacttccaaatcggatttgaaaatttttaagttaaaatttgaaaatttttaagtcaagatttaaaagctttcaactcaaaacattttaaaaagccacgtgtgctaaaaagattaaaaaaagtaatcagaaaaacacgaaaaaaagaaaaaaacgaaaaaagcggcgtggggaggagcgcgcgccagcatacgtgcgaattagctctcgcgagtttccgccgagaggacctagtagcatgcagcactcgaggaggtatttagggcctgttcactttgatgccattttcaaccttaccaaatttttgtaaagttgccaaaaaaatagctacatttagtttgctgtcaaattttggtaactatataagaaatcctaccaaaattttggcaagttgccaaaattataccaaaattttggaaatgccaaaatttggtaaagtttttttttgacatcaaagtaaacaagcccttaattaactagtactcggttagcataggccgcttggtttagctatagctcggacgaagtggtgatttcaaattgtagaactgaagtgtttctttttgttcatactgtaattgcgaaaaataaatattataagatgacgataacaactcagcacagtatcatctcggattggctattgggcgaacgttcggtacttgtccatcacgcgaacgaatcaggcaggggaggataaaaacacgtggcgatgcgcaacaggctggtgcggtgtgtcgctacgatatatatttcttttcctaatttcctgttttcttttttatgtgattcttttcaatttcccgttctcctttttttacattaattaattctcccgtagcggtatgtatcaattttctgtttttccattctttttttttcaattttttttcttatagtcatttttagcttttttaatggaaacttttttatatgtactattttcatggaaactctctgcaagtatgctttctatatataaactttctatatatagactttatatgcataaactttatatatatagactttatgtatataatttatatatatatatatagactttatgtatatacgctttatattatagaatttgaatttataaactttataataaattatatttgtatgtataaatttcagtacaaataaaaaaatataagcatcactagattttgaaagagatttttttcaagaaataaaatctagtctgaacaatttgttaatagggaaaagagattggttggtcgctaacagaaataacaaatactactatatacgagctgaaacagtcattagaacgaataacgacaaaacctattaaactgtccgcgagatgcgaacgttcgacgattagacccaccctcgtatcatctccttgacggatgaaaggtgaaatcctatattgggccactgaatttggacagctccaaattagcccatccagttatggctacaacctgtagagctcagcctagtcctgccgtcctggtatgtttgtcaagggaaaaatgtccacttgagatctctcaaataggagccaagttttcagaaaaaccgaatattgaagcatcctcaacttctaaatcagcgcaaattatattaagtcccaccgttattttggacggtggttttcgctgatgtgacgtgttgacccaattatgttctacgtgacgcttacttgcttacaattagggggggatccatgtgtcattgacatctaattcttcctcctccatcccttctccccgccaggggatgcatcaacgatctacgttgtcaatacccatatacatacatacgttggaacttgctgcttgcattatcgcatcaagaacatcatattggtaaggtttgggatttttgcgatgcttgccgtacatcctactccggcgagcggcggcggcaacatgagcagcagcaggagcggcgcggcggcagcgcgagcagcagcaggagcagcgggacgacagcggagtgagcggcgcggcagcagggatggcgtggagcaagcggcgcagcggagaagagagagagaggggtagaagatgtggaagagagacaggcagaagatgagggtattttcatccaatagatgtaaaatacgtaactcgtatctcagtggcaccactaagaatacaaacaagtagcagtggcatcgttacaaatatcaaatagtaatggtatatatatttcaaaaccacaaaatttttaatggcatggatctaattaacccttttatgtattacttttcttctaatgccacataggcatcacatgagatgaagatcagatcaacaagacgccacatcagctaaaaccatccttaatactgtcgacttgatttaaactagtattaataatcaaaagacttactatatccgattttacggttgaaagagaaatgaagcttgaccaatattttaggagcctaaagtggactcttctttttctttgccaaatgaaaatgaggcgcatctagttgacccactgatgatagcacacttatggctcaatacgaggcacatcccatattgctaccaatatactccctatgtggccaaactaggagggcagtcccctcctaatataacaaatctgaaaaaaaaaagctgtctaaattcgttgtaatattggtgtttttagaacggagggagtagctctgattcacattgttaatcgcgccaattgatcttgttgagatgaccatcttacgttacgtgtggtgtcctagtgcctaaccagcacgacgtcggccgccaccgtttcgccagcaaagtagtacgctgaggccgcgcaccaccaccgtacgccgtctccggcaaggtttgctctcgacagtctctgcacgatcgcggctgctgctcgtccgatccaagtacggcaattgccgcgaccgatcaaacgagctaaaccgctgcatttgtgtaggccgtggatcggtgaagggctgacatgagccgtgatgcgtcggcaggagcctctacacgacatggtcgttcatctcgaattccctatgcatcccgttccagattgttacttataaccaaccatgcaccgagagacaacgtatatatgttctagttctacagttctactactgctgcatttccaacagaacagaggaaggggatggtttggttttccagttttctattttctgattctatacccagagttgtagcagcaacactagctagcttatttatatatatgggtacttggcgaggtactacctccatcctaaaatgtttgacgccgttgactttttaaaaaatgtttaaccgttcgtcttatttaaaaaatttaagtaattgttaattctttttctatcatttgatttattgttaaatatacttttatgtatacatatagttttacacatatcacaaaagtttttgaataagacgaacggtcaaacatgtttaaaaaagtcaatgatgtcaaatatttagggaagcagggagtataggtagatatgctaaagttaattactaactagcacttcagcgttacatcaaccagagaggaggaaggcaaacattaccctctaagcattaaccagtccctcgtattttgttacacatttaaaatgaaatatagggaaaaatacagtttatatttcacggccaagagtgaatttatttctctgctttgaggcactaaaaagaaatatcattaggaggtgggaaaacacattcgtctgtattactgttactgggcaaagatgaatgcactggctttcacatcctcaaccagtcaacctggttcgtgtttattattgtttgaatgatgaggatgaagatgaaaattaagtgtttcacgcaaaacgaggttgtaataacatgtgattaattgagttttaattattctaaacttaaaaaatatattaatatgatattttataacaactttcatataggaagatttcgtacaaaacacaccgtttagcagtttgaaaagtatgccacaagtatccaaaatttaatccaacttttgttggagaaaataatagggcacaaattgtcgttcggatagtcaggaggagtggcttcatggcttcatattatcgtattgtatttgatcctacaaggaatcataaattcccaatcttgagttttagtcatggctaataaattcacaactaaaagatgcaatattatatcatgtttaagagttatgatatttggcttaaaattgaaaatccaaatgaaattcctactcagatcaatattgttgctataaaaactgattttaaaatcaattgtaaagctcgccaaattttttttaatggtatttcttattcggattttgaccgtgtctcacatcttcaaactgctaatgagatttggaaggttttatctaattttcatcaaggaacttctaacatcaaggaattatacaaatatgtttttaaaagtagtacatgaaatttgaaatgaaatatggagagactttagatgattattttgtgtgctttaacaaagttttaagcaatcttggatctgtagattgatcttacaatactaattatccctaatataaaatttcactacatcttttgaaccgtcttggtatgttaattaggaagatgaaagttacatcaatttaagagtctgttgttttacattaaactcaaaacccatgacatgaatattctttctcgtaaagttgattttaagtctaatgttttggtttctttttcatcttctttttatgattgctcttcttcatcgacacctactgtttttactgtccttaatgccatgtctaatgaccaactcaagcaattcgttgggaaggacttggttgtgcttattaacaagttgtcttgcgttgtgaataatattaggtttagaatgtgaagagctacatcatacattcggcctgattgcccaaaactaggaagaactaaactgtggggtagactatcaacaagcatgcatggtaccacaattttgactctactgttgtgtgcagatactgtttgacttaaattcccagtacatcccattctcaaggcatattcgaaccccaataatgcgcgcaatgctcaactcatgtcatcttagaaggaaaatatactcaaaaagaagaaggagaaggaggaggaaggagattaccaaacttcaaaattttcatatgttgattctgacaccggccggaaaggagtagggtgtatatatatgtatatatatatggttattggtcggtgtagggaagtacacatccaagtgttttaagtcctaaaccaaccactcaagtgttaaatatagtacagtatgttcatcgcacaaattttgacaatttgaccctttgcaaaaactatttttacaaatgaaccgctgctaaaacttgtttcaaatctgacccttttgctcaacgccaaatcatgtggcgctgagcttagacacctcagcgccacgtcagctagcgctgaatgccgtgccacgacagatgggagactaagtcagcgtgccaacgtacattcagcgccatgctatttggcgctgagatgtctaagttcagcgccacacgatttagcgttgagcaaaagggtcagatttcaaataagttttggcagcggttcatttgtaaaaatagtttttgtaaagagtcaaattgtcaaaatttgtgtgttcatcatagaggtaagtgttctgaatttatgactgcacggtagtctgcactatggaatgtgtttctcatcaaattggtgatctaggtgtgggccactttctcaaagacactaaatggagagatataaaaacggacggaaacaatatatcattttaatgaaaaagattatggtccaatttttttcttgttttttagataatggattaaattaacctagcctctacatcccacatggatgtgcgttgccaaagaatttttatatttaccaatttaactataaagtaacaataggatttggtgttaaaaaaattagaagaatcaaaatttagagatggaaactgtggaaaatggtacccttttatggaaacgagatctgccacagttttaaccctaaaacaaacacggtaaagacggtcggtaattagtgtgacttcgtcaatatatcggtttttcaaatgtgctcttaaagataagatgtgcgtgtgcgcattcaaatgggtgagtgcgcacatgttgtttacgtcttcaacaatactcaattttactttaaggtccagaacaaaagcacaggttttacatggtagcatggtgaatttttttaacgtggtttttgcaaaaccaaaaatcaatatagaaaatgacttgattttggcaacaattggcagttcgtcggtaccgcgatgcaagggttggctgaggtttgtgactggcgagtagcacggtccatggtggcatggtccctcctgctgcagaagcctacggcagcaacactccaaccacctcctagctcttgtgcatagaaaacgaaatgtagtagagcataaccaggaccgcattttcataaagctaagatgaaacggagcatatgcatatcgttgtctttcatatcgaattccctaccccatgagtcctattcccagtgtatcgtaccttatctcgaattgagtcggtgcatcgagctagcttttttgatatgcgtgatgtgtccttactccttacatacgcagacaataacagagtcaatatctatatatcgataagtaatccaccatgtttcagcagcacacaattttcattatatttacagcttcgatgattgtatgctacacatacatatgaccatgcatcatgcgggaggtgtcctcagggcatgcggctttcctgttccctgccatacgcaacaggaacagggaagccgcatccgacacgtcataccatgtgttggtgtacacgtcataccctgtgttggtgtataacgccgcgccaacaaaggtttgtgcgtgacgagcggcaatggtcgcagttgcactgctcatgcgagccaaagatacatatcactgtggcctttcaaatgaactaaagcacatcatttgcttgggccatggatctgcgagaggctgacataaactgcgatgtcttggcaggagacgctcacaagattaccaggcatagggaattcgagatattaaaaaaattgataccccgagttacataatacttagaggtataaccttttacaaattttacatcgtcatacaaatagtaaaattaccctcataaattagagaagcaacgtaagataatcatatgacttaaacctatcatttttttttttaaaaaaaggaaactgcgtgtagagtcattgtagaaatcgtgtctatctttgataaatggaagattcttgccaatgataaatggaagtttagtgatatttgttatctttgtctttaggttagaattctaagtagttttctcttttttcatcaagttaattcgtatttattcgacatgcaaccttgtcttaaagtaaaggccagaataaataaaaaatatatttaaattacttaactagttaaggaaaattcttaaaatttcgaagcaacataaatcgttgtttgaattcaatatatacaagttgaaaaaagaaataaatctgactattagtagtgcttgtactacctataattaaattttattttctcgatacatagattgggtttggaattattaagatagatgatcacttcaaaaaacagagtttttataaactacttttgatgacatttgagagcttagaacaaacatttgaggggatatcccttcaagataagaaaccatctcctacactgtttctcctccaaagcaaactcaaatcaaaaccaaatttgacgacagcatcaatccatcgaacaactctaaagaaaccttcctttcctagatgaaccattctgggtgattcaggaagaactgaccaccgaacaataatgccccacataggactatcactttaaccatgctcttaaccacagtgttgaactcaaattcccaacacatcctattctcaagacatctcatgaacaaactaccaattaatataatacttgactctagtcaccttcaaaagaaacaaaggaaggagattgttggaacaaaatccatcggagatcaagcaaagggaaagaagggatgtagttgttctctattcattcatcgtccccctgaaagggggatgacattcttatatagtagtacacaagtatgggagattacagagatagccctactggacctgagctagggggagaggctgtaggtcaagggattagaaagtgaatatcatatttatatgtgggtattttagaaactactatgaaaattaattttcacatacggttgttgacatgtagacaataaaagagtcaacatccacatcttggtgttcgaacaacaaccgattctcatttacagaatcgaaagcattacacgctaaaggttttctttgatgctatcttcacgaatcgcacaagcagcctagctagagaaaatcaaacgtcattgctagatatatagtaattgacaatatcatcttacaaggcaaaatcgtcttacaaggcggggcctgcatggcagatagcattcgctgacacagctgcatatgcctgcgtatgcatgctatttttgtataggattgaacaagaccaaacaaacctaccagagaaggggtgaattatagggaaaaccaaaaaccaaaaatcttttgcgaaataaaaaatttacttcgaatggagtagatgacgaacccctgtacgtagctgctggtcaaaccgcctcgaagccaccggtttgactgtcgttgtttgacggtcagaccgcgcatacacccgtggttaaaccgccgatctcccgccggttagatcgccgccttgccttcggtcaaaccgtcgggacacagaaaacactggtatatgacaaacttgaagatgtagattgattttacatgttgcgtcccgaggcgaccgactacgcctcctggctgcacatgccagaccggctaaggcttccacgtgacgagctgcacggtgtatgctgatgacccttgcaacccgaaccgggacaacgccttttctttgttatgctctgcacataaaatgaactagaacacagcagttgagtaggtcatgaattcgtcagaggctaacatgacctgctatgcctcaacacgagtctctctgcgttgaggttgtttgtctcaaattccccatacatctcattcttagagcagtagtgcatcatctgttggtttccaaaaaaaataaaaagaatagcgttttactttttcagtctttctcacaaaacctagaaagcagatggttatagtttgcagttttatatatattgctgattctgttctaaggagcagtggctaacttatttatggacacttgaattttgaagaggtactagcacttcagcacaaccagacgagaggagaaaaaagaaaacattactctctgaacatttgtactccctctgtcttaaaatataatttttgatgaatgtgatatatcctataagtatgaatctggaaaagctttctgtccagattcagtcataagatatgtcacattcacttaaaatctcttatattttgggacggtggaagtaacaagctaataagacatagtactaggaggtggaaaaggcattatttatgaccaaagtacaaggaaaagacagtatattttactgtttatagtgaatttctttttactgtctatagtgaatttctttctttctgatttaaggcactaatgagaaatagcactaggaggtggaaaaatattttttctatgatgcttgcaactggtcaaagatggatgccgtggcttgcatagcctcaacttgatccaggtgaacatcatcaattcgtgttctgtccacgcgaaaaatacttctgtgctcaaaatggtttgttctatttttatcgatgcgaggagtggctttcttcatcggaattgtgaaggcgtaggcacattaattgtgccatgccaaaaccggtcgcgttggttaggagcagcttaaggtagattcaatcacccgactgaaaaacctgttgattatttgatttacctcgggcaactgaagaagactgctgcagtcatgcagatcgatagtgtccagaggtccgcagaggccttgggcgacgtaccagccggcaacaattcttcactactacagcagaacgaggtgatcttgcacatgtgcttcattatgcatgacgggctcggctgaggatcgcgcacgacgatcagaatgtccgtagctcctgtctcttgcaagcaaaggcgccaatcgcaacgccgatcaaatgaactagagcgcatcatttgacgaggtgttcaatctgtgagggggcaaacatgactatcgatgcctcaagacgagctttggttggtcactttagttcatctcgaattccccatgcatcccatcctcagggcatcgtatcatcgaactaccgggacaacattctactactccagcttcaattctcaccgctgattttctcataggcagaggatgaagagatggtttgggtttatagttttctactagtgctgggttgcctgagtagcagcgacaactagcttatatatatatatatatatatatatatatatatatatatatatatatgaagtgacctgaaattaccagcacttcagtactctctcaagagaaacaattgagtagtagttagagaaacccatgcaagcattttctctgggtcatctaggctataacctgcagaggccggcccagtttcgttatctttggcaaaggaaaacgaggcccatctatgcccatcgaattttgggcctaccgaaaaagatatgcctatcataaaattgaccatagaattaatccacactgattttagcctacacaagtaatttccatgggaagatagggtgaaaacagatcagattcgaacggatggtcgtaccatattctaaaccatattttttaatggtttcggagctggtacagatagtgtgcatatgcggattgtctcagatgtcaaaaatgatgcggactcagttcagaaacggattaaaattatcgaatgttacatgtatatacaatcaacacgacatcaacttagcaatacaataataaatgaacgatcaattgtaagtactatatgtttaagtgctaaaaaatgtgaatacatgatatacataatataaatatgcagttatgcaagtgaaagacgacatggtgagagtcttactctaggcagtctaggttaattgatgaattataatatttgatagttgatacaaaatcgctaatgcacgatctgtcgctagaatctcagcgtcgtgatcagtttcctttccctttttgccaggcttgtgctcctgaaatcttctctcttttttttaccgctttttgtggttgtttctcttttttttttttgtcaccggtttcgatggtaccaacaagatgtgcatatgtgcagagcaaaatttgtatgcggctacctgcgtgggcctgctttcggccgaatagaaagttcataccatctttttcttttttgatttaaatccatctatggaaacttttcatatctaaagtttatgcgtataaaatttctagatcaaaagtttgtgtgtataaagtttgtatctgtaaagtttatacatggatgtttgtatgtcagaagttcttacatacttcctccgtttcataatgtaagtcattctaatattttccatatttatattgatattaatgaatctggacattcagattcattaatatcaatatgaatgtgagaaatgttagaatgacttacattgtgaaatggaggtagtagaaaatagcacgttgtgatccaaaaccacaacctaattacacttagatgttaggtcaccccagaccactaaaaaactagtacgttttattagggattattgggcaatagacatcaaccaatgcagacaactatatctaaaactgaaaagaaaaacaagcgcgtggatgtttatacaattatacctgaaaatgcattaatgcaatcgtacacacgggcattaggggtacccgtctcccaatgcgatcgtacaagcgggcattagggcatgtacaatgacgtctaataacgggctctcttcattgtcatgccagtaaatttggtgacgtggaagaaagagaggaaaagaatacatcgttgctacacatgacaacggctcagagtcgactgttaacatttattaacgaaaaaattgttgcaagagggtggaaaaaaggaaagaagtataataaaaactatttagtgcattaattaatggtttagaaatcttattatctctactattgtaggaggatagtctctagtgacattaattagtatagagagctcatattagactctacctttgtacatgcccccgtctcctttccctctttgccagacttgtgtgtccgagatctgttttttctttcccgatcacgtattccgtgtgcacgtgatccctcgcatattagagctacccaatttgatgggccgactcatattgtatgcaacatatagaatggttacttatgttaacaattttagattatctggcaaatagcctaccggataatccgcatccagctgattttagagataccatatccttatttgcatccgcaccacactacccgtatccgtatctttatccgccagatttttataaactcataccatatcgtcatttcgaatggattcagagtagatcaaatatcatccgatccgtttaatgtggttatgtgaacagttcgtattgagtttggagtatgatcgtttaaagaaatgtcctaactaagcggagcatctttccatatcacacaagcaaccactaccacagaaaagcaaatacaagtcggtactatagatgccggaagtggtaaaaccggcacatatagaactttacctgcccgcaccaaaccacgtgccagccagcctgcaaaaagcaaagaaccggcacttttaagcgattatagatgtcggttctaaagaaaaacggacacaaataccataggtgccgttttttaaaaaaaatcaacaccctgtaaaatcgagccaagccgcacaggggagggtgatattttcaagccgttcttatccatctggccccacctctctctctctccttccttctctttcttctcctcttctcctcctccatctctcgcatgccctcccctcggctgtcttgcacgtccaccccacccagcgtcagcggcgacccgacggtggaagcggcggcagcgcctcccctctgccagatccggacgggaggggaggcgtcggcctgacacgaggtgccagggcagaggcggcagcgcccttcgccaaatccggtcaggaggagtcggcgatggcctagtggcaccctcccctctatcaaattcggcgggagggggcggcggaggcggtggcggcagcgtctcccctctaccagattcggcctgttataaaagcagccccgaaatcacatcggaaaccaaccgcggaagaaacgccataggagatccacacacgatgacgacaccgaggcacgatatttgataacggagttcagccgaggcctacatctccggggcactgattacgggcgctccttcccgatccagcatatacagcgtatcagagttacaacgactcacagccggtcgccgccggcagccgctccctctcactatgctatgtcgccatgcggttacaacaggcacgccccctctatttatgagaaatcctaggacagaaaccgactcttactctagtcctatacctagtacaactccaagtcctaaactgtaaccgactatgtacacatattcgacataaactctaacaaactccaccttggcgaatatgccatgccaacctgaattcgttacttgctcgaacctccgtgtaccaggacttaagttgatcctttttcgccgctcacaccgagctgcctcgacaagcctccaccaggttcaccgtaaacaagagactccactatacctgcaatttcttcctcctgactccacctgcaacagtgctccaccttctctcatatcatcacagtcgtcttgccaagcgaaattgaattccttcctagctatcacgtcatagacttcccgaagactatgttcacctccatctaccatcttaaatttgacttgatctaatccatggccagataaccgatgtcatcaccaaatagataaatcaaactcactagacttgaagagaaccctttcttctttgtcgtcttatgaaccgaactaacgaatccaacatccacgctttccgcatccatagactgagtatccgataatttgagaagatcattgttgccttgaatcacccgaagaaattaccaccatagcatttgctcttcctcttcagtgacgcagattccatatatccccatcatgcaatccccgcagatcctggatatatcctgtactaccaaacagctcattgacgccctcaacgattttcattcgctgttgcccgggattattttcacccactgaagattgtctttaccgagtcgtaccaacacttggcatcttactgccttgctgcatgcatcaatttcctttgctttctcgcaaatgccatgactccacaagatccaagcatgtgtatttgacacacacgcgtgtccttccctcagatcttgaactggccaaatcaatgcacgaatgaattaacgttccatgcagcccatagcctcgtcacgtgcaaagccacaacagactcaaccataaacagcctaaccagcggaccgaccggtcttttccttctccaaaaaaccaactggtttttctatcggtaagacccagtcaacacagaaggaccagatcgaccctcttctcgctccttcgctcgcgtctcctcggcccaagtgcgccgccgcccagcgcctacgcgcctcttcccagccgccactccttctgctgaccatgagcaccagagcccgtcgcaccttaccactcctccgcgtccccaagaaatagcgccgccgctgctactgccgcagcctaggtttctcttcaacgctgtcgcccgctggaaggcgctgccacgcacgggagctggactcccttgcgccgcctcccctcaggacttcgccggtgagggcaaccaccgttgcttccgccgtgggtttcctgccggtgaggatgccgacgcccacgggagccacctccccgatacaggagcgtcgccgccgccccttcgccagtacctgccacctcctcgcaggagtcggcccgcgtcgaactcgccggcacctgcacgacgactacaccaagccgtgctcctaccgctcgcagttcgtcgcccaaaccccccgccgcccaagaaatcgggtacgatctcttcgttgctttggttggtttgattcgattgcaatctctgcaatcctgtggaatccctgctgcttctattttgggtaaaacttgactccgattccaaaacgaatacagtcctcgtccgtgccatgtgtattgaaatcgaaccgtgcccgactcctataccatgacctccaccaagtcaagtcctgcatgaacccagatcgggcctgctactaccagcgccgcttctgtctccgtcgccggcacgcctcaacgcaaaatcgtgcacaccaccacgaccctgacctccaagcttcacgtacgccagcaacatcctggttccagagcaaacacacacagcacgaccaccgacatcgtcaacgacttctgccgccaatatgtactgattctatgctgacgcttctctgttctaccatccatcgcatgtacgctgctaagtagcaatcctccatgcagtaccttgtcgttaacacctccaaaacagcctgtaggatccacccgctccgactttcgattgaacgccatcaatctagtcgcgaaccgaagccgacaagtcgcgtgtcgtcttcccagccgccgaatgacccgagtgctacatctagccgtctccctgtcgaacgcagctcatcgaaaggcctaggccacccgcccagagtgttcgattccaccgatcgagaacgccaatcacctccagcttcaatcaaccccgagcgtctggccagccgctccctgttgaaaatagctcaccggaaagtttgagccacccgcccgaagtgttcgacccaccaattgaattgccaatcgcttccgccgccatcaacccgagcaccacgtctagtcatctccctgttgattgcagccatcgaacggttcagaccaccgcctgaaatgtccgattccaccgatcaaattccgttgatcgccgtcgtgctccaccttgcgtccatgtccgtcctggacaccctgtgtagtcgtcgcagcgtggagcaccaccctcgtacctctaccatggatctcccgtaggctctgataccacttgttataaaagcagccacgaaatcacatcggaaaccaaatgcggaagaaatgccataggagatccaaacacgatgacgacaccgaggcacgatatttgataacggagttcagccgaggcctacatctccgtggcactgattacgggcgctccttcccgatccagcatatacagcgtatctgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataatggtctagcgatggcttcagctccactcccacaggcagctcaactggggtataagccaaacgtcttctccttctggatcctttttcttcaaaggaggttgattgattattgcaagaatgagcatatgacatactcaacaagccacacagcaaatttgcaagtgcacaaggataccaaaggatggcataatataggctcatttgcaaaagcaacatttagcaaaacatttaagagaagtgaaacagtggagtaattaatcagaaattttaatcaacactgaacaacacacccatgctgcacaggcccaaccatcctgaacaaccatacccggttgtacagatctaactccaaaccaggagctaagcaaattattaccaggtataacatccataattattgtgagaggtgtgagactaatcacgaaaaacattgctcaacccgcccataaccgcaggcacggctattcgaatagttttactctggccagaggtgtaccactgtacccacaagacacagcctcaacatcatgtctaccatgcgtcgcgatactggaaagtacccgaatagaggctgtgacaataccctctgcacatcacaactcaccacagtgcaccattcctggatcataatcacccccttataaaacaaggcatggactccccagcgacccccgtgggcttgtctccgccacttctcagtctggtgctccgcaatgaaccatgttatacaaaaggtaaagccgttgcccacgctggcttgtggttggcacggttaatgtttcacaacagtagcttgcgaaccggtccttaattgccatgagcacgaccttcaaaaccatgtgctcacaacccaccattaatcatattttaattaccaattaattatcataacacgattaaccatcgtgagctaccattaaatataaccataaataataatgtactacatatgattcatcccattagtgagctaatgtttcgaagcatggctaagcaattatatctaacatctagttgaaccaatatatataaatctcaactagtcaaattataatatcccaaggtatcaaggaatagagtaatcaatgcaaacaggccataacaaaggaatagattcacaccacccagtgacattcgaaaataaatgcacagttgaaataaatatagaatttaaatataggatcaacatgctcaaaggattgtatttagtatctgtgtgacttgccttgcaataatcggtcttcaattaatcttttgaacactcccgacgcactcacaaaccttcgcaacgacggaaacgacaagctaacatgcaaaacgaagaaaaagactaataaaaaccaaataaacagtacaaaaacaagcataaaaagtacatataaagtaaacaaacatgtggatcatgattttagatgaatttagcaacttgaaccactcaaaaccgagttacgatgatttagttatgaatttccgaagatttaatctattagaaaaactggaaaaagaaaaacgatgatgacgtcatgatacctcatcaatggccggaccaagatggcgacctcgccggagattggatggtcggctgcgactttgaaggacatgtacacgtagaggacgacgagacgaacctaacggtactcaccctcgaaccaaacgacgaacgacgacggccggcgatgaggtctagcggcggcgcggcttcggtcgacggtggcgccggagctgcggtggtcggcggcttcgggggtcaggcggccgggcttctccaccctcccgcgcacctaatggtggtgacggcgaccggcggcgacgacggaggcggcggcgcgacgcggatggagctcggccggcgacgatggcggggtggagcacgtggcggcggcgctacgaggcacgggagatcacgggagagggggcaaacgaaagaggaggactagggggtcctatttatagccttggattgaagagatcggactcctctcgcaagaaatcgatccgggaaatcaaaaactcggttttggagataaactcgaaaacgagttcgattcggataagatactcaacgattagctcagatttttggggtaaagatagaggaggataagaggaatatttcccctcaactaaattgaaaaaaggagcaacggggaggcgagatttggaaggaggaggcggtggcactgtgcacggcacggctggctcgggctctgcctgagttggaagatgaacagtagcgcggggaggggaagtagacttcttgccgggcttttcttttctcagcctgattagaagagggagcataactggactttggctgagagaagaagagaggatgcaggctcgggttggaccggcggaagagagaggaaggaaaggaataggccgattcagcctaagacaagggaggagaattttattacttttccaattaaaataatcacttaaatgatctttgaattgttaaaaatacttccaatgctcaaataatttcaagaaaaatcctgaaaatacttggacactcaaagtactatacaaaattataattagaccatttaatgattaatttaatatgtgggtaattactgaaatgttctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacagtatcagagttacaacaactcatggccgatcgccgccggtagccggtccctctcgctatgctatgtagccatgcggttacaacaggcacgtccctctatttatgagagatcttatgacagagtccgactcttactctagtcctatacctagtacaactccaagtcctaaactgtaaccgactatgtacacatattcgacataaactctaacacggccgagaggggaggcaccggcccggcacaaggtgcggctgtggcctgacggcaagagagatgacaatggcccgatgggagttgtgttctttctgttcatgcttttctttctgttcatgtgtgttcttgttgttcttgcatgtatataaattaaattgttgtatgcaatctggttggggcgaaggagatttactcgatgcatcgactcaaatcaagccgatgcatcgagccgtttttttattcttgaaacctcaaaggtgtcggttctaaaccagcactgaaaccaacatccattttctcttcataacagtgccgccttcgttgtaccggttgaaaaaaccggtacctatggggtttcccaaccggcatctatcaggtgttctatggtagtggatgtaagaaaatcaaagagatgcatgcatatgcctgctggatggtgaacacgatccgattaacatgaggcaatcctagctaatagatcgtcttataagcaacaacgctccatgtttccaccatcaaatcaatgcactctgtccacacattcaggctcggctaaggcttccccgcaacaattggcacggttcatgctattgtcccttgcaagacgaacaggaacaccatttctgtggagattaccatatacgcacaaggcaatgttattcgactggttatagagaataacttatatgagtagaatatgtatagatcaggactcgagtattatgttaactggcgtatcaaggaaatatcttgtagttctagtcagttatgattgtaaagtatatatagagctttagactgtaagggataaagtctcttgtaatcctgactacttcgcctatataaggaggggtcgggtgccccttgagggcataaccacaccttagatcgtcagatcaataacataatcagcagaatatttctccggacaggagtaggtattacttctcatcgagaaggcctgaacctgtataaatcctttgtctcataacccatccactttcctgcttgttcgctacccctttaatattgccgaaatctagtttcgacagttagcgcgccaggtaggggtagcgtcaagtttttttgccaactagtgcgattggatctacatcaggtattactttgccttccctccagggcaggcgtaccgcttcggcagcctccactacaagaaaaatgctttgtagagacatttttctagtactatagagactcttttcaaatgcctttacaatactatagaggaattttaaaaaatgtctaataagtgtcttatggtgaattgtctctacaaacgaagatgcattttataaaatgtctataaggtggtagaggcattttctagagacattaaattgtaccacaaccatatgaaaccaatgtagaaatgagaaaaaaatattttcccttgttttttgtccatccttgaactcatgatctcttgaacaaatcattcttatcttcaaggcactaaccaactcaaccccatgtcattcattgtatatgtttatgccttaagttacttatatttagccatttagtatacttttattgtaagaagtgtctctacagagtttaaagtgtctcaagcaaatgtctttacatgttagacacattttaaagtgccgaaagaatgcctttacaagataaaatctaataaaatgtgctgaaaatatttctaaagtgtctctagagtaaaagttttctagacaattttgaaagtgcctatataaagtgtctctacgctataaaactcctgatcttagaggcaatttgcaaaatgcctctacaaaagtgtctttatataatgtttttgttgtagtgctcgacttcatcaccgacaacttcggcaagatcactcttctcgactaggattcgaaccagtcgagaagagacggcggcttggccccgtttggtctcccgaactcggccaagatctactccaacatcatctctcccgagttggcttcgaaccactagggcgagacccccaagacttctttctcttcactaagcccagctcaagacacaccggtttacccggtgatcaccatgcgactcctagacgacctcaccaccatattcggatcaaggacatcctctccccgcaggtctcgatctaatctgactttggctcatattgaatctggctccagggaggtcggtgttatcttccagccactcggatcttgctcatctaccgagatcgccagctatctcagcccttcaagcaatggctcttgtgcgaacaccgagaccatcaactacagcgacgtcgacgatgagtacgacttcgacaacttcgcttgctacgacgattactatggtctactatgacagtttcaacgataacttcgcttgctacgactaattctatgacttctttcttatgctctcagcacacaggatgaactagagcacagtatttggcgaggtaggaaatctatgagaggctaacattacataggatgcctatgcacgagcttctctacattgaggttgtttgcctcaaattccccttgcattccattcttagcgcatcacatcgtcgaatcacagagatagcgttctactatttctcacaactgctttctcacaaaacagaggaaggagatggtcatggtttgcaattttatggtgccgatttctgccctgaggagtagtggctagcttatttatttatgggcacttggaattgaagaggcgctagcactttcagtgcctcacaccaaccagacgagaggagaaaaaggagaacatttcgatctgaacattggtaacacattatttggccacatactcacatatatatataaccaaagtacaacgcaaggacagtatattttattttctacagtgaattatttttttctgtgtgatttaaggcactaatgagaacttgtactgggaggtggaaaaatatatttttctatatgatgtttgcctcaacttgattcaagtcattcaggtggacatcatcaattcgtgttctatttgatcaatacaatcatatgtacttggacgatcacaggattgaaacctatctatttaccttgagcaagtggagaaggaagtgtagcgtaggatcgaacatcaagaactaagccaatcaaagggggggggggtgaatggttgatgtacccaaaaaccaaaacttttagcggaaacaaaagttaccctcaatttcgacgaatcgcggtctgaccgaagtagatgcgtcggtctgaccgagattgtatctccggtctgaccgccaagataaactgccgtcgccggtctgaccgctactaacccgtcggtctgatcgctgcgatgccgccggtgtctcgccggttagaccgccgaacccgagtaaacacaaatcgaagaactcttgatgtagatgacaactttattacttctatctgtgtttacaaagtgcaacaatagcactcctcacgaaaatttcgactaaactcgaaaccctaactcaactctcaactcaatgctctcaacagcaatactaggaagtctcacgctccctctctatttatacatggggtaggcagcctaaagccacgaactaaactcatacaagaagtcctaatctatctaggaaaccttgtcgtacaagaaaccaactttacaaactccaattatatcaaatttggactccttccaaattcaactttgcatcccatacacacacaatatgtccatcgtatgccatataaaatcttcaccaaccacgtatattgatcgttagcctaagtatcccacatgatatctgaccgtccggacgtcaccttatctccaagttgactcctgatccatcaccggcaaaactcccccgcgaggcatcaagtcacatacacatgaatcaaacaaataaaccatattcctagaccaagctatctccaacttaactcattattagcaaacaacagtattacatacgtatagtatctatctagaagccataaatacaaaatatccacggatatccaatcaaactacccgaaaccgaaaccgacgcagagtcggccggtcagaccgcaggctggccgatctgaccggcagcacccactcggtctgaccggacctgacaaaacagcagcacctgaataacacttgtaaatccaatcatctccaaaaccacttcaccaataatcctcaaatattaaaaactataatctcatatgccaattgttcatcatagaataagaatcaaacacaatttgattttacatctagtcatgcagatcgacaggtagtggccggagctctggcgaggcaacgagcgacataatagacccagagttcttcttttcctttttctagactagtcaaggagggagtggggaggagcttctcctacctgaatgttggggaaggggtaaaaagtttcatatcacgccatagtttccttttcgggaatacgcaaaaggataacgcacctttgtatcaggaggaataaaattttacaaacgggaccaaacaaaaaggaaacaatagccaagagctgagaaagaaaaagaaactaaaaaccagaggaacttacccctattctcacactacaaaatagatgacctagtgacctagcaccctacataggaagtgcaggctacaaggccctggcaagccgccagagggtggtttcctgcaccactctggcggctcctacgtcatggccatgacgacctcgggccaggacggtgtgcagcggctgaacacatgttattcctttccttccaatccaaatagaccaagcaccaagggtagggtgctaagaaaatcattacactgcttaggaaatcatttaattactgtccaattaagttattctctctccgttttaaaatgtttgacattgttgactttttagtacgtgtttgaccattcgtcttattcaaaataattatttattcttttcatattatttgatttattgttaaatatactttcatgtacacatatagttttacatatttcataaatttttttaataagacgaacggtcaaatatgtgctaaaaagtcaacggtgtcaaatattttgaaacggagagagtacatggtgaaacattttattaatactgcctttgtgaaatcccagaatcaactggagaagacaaaaaaaaaacctaacgagataattatgcacgcgagaagttattctgcccaatgctggtcgtttcaccggcaactccacgcactgaaatctcgcaacgcgcgacgagctctcctgaggtttgcgtgacgagcaggacggccccagaagatccttgcctcttgcaaaggggacaatcgcaacgccaatcaagtgaattggagcactgcaattggcaaatattttcagtctgctaaaggctaacatgacaaatcatgcctaagaaggagccttggaatgtcatcgttgttcatctcgaattccaaatgcatcccatcctcagggtatcgcatcgtcgaactactgacacagacattctatagacgttctcttctcaccgctgcttttccgacagacagaggatgaagatggtttgggcgtacagttttctagtgctggtgatactgccgaagtagcaacaacagctagcctttttatgggcacttggcaaggtaattagggttctgtttggatcgaagggatattttttaagccctcccttaaatagcctaaattgtcaaaaaaaatctaaaaggatgagctaattgagggctatttgaaaataacccaccaaaaaaactattccacccaagaggtgctaattggggctattttgggtagggcccactgaaaaattgcattttctctctatctctctccataggaagttacattaaagaccaaatagctcttaaaataaccgttggatccaaacaacttagggctattttattggagggttattttcttgtgaaaaaaaatagctctcaaaataactctttgctagttctccaaacagggcctagataagatatatggcacttcagtgctacaccagccagagaaaaagaaggaaaacattactctctcagcattagctagttccatgcatttcttttcacacatataaaacactagcgatatcgtggtgctctctctattggtaaaattatactactagtagaagatgatctgaaccgttcattattaagaaaaaatagtaatttactaatactacagtgattaggggtaactttgtcattaatttttttcccacctagatcaatatatggtcatctataaatatgtggtcatctattgctctggcatcattcatattccatcaaaaagccaaaagaagaagaaaaaaaatgtttgcactcgtatgaggagtactaattagcactcgatgatcaaacgaccactaaggcactaattaatcactatcatgcgccaattgaattacttctgaagaagtgacgtttccaaattgcaggtttctggaaaagcaaagacctgaactgtttcttttgcaattttttcttgatttcaatacctcctcaacatctttgctttgactagtatgccatgcgttttgtttaagtgacgtgtctttttttttcttcaatacctcctccttagaacgctaaaattgtttttcggtaattaacttagagtgtctatatctataaaaaaatgatttcgtttggggtggtgtattatattgtttgatttggtatcactttcctagtatgttctttttaacaataaaaatttgtttgatagtccctccgtctacaaatttaaaagattttgcctatatataggcaaaatcccttatattacagtgctagcaaatcgtttactggccaattaaaaattgggttaattggatccataccactataactttactaaaataaaaaaatgtcactattattcgttatatcggctacatgtcactggaaatttctaaaattagaaccatgctactccagtcacttttttcatcctcctctctcataccgtctccgttcctgtctcattccgaccaccgcggcggacttcccgacgagggcggcatcgacggcgaactgggtgaggaggtccgggtgagtcgaatctacgacggcgagggccgcgtcgactgcgagctaggagaggaggccctaccaacgccaccttactgctggtggaactgccatgcccagcttcatcgtcaacaagcaatggccaaagcgaaccaatccgaacaaatccaaccaaatcaaaagaatttatcctttctctctttttgttttctcatcaagaagaggaagaactcacggccaagaaacaaaagtcgagtcgaatcaaatctaatcgaagaaatcatgctcctgttttgcgctcatccagcgatgaggcgttcacgggtaaggccgatgcagcggtggtgccacccctgcatgcagcaacccaagccgtggaaggaggcggaggaggtcctctccggctacggcagcgacgtggaggagcagtggcggatgcagaaagaaatagcagtgggtctgagcaaattagatagagttacagtccccctaccatctacatatggtaaaagaatttagtgggttctttgtgggggctttcatagtcttcacgccagtagcgggggctcgagacccgccgctcccgtactggatacgcccctgcggaggcccccgtgctggatccgcccctacggaggaggtcgtgcaggctcccaccattcacaagggtatgccgcatgttcacaagatcgtgcagactcccctccacaccaactgggggaagaaaaaaagaaagaaggaagaaacggcaggacgacgaggacacgaaggagatgatggagagctcgacagggttgaccatggcgtggaggatcccaacggcacgtgcggcgagcaggtggagggcgtcgattgccgcggtagggtgggcgctggcggagaggagggaatgggcgcggcggagcagggatgcggtgaggacgacgacggtggttgtgatgacctcggcaacggcgtcctggcctcctgggaacgagaggacgggaaggagggaggggatgaggacgggaacggagacggcgtgagagaagaggatagaaaaagtgactggaatggtatggttccaattttagaaatttccagtggcatacagccaatatgatgaataatagtagcattttttcaatttggcaaagttgcaatggcatggatccaattaacccattaaaatttgctaggaagtcgtttattgtccaactaaattttacattgcaaaagcgaagtaagcatggctgaactggttatattccttgtggtggatccaaatcaccccattgcttgtatttacaactaattattctttcagtgataggcgacttaccgtcaacagcaagacatttatggtgatttcgtcaatctcaagatatgccggcctagtattgcgaaggtgcttataaggatagagtgtgcgtgtgttgtgagtgattgtgtttgtactatgtttctaaaaaaatacatggtaaaaaggttaatttttaacacaatcttaacgaatcccataagcaacctagagatgacaaaacatatctctcatgagcaagactgcgcgcgaacagggtgtaacaagatttgtataaattaaaaccatcttatagctaaatataaatattttgctgacatggttattattttgaagctaatagcttactacactattagacttgctctgagctggtcgaccgaagtcccgtctctgtcaagcagatgggccaatcacaaggccgatcaaacgaacaagagcacaacatttgtcagggcatttaacctgtgaggggctaacatgacatgcacttcaatgtggtgatccctcaaatgggctttcagtacgtcacggcgtcctggttcctcatctcgaattccccatgcatcccatcctcagatcatcgctgatcatcgaaccaccgatcgagacaacattctaacacagctgcttttcccatgggcattggatgaatatggtttattgggcatttgggttttacagttttctagtgcccagagtacgtagcagcaacaagttagcttaaatttataacatttgctctggtccaataaaaagtacctggcaagcaggcaaggtacataggtactccctacgttttaactttgatcaaagttaaactactctaagttcaactaattctgtagaaaaaatagtaatatttacaacgccagcataattttattataaatctataattaaataaattttaataatatatttgtcctgggttaaaatatattactacgtttttctataaaactaatcaaacttagagtagtttgactttggtaaaagttaaaacgtcctgtaacctaaaacagagggagtaggagatttgctccggtccaacaaaaaagtagctcgtggtaccatcattatagtaaaggttaatgtttgcagtgtcataattgcaaatccccccacggtaccaaatcgttttcgatcgttgaatctaacaatgcccatccggtcgagctagatccaacgatcaaaaatgatttggtaccatgaggtaccgatacctcgagatatttttaataaaattttgtatgcaaaatgtggtatctcgatgtaccaaatgttggatggtaaaattgctcgtatcatacatatatggagtgacctcaagttattaggacttcagtgctacaccagccaaagaagaggaaggaaaaaaggaaaaacattctctttagttgttagcgtatataacgaagtgtagcaagaatacatgcagtttatatttcactgctcggagtaaacggaatttgctaaaaaaaacgctcggcagatttttccttttcccttaaaacttttgaatttttggccgtctgatgtgcttcaggattcaaaagcgtgatcgttaaagaatacgtctttgatgaccaaccaattttttatccgtgattttattaacggtggtgtttttctgccatggttgttttcactaatgacagtaatattatgccatcgttgtagccatttttgtattaacgactgtgctacattgcataagcaaccaattaagctgtacctaatcaggactgaaacctattgatttaccttgaaaaaggaaattacatatagagtcactatataaatcgtggctgtcatccactgtgattttccttttacccttgatagcatactcaaagcagagccaaacttgaggaccgaactgacttgtagagcaactctgaatatacacaacatactttcctagatgaaccatgcttcgacgttcggaatgaattgattgaagaacaattatgtaactcatgtctagtatatgaatggctaccaacaagcatagtgccacaatttaaccctgcaattctaggtactgaccaactcaaattcccaacacatcctattctgagtattctcagggcatctcatcatcaaaacaacaaatgcaatgctcatctcttctcgccttaggaagaaacaaatgaaggagatcatcaagcgtcacaatgttcatttgattctgcccctgaggagtagggcacatatataggttatgtatttaagtacattcagtggccgagtgacttagcactaagtgctgcaccaaccagttacagtttgatttagggagtgcagtactacgaaacactttaaaaattaaggtaactttaaatctaaataaactttatagcacagtagcacagtagtagaatttaaatctaaactttgattttgcatgagtattgaaaacattttatttgaagctttaacatgagtaatttctatcattataacttatcgtataacatacgaatttacctagggagtagctatatttatctacttgtctatttcaattctaactagggagtagctatatttatagcgtcacatttttcataaaaaaatagtcaaaatcgtttttacactgtaaatatattcacttacattataattacaccgtatttacattaatataactacaggataagtataatgtaactatggtgtaattacttggtaatttctcagtttcacttttcaccgttttctttcttctcttttacctttctgtctccaactaaattcaatggatgatgtgacatgagtttctttgggcaataaaaatgagatattcacatgagtaacaacaaactaaccgtggcaagtatggagaagctggactcgaggtctcggtcaaaaaaggcacgtacacaagttttactgattttaattaacagaaaaatatgtcgacacattgcctcccaaatttttatttttcaattttcagctcgagaatcgatgaacgatctcctggacgggccggaccgcctgggtgcacgttcacttagacgagctgcagtgatatcttgtcagatagtaaggtcgtatgctcatcacacacagaatggacagatccatgttgctgtaaccggagcatgtcaacttcagggtctctttatcactcaacgctaattccacatacatcctattctcaaattaagcatcgtatcgttgggccaccggcacaatgttctactactcttctcatcgttgatttccagcagacagagaggaattggggatgatcgaggtatatagttttaggacttttacggtaaaatatactgctagtacatactgcaagtatatatgatttaacggtgtagattgatttgattttttttgttaattagattgcagtataaagtttgaaagggtaattttatcttttcttcgttattctatcatcaaatcgtgctaccgtcacgtgcttcgtcatcaaatgtcactcaagatgctcctcctctattgcacgataagatctaagacgaggtacttccaattaaattcaatctgaacaaaaaattactaaaatcttatttttattttctatcaaattcctaacatgcccatcaatatactgccagtatatactgatagtatattgtaccgtaaaagtcctaatatagtttttgagttctgattctgtacgttctaatatcccaaggagctagaagcagctatagcttttatttataggcacttggcaagttatactacttaggacctcgctgccatgccaaccagaacaggcggagaaaggaatgcgttagtctatgaacattagtaacacacgattttgtcacatgtatataacggaagcataacggaagtacttcctccgtttcacaatgtaagtcattttagcatttcctatatttatattgatattaatgaatctatacatatatatctgtatagatttattaacatcaatatgaatgtagaaaatgctagaatgacttacattgtgaaacggaggaagtaccgttttttctccttcgctcttttctcctcttcgccggtttagggttagcggcgggaggcagggcgatgagccggcggcggcacagcgcgccatcgtccccggacagcggcagcacgacgctcttccctctgctcactgataaccattcatatctaaccttatcgctgcatgatgttagtttttacccccgtcaaagttgattttagcagtattttgttcgtcttgctactgtgattagtccgaatctatcaaaaacaatcaggcttaggaactatgcattaccttaaccaggaagagacgggtaaaaagaataagtgaattattaagaaaaaagatcattaaattcaagagatacacgcagataaagagtgatttagcctactttgtttgtggacagttccgaaatatttaacatatattatatgaatggtattttatttctacatagtgtgatcttcatatccaaatattatttgtagtgtatacattctgagaggtaacctcacaactaatgtgaagtggtaattctatctagccaacccaccttcatccctccatccaaacaattgataggatcattctaacccattatatctctcaaatcagacaaaaaaaaaaggtatgttctatccccttaaccgaaaaaaaatagaatcatcccatccaaaaatagggatggacctaacccgtcctatcttgtccccaaatcaaacacatgctaggtgtctgagtgtcgcttctatacgtatgcattacaaaatcgtcaacacatgcctccaaaatttttatttttcaattttcagctcgagaatcgacgaacgatctcctaaggacaagttttatagtggaggtgagtgtcacatctaatttaaaccatattatattcttattaattaagagataacaagtacaatatgtcacctctagtacacaaaccccaatattagtttactctcatatcattttatatttttcttagagatgctgtggagattgccccttgtatgaggggtggctcattctctctctcctaatttctctcctccaactcatcacttaatcctatgcgataaatttagagataaaatgtaggggtttacagtacttgccctaaggcaggcaaacggctggaccgcctgggtgcacgttcacctagacgcgctgcaccgacatactgttagatagtaaggtcgtatgctcatcacacacagaatgaactgatccatgttgctgtaaccggagcgtatcgacttcagggtctcttgatcacccaacgcaaattccacatacatcctattctcaaattatgcatcgtatcgttggaccacctgcacaatattctactactcttctcatcgttgatttccagcagacagagaggaattggggttgatcgaggtatatagtttttgagtgctgattctgtacgttctaatatcccaaggagctagaaagcagctatagcttttatttataggcacttggcaagttatactacttaggacttcactgccatgccatccagaacaggcgggagttctggctgagaaagtaatgcgttagtctctgaatattagtaacacacgattttgtcacatgtatataacggaagcatgacggaagtaccgtttgtgcgaatttcactctctgtttcaaggcactaacgataaatattactccctccgtcccaaattatagggcgtcctctttttaagaaaaatcaaacttgataacttttgtctaataattatactaacaatatatatgctaaatattgtgcatgttatatcactagattcatattttaaagtactttcatgttatgctaatttcatatttgttagaaacataacatgagataaattaatggtcaaattatgtcatcgaagaccgtgtaaaaaatatagaccttataatttaggacggagggagtactcggaagtggaaaaatacaatggtgacaacacatatatgtgacggagaagagacttatcaatgaaacctcatctgtgacaagtgaacatccatcattgatgactcatccatgacgggtgataacttatcacacatcacacataagaacttacaatgttatagccacaaattcatgattttttaagtgacatttatatgcatgttatagtgaaatttaaatctaagatctctcaaaacatgcaaaccaatcttaccatctcattcatagaccacttgttgataggtcttttgcatgtcttttttttcactattcttatccaaacatgaaacacaaaattgacactctagataactagaataatttcaactataaagttgcatatctcgtcgagctctacaacttctatgtatggcatgtctccatccaaggtcatttcaaaaattcaaaaaatattttggaaatagatcacatcacttataacacatattcaaatgaaaaatattgtgaattataaagttatatatctcatcgaactctttcacttcgatataggacatgtctccatccgagatcttttgaacaaaaagtaaaatcaaaattatgtatttcaagatagatttcaccacttgtaatgcgggaacatatcctatgcacataagtttttccgtatacactccgtgcacaccaactagcaaatgtcatagaaaattctagagaaaatttgacacatacttccaatagtattacacctatatatgaaattttaccttcaaattcattatattttagccgtaacaaaaaatacaaaattttgacatatttttatccttaaaactgttagattttttattttttatggctaaaatataatgaatttgaagataaaatttcacaaataagtgcaatactattgaaaatatgtgtccattttttttagaattttctatgacaattgttagttgttgtgcacggagtgtgcacgggaagattgtgtgcataggatatgttccccttataatgcatattcgggcatgtaaactatttcaaattcaaatgttgtcaattttaaagttattgatctcctcgagatttacaactttcatataagacatgtctctattcaagtttgtttgaaaattttccaaaaaaatgaattttccctcatccgtgacggcttgtaattaccactcttcacaaataaccattacggatgagtgctctcatctttaacgggttatctcattacacccgtcatggatgacatgttatatgcgacgatgtacggttgtgacctgttataggtcatccgtgatgtttaacatcacagctatatatgatccatcataattgaccccatatcggtgacgggccatccctggtagttatatctcaaacgtgatatcttttatccattagagatgaatcatcctaaacaggtcgcattagcccgtcacaaattccggaatctgtactggtcactactacttcccaaaattagatgttgtggctttctcatgcttcaatttgattcaggtgtacagcatcatttccgtgttgtaacttgtaatgcactccccgctcaagaaacaaagcgtgttctgactttcaaatgatatacctttgatctacaatttattttattgatacaataataatcacttagacaaatggtgaaatatgatcgatgagcaccattaacttcgatccctcgaaagaacagaatgctatatatggattcctcagtgctcgtcctgaacacgaaacctgaaaaaaaattttcagcctcctcaatgcatttttgtggaagcataaatcataggtcactaccacataacacgagaatagtgccggttgggaaacccctttctatgtcggttttttcaaccgacactacgaaggcggcactgaacagtaaaccggcaccaatcctattttaaaaaccggcacctttgacaccactcgtgagcaaaaaaaaaaagcttgatgcatcacaatctctgcatcacaatccctaatccccaatccccaatcacagaactcattcacagaaatcacagaaatcatttcactaatatcaataaacattccctaatccccaatcccaaatcacagaactcattcacagaaatcacagaaatcatttcactaacatcaagaaacattgaagaacatcacacaaatcatttcacagaaatcttttaagaaacatttcgccagatccgacggagggagggagccgccgccaggccgccaccgcctcttgtcctgccgccgcatcccccctcccttccgccgccactggaccgcccctccacggccgccgccgggccgccctccccggatctggcagaggggagggcgcgactgccgctgacgcctccgccggccgcggatagcaagagagagtcgagaggggagggcgccgccgccaagctgccactgcctctcatcccaccgcagcatcccccctcccctctgccgccgcatgtcgcccctctgccgccactggtccgcccctctgcggccgcccctccccggatctggcgaaggggagggcgcagccgccgctgccgcctccgccgaccgagagaggagaaagagaagagtagagagcggagaaaacgagaggagagaacgagagacggagagacgaagagagagaccgagaggagacgagcactgcggagcggccttttctcctcaaagcttcgtggtggggcccatcggctcggctcaattcataggtgttgattttttacaaaaaaaccggcacctataatttattatagattgtaggtgccggtattaaatactaagggttccggtttttttaaaaccggcacaaaatagagtagatgctggtttttatttagaaccgacacctataattacttaatggtgtcgttttttgcgatttcaacccgtggaggtgggaaaacccgaaaaaggcctataggtgccggttttagaagcactaccggcacctatagtgccaacacctatttgatgttttgtagtaatgggtttatcacatgctataggattttatacatctggtactcaaaacccgcagaacattgtggccctagcggcatatttgtaaacaaaaagtaattttaaataaaacttgttagtgatctaaaagcaaaggctgaaaaataaacttcacttaaaaaccctgaaatcaacttgaagtataaggttaaaaattcaaattttagatgataaacatgagtataagtgaaaagatgagactgttagtttgtgcacaacgggaatagcaagatgcctgtctcgggctctcgactaagccacactgtggagccccccgggtgcacctagccacctacaagctaagctgtttgttcatcactgactcaatcacttggtaagagcaaccacagtgtttggttcggccattgtattgattgaagtcgaatggagagtgaaatcgatagctgcagtgtgaaatcaatttgtggggcccataaaaagaatccatcaaccaatcagtgcgtctactttctaatttctatgcatgtatggacaacaaatattttttaactctctagagttcgacttcaacttagagttcgatttttttttctgacaccatgagtcggctgtcacaatgtgtatggttcgcttttctctgccttaaatcgattttactttcacactggagatgctctaagctcatatccgccttgaaggtagatcgagcttaactcaacttcggcctagaactagattgtgatatgctaggttggtaacgagaacaactatggcgttgcaaccatagcatatcaatggcaaatcctagagctcgcgctcgcattcctcgtgcatcccattctcaaagcatcgcatatatcgttgaagcacctaggatactgtgtgttctacactttctggaggagatggtcagggtttacatttttctagtgcgggttctagccagaggagctagtatagcacactagcagctagcttatttatgagggtaatttcaccatcactgaaagatatatagaggtaaaatttaatatttgtaagtactaagtttctcaaagtactaaaaattcttgctgtaaaatttagacacctcgagattcctttatttataggcacttggggagaggtactaggtagcatttcacttcattacgagtgacacacaacaagagaagaaaggaaattgtttactatctaaacattagtagcacatattgtcacatatatatataaccgaactataacggaagtacagtttgtatttcacaacctagagtgatttattttctatgttctaaggcactagggagaaatattgctggaaggtggaaaagtatcgtcctcttcgctagcgtattgttactgcctgaaaatgtattgtcactcaccgccgtcggtgagtgatggagctaggtgaggggagggagaagagagtggattagggaaagagataaaaatgagagaaatagagatcaggtgcgaaactgataggcggggtctatcaatttttttaataaaaaattgctgactggactgtcacgtagaaccaaaaccaccgcggattgagccccgaggagagtggggggtggaggtgagagttatttgtgcggtttgtatagttgggggtgaaggatatctgctttcatgcatggttcgggagataattcaatcgaacgtgatagtttaggaagtaattcgtactttttccttaaaacaacgtacattctttttcacttttcaggttccatcaaacttttatttttcatttttcagctcgagaatcgatgatcaatcgtctgagggtgtgattagttcgcaaaaagaaaatttttgtgtgtcacatcggacgtttgactggatgtatgaaggggttttcggacacaaatgaaaaaactaatttcataactcgcctggaaaccgcgagacaaatttattaagcctaattaatctatcattagcgtatgtgggttactatagcacttatgactaatcatggactaattaggctcaaaagattcgtctcgcgatttctatgcaaagtgtgcaattagtttttttatcatctatatatttaatgctccatacatgtgtctaaagattcgatgtgacgtttttggaaaaaaaattaggaacttaacaagtcctgaggcaaaacggccagaccgcctggagtacacgcgctgcactgatgaactgtcaaatcgtaaggtcgtatgcttatcacgcacagaacgaatggatccatgttgctgtaaccggagcgtatcgacttccagggtttctcgatcgcccaacgcaaattccacgtgcatcccattctcaaagcatcacatgcagggataaaaacggattggaaacggacggaaactagctttatcatattcgttttcattttttttttcgaaatcggaatcggaatcgaaaacttggatacggaaatgaaatcgaatattatcgaatatagatacggagcgaatacgagacggaacgaatacggtagcgaatatttaccggtatataaaaaacccctcaaattgagtttcttgatcaaggaagagatatcgtttattattttagttcaatatctccaacatttatatcgttaattttatagacggtcccacaaccgtatgtgaaaatcaattttcatggttgttcctctaagagatccatatgcaaatatgattatcattttctattcccaagaccttttactacatgtataacttacttaccattgtataaattagagattttatttattttacttcacatcttcgaaacttgtaatgtttgtattatattttaaatgctttcaaatacaaatgttataaactacaaagtggtagatcccgttgagctctataactttgatatggaacacatctccatcagatgtcgttgaattgtagatctgagatttcgtaaaaattaatatggtatattataatgaatatttagacccataaatgacctcaaataataaaatagtcaataataaagttgtagatctcatcgagctctacaatgttgatataaagtttgtcttcatctgattccgtatgaaaaggttatgtatatagacatgttttttatataatttgctcaatgtctgcggatatccgaaacaaattccggatagtttccgactgttttccgatttcgaaggatagtttccttactgtattcgttttcgtttccgagaaaaaatatccgaattcgtttccgaatccgagaatttccggataattccgatcgaaactatccgaatccgaaaaatggtccggacggacggaaactatccaaaccagtttcatccctaatcgcatggttggagcaacggcgtacaatgttctaccctttaacacaataacagcgggttatgtagctgctggatccctagctgctggatccctctctagactgtcagtcacccgggtgcacctacaatcagtgtgttgttcggtgatggttgagatcatttggtaagctctcctcgaaatcttaccaatcgagctgatctcgggtaggggtgtaagtggctaacccgcgaaacctatttatagactaaaataagccgcgagcccgcttattttgatctataaataggttcgcggctgacccacttacacctctaatctcgacctcagactgatggactgtgatacgctaggttactggcgtgaagaactatatggcgttgcaaccgtagcatatcggccgccaactctgcagcttgcgttcgcgttcctcatgcatcccattctcaaaagcattcgcgtcgtcgaagcgccgagacagcgttcgacttctacactatctgactctgctttctcatggacagaggaaggagattgccaggggttttacagttttctagtagcggagtagcagcagctaacttatttatgggcaacttggggagttgctaggtagcaagcacttcactttagtgccacaccaaacagacgatagaagaaaggaaaacattactctctgaacattagtaacacacactgccagatatatataactgaagtacaatgaaagtacagtttatatttcacaacctagagtgatttattttctatgttctaaggcactaataaggagaaatattactggaagatggaaacatatcgtcctcttcgctagcatattgttactgcccaaaaatgtacgttctagctttcacatcttcagtttgttacttggtttcaggtgaacagcatcagttcgtgttgtagtgtgctatccacacctgaaataaagctttgttctgtcctcgaaataacatgttctattttattggtacaatcatcaattgggtgatgaaatagtcgatgggcaacactaacttcctgaagttccttgaaagaatgggataatctggagacctcatagctcgtcctgaatatgaaaccaacagattgaaaatgttactgaactgtttctcctgtacctttggcagttctagagatacaagcaaatggagaagttttgtaacttacatggtagtcatacctacgatgatgaccctgcaaatgtagagaaacaaaataagatgtcagttgtgatggccatcaaccggtgtcatattactgatactagcctatgcatcagcattagcaaattgtacatgtatatggcagttagtggttagcacgcacactacctctacatgtctccacagtgatgatgtctagaattcttacatgttttgctgacagaatgtctattacttttttttcttgctacctatcttttacctgatctttgtaaattttaatacagctatagattttcctgttatatcctaaagcaagcagatacaagctaaaatttttgatagattattatggtcggtgtttgatatattagaggcaacccctctctgaaaggagtaaaaagaccagctgaattgtagaaggaagaaagtattccacatgatagcagggagaagaaatgtactctatatctatccctgtaacggtccctgcctcggtgccgatccctgtctcttcttcgtttctctccttcctctcgtgcacgccgagcctcctgtggaaaagaagcatctgttagcttccctatgaactggaattgctgagtcacaagacccaactcttcataataatgaacaaacagaagagtaaccagtgaactaaaagcaatcacaaacctcgtcttctctagccttcctccgcttttcagcctcctcgaaggcctccttttcagcctacaacacagaaaaatatattgaaatgggggtttccatgacatgaaactaatggcatggataaatttacaaatatgcgttctgtgttgttattccaggtgagcctacctctttatttgcagccctaacttcatcaacaacacttcttgcatactccgggtcgtcacaaatcaaaatgttgtcaaaaactgaaccagctttcacctgcataccacctggaatgttagcttacatagcatttatgccattcatgtaaaggactgtgtcgtttgacacagcctagaagcagcattccaacagaacaagcatatttaaccaagaaatataatacctgccaaacctcaattcccacatactgcaaaggtttcagcacatataggtctgggtcgtcctcaaattctgtgaaagatgcatatacatcacttaatattcacttcaaatttggaaggaggtgaggtccagctctaagtcagatatgcagcaagaaatgaaaaacgctaacatagtactgttaaaaaaaaaaagcccatcatttctcacctggattatcaatccatgggatcttccattttcccttgtagttagggttcttaattttctgcgtacagaagcatgttaaaaaaatgctacaaaatgtggcaatgaggagctaatcagtcaataaaacaaaccttgcgtttccaacgtcccttgtattctggattcggtatcattctaggcttccatacaccatcatcatcatcatcccatgactcaggctgatttagtgtagaaaggaaaacatatgtcatcctgtgttatatttattaacttagcaaacacaccataagagccattgaggtcatgctgggttcaatatagctaatagcagatagaaaatgctaacatgccataggatgtttctaatgaaacaagcttgaacaggtaaaatggaacctttgtctgcactcgggttcttctcataatattaagaacatatgacactatgtccattataaacggatatgccaattaaatgcgaaaatattagaagctggatttacagcgtaattcttaagtgcaaacctttttgtcctttggatcaggaatctctttaggaatagagtcatagccctggaaaattaaggtaaaagattacataacgttctttatttgtattatcaatgtataacaaatatgaaattgcaaacctctggtttaacttcatcaggatcttcaatatattccctgtcatcccaatcttttggctgcaagagaagacaaatataagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28687 - DNA, 687 bp, Oryza sativa
  unsure (1)..(687): unsure at all n locations
agctctctcgnacccttgatacgtaagcatagggaaaactgtgtctagagattagagatctagaaaaatgttttgctaatatattttccttttaagaagcccagtactatttggaaagcattatcagttatttcgtccatgtacataacnatctgtgcaaggcttgccaactatgttatcaatgttatcagtgtgttattttcttattttgtattatcaagcacagttctctttccttcctatgtcatggatttctatgcatcctgagggaatgaagccgtgccaattctgtttttatgtttactgctgtcctagatgttctacctttgtaaccttcctgtgcttcatcattgtcatcagtccattcactattgcaggaatccaaactcaacccttgtgctagggtcttctctccttcgtttgcaagttccagaccagtacttgcagctgcaccctctgttaacccaatctacatctcaaactctgtagctggagttccaaccgggttacctgtatttgaaactaactcagtgccaggcggttcatccctgtccagcaaggctgttcattataataacctggctgctgcaaactatgctatttcacctcaatatactcagtcagtaagttctttgattaattcttttataatatcattgttgcttcaatagttcatcactttcttca

SEQ ID NO: 28688 - DNA, 662 bp, Oryza sativa
atgcttgcttcagtttaccaaatttctatagctaaggtgtggcatgccacaatttatgtggctaagaaattcttggccacaagttaggcaaatgttggcaaatgtatgtgcctatgataagtggggtcacaaaatcaaaaagtgtggcatgacaaagatgtggcaatcaagcaaacactaggctaaattggtcaaagtagcttgccaaagttgtggcaaagtatgatcaccatccaaacaacccctatgtatccgcctctctgcatctcgttggcaccacgacgggtgccatgccaattagggtgagattccgcttatccctactgaacggatacgggtttgacgcataacttcgagcgagccggcagcgactgcaggatcgccaggttcgtcaagaaatctgacctgcaggaacatgcaattcgccggattcggttcactggcaacgacagcttcaagatcgagtgttcgctgaccgtcataagcgagtctcgcgctgaagacgtgagcacgatcccagtcccgccgtcgaacctgcaccagcacctcgccgggatgttgcacggcgtcgagatcgcggatgtggagttcagcgtcggcggcgagccgttccgcgcccacacgtgcgtgcttgcggcgcgggtcgccgtgttcaaggcgga

SEQ ID NO: 28689 - DNA, 493 bp, Oryza sativa
ctttttgggaattaggccccacttcgctctgttttgccggatcttctttctcaagccccaaccgaacaagaataagccatgtgtagtcggaggggcaggatttcagttgaggggaactctgagtcagaagtacttctctatgcccttcaagacctcaaacaaagggtggcatgcgaactggttttatgttcagaatcctgagcctgctcttcccgagtattcttgtcttcctccggtgtaccaagatacttggaactctcttccaatcggagatgaagctgcccaagctttggaattgttggatcgcatgttaaaactcaaagaacaaggcttgcaaggagagcagatcactcggcatttcatcaaatgccgactggcgccaattaaagaaagatcccgtacagcttttgagtttgacggcaagcatgatcctaatcgcgaagaaccagactctctggatttcaaaatcatgaaggagagaatgtataaaatc

SEQ ID NO: 28690 - DNA, 355 bp, Oryza sativa
ctgcggctgatgtgcgaggagaagctgcacgagggcatcgacgtggacaacgccgccgacgtcctcgccatggcggagctccaccattgctcgcagctcagagacgcctgcgtcgcgttcattgcctcgccgagcacgctgggtcccgtcctggcgtcgagcggcttcgaggatctcatcatggcgaccggcgcttcggtgaccaaggagattttgcacaaggtgtccgaatcgtggagcggtcctggtaacagaaataattcaagcaaaagaaagtgagaaaaatggcaattatattgaatacgactgaactactctattcgttagtatttttagtttccccagcaaagattat

SEQ ID NO: 28691 - DNA, 661 bp, Oryza sativa
tattaagtgctaaatcgtattttagttgataatattaaaaaaaaatctccatacaatttcaagaaacgaaggctgcagcttgggataatcaaattacataaagggaatccaggcacggagaaaatgagtacaacattgtatcggtctttagctctgttttctttagatagtgtttcgcttggagagcgagcaaagaaaagaacgaaaatatgatccgcagaaaggctgaagacagcattggcacccaaatacaagctcaatgcttcatgtgctcacaaaatcaataacctttttttaaccttctgttgcatctacaaatccccaaatcaagcatgtatatcacgcacacaccaatctatacaacaatcagcacagcgcgtatgcacaaaactacacccattgtcaccgtgtgtgcgttaactaaccgtgaacttagctcatcttcttcttcccggtgttcacaggctcgagcggcttctgcgagtccgggaggctgtcggcgtacagcgagtgcaccatcttcacatactcgtcgatcctcttcttcacccacccgtccgtttcgatcggcggcagcaccttcacggtgagcggcgccgggctgacccgcaagctgtttttcttcacgccaggtgcgtgccggtcaccaccatcgcacgat

SEQ ID NO: 28692 - DNA, 606 bp, Oryza sativa
cgcggcggcgaagagggtgatgctcttcgcgccgccgccgccgagcccggacctgcccgtcgaggtggccatggagttcctcggctcgccggacatggtggtcgccgctcactaggagggcggatcgtgatgtatttgctgcgatagacctgtagatttggggatctagctctcccttgtttcgatagttttgtggtttatgattttttttttccttgtttggttgtactgatatgtgaaaacaaagacaaaaaagaatacttatgctttgatttgctaaaaaaatacgaaagtgacagaaaagagttgcaatatgactggatgctcttactgtgatctattgaatgctctgtgaattgaagctattttgttcttgatttttctatgggtatagcatgttgtatttttcattgccgtgtgaaagtaaagaggagctggtattacttcagaaattgaaagctatttgtctacagtaagtaaatttgtttggcaactaccctcttatctgacataaatcttagtatgctttcttggttgtaactgctagtaaccaaaatcattagtcagagctgccttcgaattaactttggtcatgtttttctctta

SEQ ID NO: 28693 - DNA, 365 bp, Oryza sativa
cagtagaaccatagatttagtacacaactataaatcagttttccagttctaacataagttgctattggtagagtgtgaaacttaccaaatgagatagtggctcatcataggttaaacaaagctttacacgaccatggtattcgccatgcagtttactagctaagttggtaaagtcaccttgtatgcgatgatctggagctgagcctagtaaaaccacctatttaagaaagccaatgtgtttcagtattgaaaaatagaataacagatagatggcaagaaacatatgcatcaaacagtgtggcatctatgagcaagatatagacctgcccattgcgttcaagagttcgataaattgcatgtttgat

SEQ ID NO: 28694 - DNA, 583 bp, Oryza sativa
aatggttaaacatgtactaaaaagtcaacggtgtcaaacattttgaaacggaaggagtatgacacattctaatacatgaatctgtatagagagcccgtctagattcatagtgctaggatatgtcacatctcttatattatagaacggcgggaataagtcttactctcctattgtttcacatatcagtgtctctaatgatattgttattatgggaaaggacccgatatgatcaacgacgttcgctcgttcttcaccgacgcagtttttgtcagccatccatttttttcgacggggacggcggaacgacgccgacaagtcatcagtcatctagttgcagcgtgcaaacgacgtacgcccgccgggctgaactgaaactccggcccgcttacgcaagggttagttgacctgggatgaactggctccatcatccatgcatattcgcgattccgtagcggagttggtcggatgaattgcgtgtatattcagacgattcacgcacaggatgatggaggtgtttcgcccaacgctctcgtaggtcaagtccgttgggagcttttccatttgcgtaacgacagtgaaactg

SEQ ID NO: 28695 - DNA, 615 bp, Oryza sativa
tcctacacagatgcacaacaaataattttccatgtttatggcatgtgactagtcaaagtcctaacatactagcagccacctagcaaagcaaaacatttctagtatgatctccctatagtcaaacaaagcccttggagccactgacagtgggctccacttcacaaatacaaactccctggattaaataagcaccaccttaaatacgtgtccatcaacaatcaaaaccaaccaacacgctgttcaactccagaacctcactaagtttctggcaaggtctaatcttaaaataaattttcttaatgggtcaatttatcaaaattgctgccagaaccttctctattagctctccacaaccacacaaagcttcgcgccacgacgctctctcgcctctctgctgctttagcgttcgcgcgcgcgcgctgcggctggctggctggaccaagctaatagctatggacaccgtcgtggcggccgcgacgacgggatcgagacggtggctgccgtgggcgcggcggcaggcggcggcgtacctggcggcggccggggaaggcgacaacgggtgggcggcgtgcgcggcgtcggcggtgcggatcgtggtgtgcttcgtgtccatga

SEQ ID NO: 28696 - DNA, 294 bp, Oryza sativa
ctgtccttgttgcagtagtgtctgaataaaattaaaggctgtaactctagctacccagtctgaacttgcactaagacccccagagagtgcatcgcttatagaagttggaccatctgtgtatcgcgacatgtcattagatgagatatggccatcatcaaaactgtgtctcgaacttgcagatgtccttgatgccacttgcttcctaagaggcctctggaagtgtggaacttggtgattgtgtaaatttctgtggctggcatccctataggtcatatcaagatagtgtctgtccat

SEQ ID NO: 28697 - DNA, 204 bp, Oryza sativa
tgttttggttaagatggctagaacgatgttggatgaatacaaaactcctagaaaattttgggctgaggcgattaacactgcttgctatatttcaaatcgagttttcttgcgttctaaacttggaaaaacttcttatgaactttgatttggttatcaacccaaagtttcacatttgcgtgtttttggttgcaaatgctttgtctt

SEQ ID NO: 28698 - DNA, 677 bp, Oryza sativa
cgagcagggtactgaacatgtgaatccacaaccgttatctgctggggtacctattaaatcaggtcaacctgtattggcatcatgcaaggaagtcgctggagggaaaactgtcaatgagattcaaacagtctctgaatcttcaaagcacactgaagagtcatcaggtatgttcgttggaggaatgcaatttgatctactttgaataatatattacctctggatagaaataaagcttaaataatagatcacattttttgtgtcattataggggaaaggcatctgcttaatgttccagtaatggatgctataaaggaatctttgggtaagatttagatgttgtatgctcgattcatgtgtgtcacacacaagtagattcagttattttattttggggcatgacaaattcagcacgctcgttgtcaagatagcatctgtacaacactatatatgccccttctgccctcgatgacttattttctatcaagaacaatcactaaatggatttgtatctttaggtcccaaagagcagcctaatgctacaaatagcaagcaacaaacttttatgggaccaccgggtaatacataattccattatttgacatgcttagtattaaccctctatgttaatgctgtgatatgaatatttagaaagcacagaacaagctgtgcagctgaca

SEQ ID NO: 28699 - DNA, 668 bp, Oryza sativa
  unsure (1)..(668): unsure at all n locations
cttacatactttcgctctttgctactgtcttaggacaccctggcggtaagttgcggcggcatggtttggttaagaagagcctggatggagttgctaggatgatactggaggataaggagaagatgggcgacgtgtatctggagctgaacagtggtgagttccggaggcagaatgctgcgcttgatttgctggctgcaattgttaagcgtggtggaaggttggcgtcggagattgctaagagctttgatttcaagatggctgttttgccgcagctctcgggggtgcggaagaagagaggtggcagagatggggggaatcggaagaagggaactgatttcggatccacaaggcgatcgtttgttgggtttgccatgtcattcttggaggttgggaacccgaggatgctaagatggatccttcaacaaagggagctctattcaggggttcttcgtgggatcggagacgatgatactgataccattgtctatatcctctcaacgttgcggaataatgtcttggtagatgagtcacttgtcccaccagggcttcggagtgtccttttttgtagtgccacactggaacaactgagcttgatatcttggaatttggatgcgggggaggcagctgacattgctcatgaggtgttatcatggngggactgatccaaa

SEQ ID NO: 28700 - DNA, 642 bp, Oryza sativa
acttcagtcttcagatacacacaaagcctgaaatgaaccaaccgaccggaacaaattctactcctagaaagtagaaaccaatcaaaggaacggaacaaaacgcctcgaccacgcatggcctcatcttctaaagcggcatggcctctcagtggtagcaccaattaaatcagaacccggagaacacgaacaaggaggaggccaaaaccgacacagccgcacccaaacagctccagagacgcacctgcgcgaagccagtggcggccgtcgccgggcggacgacgagcaccggccggctccgggagcagagcgggctatgcgccatctccattgccagcgccaaaacctccctcctctccccctgatcccctcctcctccctccctctccctctccctcctcagagctgactcccttcccttctttttcttttctggtttccaaaaactcgcatcgaaatgcgcagctgtgtgctgtccggagacacacacacgcgcgcacgctcgatcgaaggagaaagaaaggctcccgtgctttcccgtgaaaatttcgcgatctttttcttttttattttctgcggcgagagggaggaattgtgcgggatttgtgtggacggtgtaaggtgcccaggtggttgggcccttaa

SEQ ID NO: 28701 - DNA, 664 bp, Oryza sativa
  unsure (1)..(664): unsure at all n locations
agtatgcctcactttttagattagcagatgaacaaccacatgcttatgccaaagattgaaaatagtgtctgaaagattcaatttcagtatgtatgtgccactgacatacatactaacaaggttcactgtcactgattaattactgcatgacctataacagattcaccatgctttggaacttcatcatcgtcgaactcttcgtgcactatatcaaccgccgaagaaataaattcttcgtcaccatccgatgaaaactcatccaatagcatttgaaggagggtgcttcgacgactcatctcctctttttgtttgccacggggttggagcgtttaccacagggatgaagtgcaatggagggaactgatggcaggaatagaacaataatcaatctgcaaaattaattatcagatcaaacttaatattttccaataatatatatccacatatcaaaatatagacatagagattgactacgacacaagagatcaatgggaattgctaacgattaccctcttgatgacacgaattgctacggcatcttcttggtgtttccgtttttaacaaatcgcagcagtcaggacactggttgacttgcttgtgatgaccgcgctaagtcacggccgcgcaagtcccgggaggaagaagtcnatcggcgcttgtgcgg

SEQ ID NO: 28702 - DNA, 513 bp, Oryza sativa
tgtttttgaatcagtcaaccttctgtgcgatgtaattgaagtaatcaatgacatagtatcaaatgctagggtaaagtcagaacacgataattcaacaaaagtgacagtcaaaatagacggttttccaagattaagctgttctacttcagcagatgcatccattgtacatgaggttctacatggagacaaaatgcacgtcgataggtggataactctgagagaatatattcaagatgtagttcgtggagctatacctgatccgcaggttcttctcaagctactctcttctgctagtcagaagcatcaaaattattctcagaggtaacaaaagaaacatgcacagcttgagcctcctcgaaaggaaaggagacgtggagccacagatgaggatgctgatattattattggcgggattgatgttgagttgtctagggatgagcctgaagagcaagagatgggacttggcaaatgatcatactactattctgtgtgagatatggggtctaaataagc

SEQ ID NO: 28703 - DNA, 670 bp, Oryza sativa
  unsure (1)..(670): unsure at all n locations
tgccacaaacccaatgcaagcctgtctcagctgcgagcagtgatgttgttctgctaaaacaagagtggttgccactgtttccacatcaatggtttcgctgagccgcctctcacaaatcagcctcagcctgtccactccgtaccgatccgcggcaactagcaagtgctgcattgctgcagccttgccatctctgcagctatctggcagcctatctgtgtaaatgaagtgaagaagagcctcaaaaacctcaggctccatgtcgtcgatcttgatacattgcgtgccattttctttcatcggaccgaaaagctcggccttgaacaccggggaccggaaggcaagaacacatttatgagcacggaactcttggccacccacggtgaatgtcacatctgaaccttcaccatcctggagcatgttctcaaaatcggtatgcaggttggacggtgggacaacaacagaattgacctcaacatccttggtgtgggattccctgacgacggtcagcaagcacctgatggtcaggcagtcgttgtggaggaacggcgagctctgcagcttcgatttctcggcgaatttgatgaatccccaattgtcactcgccggggagaaggtgtgcttcatgtangaatnggtcacctgcgacaatttgccgtccttgccgagcaga

SEQ ID NO: 28704 - DNA, 1235 bp, Oryza sativa
ttctggctcatcatttaacaaaagactctggccttctgttggggttatcctctgtaatctcatctcatgtcgaagggctggacagtgtaaaaaactcctattcttctacagtaattgggtcagcgttggaggtaaacactgttttacattactttctataacacttttatagatgagattcttgactgtacgagttggttattgtattttctgcatgtatcactgcagtcaaacatatgccttgagattggtgtaaaatcttcaaaattcaaaccaaaccacccatgttccctatccattcattctatcgtgttacctttgcacagatattgaagcactataactgggcaggacagtgcatgtacccacatatatacacttggagaaccatttctctaggatttgtcatattttttcatgaatcttgattgtaggttgtagcccatcatttctttcatgggatctctgctggtgaccatgaggatcatttcaactaactactttgtgggactgattcttgccgttgcttgatattactagaactgactgatttattaatgttgattttgttccttaagtcaaattcactctgcagtgatatttgctgtttccttgtgtcaatactttaaaagtatatataattattgcagctgtcctagtttagtttataacattaattggtgcatgcagttctaaatatatgtttctcactcattagtaatgctgtttctttagacaagttaagtaggttgcaactcacactcctgataatgccagtcagttgtttctgtcaagcaactactactgaaacatgagtcactaaatcatatctttagaaaacagtcaatgaacccataggattgatacaaacacactattttagcccgttgtcacctgcataccattaaccatcacagattataacatttgtttttctatgagaacgacattgttcaatggtctagtattattttatgatttggagagtttttttagcaatgttttgcacatcattttctttacgatagtattgtgaatctgctttttaatctatacatatgattttatgtcctctctccaggtagtgaatgatttgacatcatcaagattaattgcagaatggctccaagaaaccgcccttgagcaactctcaagaatatctaaatacctttatgtccttgttgaagatatgaaattgttgaaaggaaatgttccattgctaacttcagtgctaa

SEQ ID NO: 28705 - DNA, 377 bp, Oryza sativa
gcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttaca

SEQ ID NO: 28706 - DNA, 672 bp, Oryza sativa
acaatgtgtgacagtctattagatgcttcaactcctaagccctctctttcaaaacctttggccttgtaacacggcaagaaagccaaccatgcatcaatctctgcaatgttctgatcaaaagcgccagaactcgccacagcagctttaactaaaatatatgctttatcacggatgctcttaacttgcgaatgcaacataatgtcaatcagaggttgcaaatacttgtacatagattctggaactttttctgggcaccaatatccatcagattgacctgaatactcaactaaaagagataaaagggactgctgttcatccatggacagatccaaaggattaggcggcataaccttgaagaagtcaaatgatccatcaaaagagctaggcattaccctctgaaaagaaattgaagttaaaagttagaataccaaaagagtagattgtgaacgaaacttaatatatgcatttgaatatcaaaacattaaaatcataaattgtgaaggaacattatcgatttccttttgctagtcacagaaaacaaaaggagacagagcaggaatggagggattaattaattcgagcaatgaaataagccaatatagatgaagtggagggaatttaactgtcctaccagatagaacctgagaacatcaagcaacttgagtggaaaca

SEQ ID NO: 28707 - DNA, 441 bp, Oryza sativa
tgctgaacaaactagaactcttttggtcagaaatactcctcaagatatgcaacaaatacatcagtggcctccattcagcaaaacaaatcctagaatttatttcctctgatgaaaatttaccgagtctctcatttaggatggtgcctacaagatcaggcaataaaagcacatctacctgtttatgatcattggatcagtgaaagaagagtagaagaccatgcaagacaggcaaataggcgagagaggacataaatgcaatacctgtgactgcataataaggtagactgtgttgcacacatataatgaaattgtagacttctcatgtaatttcacacttgcagactccgagtctagtagcctaagacatttctggagaacacaaacaatcaaaggactgaaagatggagaatagcctacaaatcacaagaaaagtttgagcat

SEQ ID NO: 28708 - DNA, 467 bp, Oryza sativa
ctcccattttgtgtcgacaataacctgcagtggagtttccgagtgcccatctgcttgtaatcccactgggggcctgcttcagccagcaccaagtattttaaaatcagttgattctgcttttgcaaaagaaaacaagttccaagactgcattccagaaaggaagaaagtagaaatcatcaggttactcagggtactgtatgatattaagagtaggcaacataacagtagcctattggatgaatcaagggagcttggtttcttgcttttatctgtttatggtgcaactcttagtgaaacagatctagagatacttcaccttatgaatgagatagagtcatctgagtgcaaagccattactgatgtggatcatctttggggaaaggcagctgtgaaatttagagaagaactgaagctagaattttcagcatctgatacgcacaaaatggaaaatgcggaaattagtgata

SEQ ID NO: 28709 - DNA, 669 bp, Oryza sativa
acatttgcaaagcctctacagatgaggaagcctgttgagaaatctgtcgctaagtgagagaacctgaacttctgtagaaattctgaagtctggagaagttcaaagaaggcaaaggctagtttagattaagggaacagaacctgcggttgtgatttctctgtactgctccatatggcattggacggttggaattgattgatgtaatcactggtgctgtaatctcttttcttaaatactgaggtgtcagcatttatgtctgaggctttgacgaatcggttgccggatctggagctggatgcactagttgcatttacaagtgtgtatggcaccttgtagaagctttgtagaactgtacttaaaggtaactccatattttgtgaactatgatgttcagtgttcgctccacatgatttgtgttcgctccacatgatgttgcggttgaaaaaaatttcacatgatgtttgtgttcgcttcacatgatgttgcgatggaagaaaatttagtttagtggtcgctccacatgatatgttgcggttgaagaaaatttgtgttcgctcacataatggtgcgggtgaagaaaaattagttgatgttgtgtccgctcacatagttgatggtgtgttcgcttcacatgatgtgcggttgaagaaaatttagttaggtagctcc

SEQ ID NO: 28710 - DNA, 650 bp, Oryza sativa
agaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttaaggtggtcaagtcaacaaattatgtgtatgaagtgaggtgcatgaaggaagattgtccgtggcgtgtccatgcatataaaggtaaatggaatgattattggaaagttagcattgtgaccgagcacaagtgctacttacaaggggtggagaagtatcaccgaaacatcactttagcttttggggcaagtgagatgtacagcaatgtttgtggtaacaattgctttgaaccaaaatcaattattagg

SEQ ID NO: 28711 - DNA, 563 bp, Oryza sativa
aataagaaacggaaatgcctagaaagataagtaagcacaaaaattcaagaaagtagggtcagtggttccctcacctcgcatgaatctctcctcgtcggtgaaatcctcgatctcatcctcaaagctcccaatatcccccaagacggccttcgagctcaccaccggagaagcctccatcgtagccggcgctggtgtcctatgaggaggtggtgttggcgcttgagatggcggcgcggggcctctccgcagccgcttgaatcgattcatctctggcggcggcggcgccgggtcggggacaacagtttcgtgccgccgttgctgttgctgttggccgtcggcgaggacgaagtcgtcgtcctcctcctcgacagtcccgagctcgtgacggctgccgccgatgagaacatcgtcttcgtcgtcatcgaacccgagggagaaggagggtgcatcgggcgcctcgtagcgcggagcttggcggcttgcgttggggaggcggggttcgtcgtcgccgtcgccgaagtcgatgccgagggagaaagaggcgcgtcgggcgcctcgtaacg

SEQ ID NO: 28712 - DNA, 757 bp, Oryza sativa
tggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgctcgcaccatcctaactccaaccacgtggccaaagattgtttcgtctacaagcaattcgcggatcaatacaccaagactgcacggaagaattctgacgaagaacaaagcacgtcgaggaagaaggacgacggcgacaccccggcaggttttcaagatcaccgcaaggagctcaatcatatcttcggcggccccctggcttatgagtctaaacggaagcagaagttgactgaacgggagatcaatgctgttcagcccgacacgccccaatatcttcgatggtcagagatcgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccctggatgatatgcagatccctcactccgagttaaaaccaagcaatgcgccttttcacggagtgattccaggattatccgcaactccactcggccagatcaccctcccagtcacttttggcactcggaaaaactttcgcacagagaacatcagctttgaag

SEQ ID NO: 28713 - DNA, 476 bp, Oryza sativa
tttgtttacatgcggttcatgtataaatttggatccaaaaaaatgattcctttcacttcagtcgttactaatgtgttttttatttcactggcaacccctacattttaatcctgtgtgcgtcggttaccattcctagtgaccaaatccattggaaacagtaattgccaaaaacgagcattggaggaggaatttccacgaagccctagtcatatctaatgtttatataataaataacagtgaatatccatgaagcaatgaaaatgaaatttgtcagatgcatacgaggcaaaaggaacataaatacctttctggctataaatgttctatagcaactattactagcatcaacatgtaataaattaaactgggttatattcttggattacaaatgcagaaaccaacttattacggcgttgagctcttgtagatctgtacacatgccctgagcacaaacactcaagctttgtaaaatatgt

SEQ ID NO: 28714 - DNA, 420 bp, Oryza sativa
ccgttttcggtttggaatagatatgttatgcgtggtacacatacatagcagaaaaatctaaaatcgggcatatactagttcactccaacacagttcatgtcacacagggacgaactgaatcttacaatctagaatggctaagaaaaaaaacactgaaatagacgcgtaataataccatagctgtagctcgcgagcttgcttcttctcccaactcaagggaggcggccgcggtggaggaggccgagggtgtggcgcgcggcgtcgaccaggtcgcggatgttgtggagcgacctctcctccgcgccgaagacgaagatggcgcggcactcccgctttttcgccagccgcgccgcgtgccccagcggcagcttcggcgagttcagcgcccgcaggatccgcctgtacagcgacagcgccacc

SEQ ID NO: 28715 - DNA, 699 bp, Oryza sativa
ttgatggacacaggaagccgaagagcattcattgcactcaagtgctacctatcaaatccacctgtacttgttgccccccaacctaatgaagaattatttctctatattgccgccacgccatatttcgttagcactgtcattgttgtcgagagagagaaggtgcaacgaccagtctactatgtcagcgaagctctccacgacgcaaagacaagatatccatagatccaaaaactgctttgcgcggtaatcatgacatcaagaaagctatgccactactttcaagcccacagggtcacagttgtatcctccttccctctcggtgaagtagtgagaaacaaagacgttgtcggccgcattgcgaaatgggtagtcgagctaagccagtttgatgcccgctttgcgccacgaacactcatcaagtcccaggtacttgccgacttcgtagccgattggactatgcctgataacaggtcagacaaccaaatcgacaacgaaacgtggacaatggcgtccgacggcgcactcaacagccaaggagcaggggcaggatccatcttgacatcacctttgggagatcaatccaagcatgcaatccacctcaactttacggcgaccaataacatagccgagtacgaaagactactcgccaggataagaccgcagctgcactcgactgatcgcgataaggggactctgaac

SEQ ID NO: 28716 - DNA, 6829 bp, Oryza sativa
tctcaaaacagctaaagactgccaacacctttttggggctggctttctgctttctcgaacaaaaccaaaaacttgattgtaactggtattgctgctgtaatctgggctgtctagaaaactagaaataaagcttgttttgataaaaaaaattgcctaatgatcccactgatgtagttttcctggtttgccactggatggaatcctaggctcttttgcagaagcgggaggcagatcaaagaaagctgctcttgggggccaagctcataaggcaaattgcaagtgatgtgtacaattctaggtttggatggaggccgacggggagactgcagtgttgatcttttggcgggggtagagtatgctttgttgattgtgtggatgctgggttcatggctcctgttagtcctggaagtcttgttatgcagttgttgattctgtgccttctggatagtccatgtatggtcaaagcagccggtgtgctggcttctgtcctttcttttctgttcttcagtttgtaagactttgatcttgtaatctctttcatttctagtaatggaaatgggggcgtaatgcccttggtcaaaaaaaaaactcaactaaagattaattatctctaattggatttatagtttaattgattaaaacataccgctcgtaatggtaccatccacgattgaaatataccgcttatagtttaattatatcaatagtctttcatgtgggaataaaaaaataaagactattgaaagaagagaccatctagaacacaacacgagattaattaaaattcagaaaaaaaaatccaaaaatataaaaataattgtaggagttaaagtatgaatacaatttataaataacaaaatattgaaatgaaaaatatattttttttaaaaaaaatagtccatctagaacacaacgatgacaagtgacataaagaggagagaagcaacaaacctgtaagaagtagtgttgtgggggttgatgggacctctaaaaactataagcaaaactattgacagtcattaagtaccaaatgcgatagtcaactatgataataaataaagagagaactagcatttcttacatgtattccaataataaatagtgtagtactactatgcttgaagaattaacatgaatgcagagaataaacacacttctggctaatcacgtgcgagcacacggattgagtcacccacaagtcagctcaaactgactcaaagtggggccaaaccaccgggaaccgaccaagaggcccacttgtcaaccacacaccaaaggaggtggctaatggcggttactctggttcagctgaaccagccttggagcgcccaacactcccttccacttggcaactcctcattcactcctgatggcagttatgcttgattcccggcccacaactgccttaagcaaccaccatttaaagctataaatagtgataaggacataactagcttggatatgtccatgactaacttgtgtatttatcaaccaaaggtacatatgttttatattagatttacttattactccgtatatatttgaataaacgttactacaccatgagttttgtatcttctcgtttgcagatctacttgcgtggatgatggaacagagaccgggcgtaaggaatgcatggatgatcaaaaaagttgattgggaccaaaccaagaccttctcctagtctacttttacctaaccacgtcacgtttggtccaaagaagataagagataaagttctacacgttttggattcggattcgggccttctgacagcattaacttcaaacagacctagccgctcgtataaaaggaatttcggggcccatgagtacttgttggaaagcttatggagtatactttcagatggttttggtcatacattaaaattcccaccgagttgtcggaaatctgcaaaacaagcctcataccttatccagtccaaatctgatttgggttttagaccttgtaattatgtcgtcgcttagaccaaaggggcgtgcgccattgggcaaccctaggacgtccctaattatatatatttagtagtcgtcatcgtttagagtcgagttttgcttagattatttctgccattgcagtttcgccgctaggtcggtttgtggaaccctaaatttgagtgcttaatcattcgtatgcaattgtgttgcaatctatcttattcttgcttgtgttcttcgattcgcatgcagggattagccttctcggcgtggtcaaccggacgatgcacggttgataaccagaggagacgtggtgctgcgatttgcatggttcggatcgtgttgatcggaagccggattgtgtgtgtcaagtttccgccaaatcgagagttatcaatacctatcgaaagatcgagacctagcatcctcatcatagaggagatcttttcacttcccaacacacacctcaaggagcaattctctctatctatattgtgttctctacagttttagtagaaataggcttggagtatctccggtcctatagtcttcttagagattccgatgtgtgtttagttctttactattttggtaagactatatttgaattaaggaacaattgcttacttgaccctagtttgaagcccaactactaaattgaccctattttttcaagtttgctcatttgaccccattttttaaaactgaacatcagagctgaccctattccgtgaagaccaaataacagtgttaactgtgaagcaattatcatttttgcccttgctcatttaccaatgttatatcaaagatttttttttctttcattcagtcctttttaatatttgtagttcatctcattgtcattggagctcaggacagtgttcagctgctcgctctccaacaccgggcaggagaactcggccgtcgagatgacgatggtggcgccagtggctgcctgttgctgttgacctgttgctgccgtcgatctgcaggccggggatgagaggctgtgccatgggcatgtgctctgttggctggatgaccatccggccaccgccgacgtcaatggcattggagttcgccggaactgacagaagagagagagcacaatcggattcgagcacttgtgtcagcccgcgcgcagtcgccgccacccctcagcgcgctggcgccggcgccactgccaatcgccgtccctctctccctccgcacggcagcaaccgctgccgctactccgtgcgcccgcgccgaccgccttcgctcgctggcgccgctcctcctccctccacacggcagcagcccgtgccgccactcctccgcctgcaggcgccgccggttctcctgcctccgcgtgccgacgccgcccctccctccgcgcggcagcagccgacgccgctgctcctccacacacaggcgccgcctcccctctgcgcgccagcgctggcagtcctcctccctgcgcggaccgccgcccctccctggctccctccctccgcttggcagcagtcgctgctgctactccaagcgcgcgcgcccatcgccgtccctcccttcgctcgctgacgccgccgcccgccgctcctccttcctccatgcgcccagccgtgccaccgagatgtgtgggtgaagactcttgatttgtaacttggataaggttattatttataatcaggggtatattggtcagttcatactagcaattttattttttttcattttgctaactaagacactaacggactattaaaaagaggctcagatggtggctttgattttaaaaagcggggtcaaatgagcaaagttaaaaaaaaaggggcaattgtatccatgcccccacttttaaaaccaattgctgttttaccccatattttagagtttgtatttttacccccactttttgaatctgaagcagctgtgtaccctcatttctaaccgccacaactaacggtgtcagttgtagagaaaaagacatatatacccttggtggttattgtagttttgcctccattttttttagctttgtgtgattttgccctcattttttttcagcttgtgtgagtgttataatgtgaggctttgaacggcctatgcattcactctgaaccctctaaactacacatcaacgccacatttagttgtacatggataatacaacagagttgtgaattgttccaaaaaaaaatacaacagcccatgtaccctagatttttttgttaattgttgatcgctctgtgtccagttcttcattgcatagagcaacaaaccgcaattaacgaagcagaatgtaagcaggaaataacagaacggaggagcatcatgcatttctatagctccatctctgacgacaaatgcagatagcaaccgcaaaatgagagctgcagatcgatggatcgatctctcctttatcattgtcgcatcacttgacgactttgatccactcagtgcaccctgcatgcgaatgcacaacacataggcaaattaacaaaagctgcagctaataacacagatcaaaaccgttattgatggcaaatgaattacctggagcagtcggtggaagggctgatggcgtaggggatgttgacgccgcacttggaggggatgccggcgacgaggtcgggcctcaggccgcccatgccgctcgtctgctgcttgatgcaggcgcaggtggtctggtggtcggcggcggcggagttgagggtcctgaccccgtcgcagcagccgccggtgggggcggacaccctccccgtcgcgtacatgatgcacggcgcaagcatgcggccaacaactttcccttttctgccttgtcttgccctcggctgtgagaggccgcctccacgtggaagagcagcggctgccggctgtggacctcctgcgagcgggcgccggcgcacgcccgcgtggccgcggcctcctcgcgcggccgcagccgccgccgccgccgcctccgtgccgcgccgccgcccccgcgctagctagctaggatttcgacccgactcacggagacgcacgggaagaaccctatccattccctttccctcaggggtacaaatgtcattacataatttctaaaacctttttttattttgtttttatttctttaacacaaaatgtgggacccaccaaacagttgtcacaagtgggggtagaaggctacttcagatttaaaaagtgggggtaaaaatgcaaaccctaaaagtgggggcaaaacagcaattggctttcaaagtaggggcacagatgcaattgccccttaaaaaaaatagggtcaatttaatagttgggcaaaatttaactatttgccattcttgtgacatggcaattaacgatttaccatactctatcaattacatgtgggctctcatgtgtatatgacatgtgggcctagtggcaaatcgttaagcaacatttgtaagagtggcaaatagttaaaagctccttagggtcaaatagcatttgccccttgaattaatggaattatcttattatttatttatttatttatgctcatagtatgtgtattcatttattggatatgtgttctatgagtagtatatatttcgcatatctcctacagcctaggctagtcgatccatgtaacaattgttcatttagaactaactgaaattcaaaattaaaaaaataagaaaacaaagagtagagcttagagtccacgtagaaatactatttagaaatatctaaaatcaaaatttttaaaaaaggatattggaagaagatgctagaaaccttatagtaatactcctgcaataaaggaattagaaaaggaatactgtaagaagagtctatagtccatatagggatacaatttagaaataacgaaaatttagaattaaaacataacgaatattaaaaaaaattctagattccatataggaatataatttataaataaatgaaactagaaataaaaaaaagagaaatattaaaagaagagtgtagtccatatagcaatacaaataacggaaattcaaattttttttaaaaggagtgttgaaagagaagtctagagtttatatagaaatacaatttttaaataactgaaatttgaaatttaaaaataagaaatatggaaagaagggtttagagaccatataggaacaaaatttataaataaagaaaatttgaaattataaaaataagaactgttgaaagataagtaatttagagtccatacagaaatataataaaaaataattaaaattagaaatcaaaaaataattattaattatcgcctatatacaatacactataaatatcacgtatcgaatagtttggccaggccagaacagtaattgaaaattatgttgtcattttaatatattttaataatacaaaaataaaaatatatatgctattatgtgagaaaaaatataatgattctagccgcgcaatatacaagaccataatgctacttgaaataaaaaagaaacagatagagcattaattttgtttgcgagcttcattgacaagcataacctttgcctagtggtgtgtttggatggagggatataggtggataggacatggcggcccattttttgtgggtgtttggttcctgggcaggggtgggatggagcggcccggggaggaatattccccccagatgccggatgaggggatccggccgaattggccggatgcagccgcccgagcgcggggcgagcgaccaaggcagtcgcatcactcctctccaagaaagagcgacggcgagggcggcgaccagcgggagctcggcggcggctgttgcgagcggcggcggcggctggtgcgagtggcggtggcggcgccagatgcgcgctcggccgcggcgccggatgcgagctcgttcggcggcggcggcgggaggcgcgctc

SEQ ID NO: 28717 - DNA, 31930 bp, Oryza sativa
gggtatactcaccctctctacagtgagaggtgaccacatctgctcatccacctactccgcccaactaaacaaaaaaattggatcaccaaatccaccttcatcactacaaccaaacagttttatcgatattcacctaaccaaacaaaaaactggatcgccatatccaacaaaatatggatcgccatatcccattcaaccttgaccgtgaaccaaacttattggccatttggtggtggcctggtggagacgtacatggtcgcgcacacgcacgtacgactcgaactgttaggggacaaattgcaagacacccatatctacgccaaccacagagtcatccaagagtataatgtaaaggcgacggtagtgaggagctagcttgaaaagcagataccagcagcatccagtgagattgtgaatctatcgcccgtacgccatttctacttttccatgggtgtccctactaatgaactctggaaggggtgtccatgattgaaacctaccaaatagcactgtaatggagattaaattcaaacctctctcgtgcacggtaggtgcagtctgcatttcagtctgctgttttatcaagagcacatctttcttgtcaagttaattcccattatacgcccctgactagctgtaggcgctgtagctagtcgagatatgccaatcatcatcaagttttatcaagaaggtcacatcaggcagtgcgcgcctgaggtgagcaatggtgttctccttcatttgatcaaaaccattcgaggaacaaatcaatcaattggtctccgcattatatacatacgcgcgtacgtacactaagctagatagctagctaaaagcagcaaattttgctgcatgaaccggcaagaattcgtgaaagaatcccacgagcaagaagcccggaacccccaccggccaccgggcagctgaagcagagtctacccgcccggtgattgatcggtttccggccggaactcccatgtttgcatttccggtctacactacacaaccaagctccaaccaatgccagccgtactgccactgcgtgtgcgtgcatctctggtgccccggccgagcgaccgggcagctgctgcagcaccgtgcgccggaagcggcagccaccaacgacgacggccgggtaagtggtcgatcgcctcatcgattgaacggtcactcaggcagtcagggcggcgaggagggcttcaaagtcggcctcgtggcagggaagcgtgatggcggcgtcgtgctcgaagccgaactcctcctcggccttccgaagcagcagcaggaagtccgggtgctccaggcaggcgatgggcaccacgtaccggcaccggctctcgccgacgtacaccgggaagtggcccctcggcaccgcgccctgctgctgctgcctcctcccaaggctcgagcacctcctcaggatctgcttcaggttggccgccggcgcgatcttcttcgccatcacagctaccaaattccactggatcaatcagctagtgtatttctctctctctgtttctgttgctgctgcaaagcaatgcagtgaagctagagtgctcaggaggaagaagagcttggagagttcgtggtggagatggccggtgtgcagcgggcggtgtggctgggtatttatgggggaggtgagggaagaggaggaggtgcaagtgcacatggtagggccggcaagatgagggggcaggaccacgggggtgatggggtcgtgtgttttggtggaagagggaaaaaaaacaagttaagcttggatgccatctcaaaacctagggtagctgtacgttcttccagacaagctggggcctcctcatctcttcatctctctctgccctccatctttttttttctctttagtgtctatgtccaggaaaagtttaaggagttcaccaaatagttactcaattgatgactccggatttgcttattaatacaagctatagcgctaggctactctagctccttgattgatacttcctctgttttacaatataagattttctagcgttgcccacattcattttgatgttaacatctatatgtatatgggcaatgctagaaagtcttacattgtgaaaatgatggagtataatagattccacataatggactgggctgggggtgaacaggtgcatatatcctcctgcggctatctagatggcgcaggtagtgtggctaacgtgatttgagcggttccgtccactttgacgttctgattgaaaccgatgtcgttgttccataaacagagaatgagaacaaatttatggacaccgctagtcatctttgtcaaaagaaaacatgttgtatgattctcggtttcttcatgttggttttagtttttatcatgcttgtgacagttgatcgctactgaaagtgaaacaaagtatgcaattactcccgatgactgctagtgctatataccctatatgcgcatccggactgatatcttcacaacttgatatagttgctaagagacgtacaacccgcatgatctaatgatcctgtagtgtttggggatcggatagactgtcagcccaggcgcaagatgcgaactaacataacacacttatcagtttcgacgcaagcattgagtgggagaaaatgttgtgccacagaatttccggtcatggcatgtgccgtgtccatgagttgcagagagagtctgcttttctctttccaaaagcgaaatggacaagatccccagtatatactacaaaatgatttgccttttgcattttcaaacaacctatatatggtttgcttaaagttcaaacaacgctcttcatcacataaatggaaatatatataagatgtaccagtagataggagtactaagcacaaaaaagttgactctgattaattatgaccgtcttttagaggatctcagttgattttggtcaaaccgcatttgctactctctgttttttttcaagcatgggcaagaacattgcacgccattgtcataaattaataagaaaatagttgcatcggtgccaagcacctagtctactgtaaatacatgtaccatgcattcatagatggatttgtcagttaattgacacatagatctacaaactgtcgatctgtacgcttggaatcaatttgctacgccagcagttggtcttgcaacttgtgtgctagtttcatttgcctggtcttgcattgctccaacttaattaattagaagactttgcctagctaaacctcagatttctatcacttaatcttggagactgagcccatgaatgcttaggttctttgattatcacctgaagagtcagtagtactgtttcgattggatacccctgcagatcgagaggtagctttcttataatctgaagagtcagtactgttagcaaagtcttcagttgttgtgtcctgctatacctagttacgtacaagtatacgtacaacacgtacacgcctgtagctcgttgcgagagagagagagagagagagagagagagagagagagagcttaggatttagaggtgcagatgcgggtacaagagagtggtactatcatgtgcggcctgggaaagttgctgtctgctgctgttgcatgtgactggcgttgaggaccctagcgcaagggccgccgattggtgatcgcccacagagtcacaggcgctctcgctgccattcatttccggtttcccgtttccgccggggtacattgtggctggctggcccatgcattgcatgcatgcatgcatgcgcggggcatggccatgtgttcctcccccaatcatcattggcactgccgcgctcggttacatttacatatttacacccggcgtttccaccaccatccacgcacgcaccaacgctcgctatctacctactgctagtgctaggtggtcacaaattggtaatgtcgcatgcattcagactaattcgttgcatgcatgtatgagtgagaaaaatatctcgatataattggaataggccgatccagtggttggaaggcccgggagcaaagactggaccaggtctctcggctacttgcctgcctagtggctgccggcctgtttcacgcgcatgcatgcagcccatgcattcatgccactccgtacatggttaacacagtacacttgtaagttgtatcacacccccgacatatgtaggtcctgcagatataagaaaaataagtttataggtcatgcaaatgcaataataagcgtaattgtaatgcattgtacgtggtggaaagtccccaaagacgcagctacgtaccgtctataaggtgggtctgtgggttcttgagcccccactatctgtgttgtaaccatgggagccctcataaagtccccactaaaattttttgtcatacatccattagaaaaaggactataatcttttgtatagtttgtttagaccctcctgttaatcctttctagatctggccctaatataaaccatctagttagttttttcttttataaaaaaacttctagttttctctcatgccagcagattcagcatgcatgacggcgttcatttattacgaggaattcaggttctagatgaagaacaaagaatgcgttcatggaggcttggggacctacttgatttccaagagcaatcctagacagagctggccttcggggaccccatcccaataaaatgtgaggcccatacccaacaccaatacaacgccaataggaataagtccatttgtcgtccctcatctctaacttgagtttacactataaaaaatcctaataggaaacatcctcgtaggtgctagtaaaaacatcactttgctcgcctttccaccatctcatatatatatatatatatacatatatatatatatatatacatacatatacatatacatatatacatatatacatatacatatatacatatagaaatcggcgcatataatcccttatgtcgattgtttattaaaaatactggcaccaataatatctaaaccagttttttaataagcgggcacctatgatatggttataggtgccttttttttttttagaaaacgaacacccctgagatagtcgagccgatgaccgatcgagctggcccgtttttttgtatggatgactcagccactagtgtctacccaatctatctcactcattgttagtatttcttaacgacattactagaaatataatttccagcaatggcgcaaaaatacatctggtatattatggctacagagttcatcagcaaacacacggatataccattgtagcatttcacccgagagtattccaagggtatcgtatttattttatcccgtggaaagatcatgtagagcgaactcaactaataatttatatattacttgtgataatcatattctaatcaggggttaagataatccaagggtagagtgacacaaaagcatttaactactcatcctcatcatatattatctaaactaagtggaaagaaaagagaaaagaagtctattcctatacttctaatatacatagttgttaacagtgaaatttggtaatcggcaaagacgtcatcggcttagaatcattatcggctgcaacatctcggaatcagcctatgggagttatcaagtcaccaatagtcggattcctgctatattcggttaaggaaatcaatctactaaaggaagcttatccctaagtgaccgagtttaaagaggatgcggcatgacagtttatctattaattaaaaatagtttgttagtttccttttatctttaggaaagtgagtttagtgtccgataaggactttattttttccttttatctttaggttagtttctttcttgtccgacaatgacttctatcaacccatgggtataaatatgtacacccggggtctatgtaatctaacgctacgatcaatacaattcggcgcatcgccaccctttttacttctacttttgctttttacgttccggcggaacttggcacccgacgcggggctgcatcgtcttcgatctccggcgaaggggtaaatctaatgttccgtcggcccaggcaattgtctcatctacatcggcgtcgttcaaggctgcatcagtacattcgacctcttggattgctctggtttggatgatatatttgcctacctatttatcatatttctctgttaatctaatcttagcatatcaatttagctctatcggctatatctcgctttagggtttctgccggtatcggctaaatcgcattgctagattagattagcataggcatctaccaccctgaaaatcagtcatcggcttgattgtctagatattatgtttcttttcatacttagtgctgcatcagttaagtttgatctactaagttgtgcttagaaccacaatctctagcctgcttattgattgccaataagggtttcatcggggtttcagccggtgagttatctgtacgttgcatcggctcatgaggattgcatatacatataagttggatttagccgatgacaacaaaggtttcactgtttaatccaatcttgtggatttcatgacatcggacctccagccgatgtgtgctttaacctttggatcgatgcttatttatcatatcattgctagccgattggtttatattggattatattgttattttattacatcatcatcagccgattgcctttatatcattatctacattggacatatagccgagtgcataaaccctatcgctatcggctggtatcgacatcggctattatcgactatcggctggaactactccatcggcttgtcagccgattggctgttttgatctactatttgcatatctttgtcagttgcaggatcaaactgactggcacgcccgcatctcatcatatttggacttgcactggagctaagcagatctcccaggccggtgtgttcgattttttcgtcaacaatagtatacatacattctagttaattgatatactagctaataccctctatccgatgccctcctggtacttcgagaagccacctctgactgccgagttccttacgacagcccgtcatgaccatccaaccagggctaaatacggaggaataccctccccaggaaattaacttaggattatatataggcgcggaggaatacctttactgagctgtcaccatcagcggcctacctctcatccgcaatatataaccccaaataatgatatcccgtaatctagacaccacgtctaaactaccagatactactctaatattatcgtcatgacatagagtaattgcataagcaaacactatacccgcaccaaagcatctcccagataagctagccgtacattcaatataacaagaacataatgtaaagtaggtactcatatactcggaaagtatttcaatatcataaatgtatatagaagagtattctaataaaagtacaaagcttacaaaagaggaaatgaaagctgctagagccatacgcgaactcttccggactcctgattcctattctatttctattccaccagctagatactactaaactaaacttgagaggaatgagagagctcttgcttaaggtgtgtgagtgaagtgagaatggcaacttcttttttatagccccccaatgatggttgtggcggcttggagtggtcggaaatgcccttcaactgtcattgggggctaatccacaccgtccaggtgaagccctggatcggatggcgctaaggagggtttggccgaaccccttggttcggccgaacctggggccggcccgatccagcccaatttcagctagcagcctctctgttgttcctcttcgtagacttgtgaattttggcccagtttgtcgtgtcaattctgagttcgtggcccattcatgcataagtctggttctcgacatcgcccttatatgatcttattcgattggtcgcttgatagtctgaattgctcactcacacgtcttattgagtcatctcctctagcaagaaggttagtaaagcctaatactagtggaatattattattctaacaaatatatgcattgcaagcatcactagttcactcctgttttagtaatattgacggtcgaaactgatcgataacgaccgtcaacaaaaccccccaagcttgaacctttgcttgtcccgagtgaaggacgaaaggaaacaaagacttggttgttgatcaggagttactactatgctgcatatctcaaagatacaggtgcaaggtatatgtattctctctcagattaaataatctttggcacggtggcttacccttacccctgattcccacgagacactgcttctccttgccttgggcggttgaaagacagaacaacaactagagcaccaatcacccgatctttattcaactcttattccggaagttttcaaatgattttggaaaagaaaaccaagttcctcaattgattcacttagtccctctaagtgtatcaatttgaattcctcaccaaatgatgcctttttgattcctactctaaggtttatatgtggagctcggtagagaccaaacatggcacgcttgcattcacatttattactaagtcaaaaacttagactaaagcagataactaaacatactcaaaatcaagatcgtgcataatgtgtgtggtatatagtggaaatggtatatgaggaaaaataaaagaaaaaatgcttctcctttgtgcttactttcttctcccaaaaatcttttttttattgattaggagagggcatggctacatttttttttcaacatcatgctcatgcttgatggagcataactttatttatttttttttcataaccatgcctttccctcttttttttcttcaaaaggatttttctttttaggagcagaaaacacatgaaagcatggagaatttatattggtggtaatatgaaaatggaatggaatatgcttagctcccagtgtaggagtttagcatgtgcatatatgtgggtgtatgatcttgattatagagcatgagaagtatcaacacaagtcacaagagtttgacaaagttcaatggaatgtcaagcaacaaaaatgcatactgtttaatcatgatagcacatttttgtctctggtaggaatttatatcaaatgagaaaatctcaatttatcattttgggaaaaaaaaacatccggaattcaagtcaaactagtatcagtatcatagctactcctagttactatctcatatcttgcaaccgcttagacttagatcagcaagtgcggcccatttacctcaggttcccggataattgttgcctacttatattcaatccttgagagagtatttaccaagaacccatatatcagagatataaaacagagcaactattcatcatttcaacaaagagaactagcttgtcttacctagcatgactcaaatctatcctatctttttggtattttctattttgtaaatttttatgttgttttcaaaattttataagatgcaattggaaagcaaatatgcaattggaaagctaatatgcaatgtgatacaagttacctcaatggggggagcatgtctccccccaagcttggttttcgctcagggtccttgataaggattgaacccttgataatgaaagtacgcctgaaggtcaccatgctgttgctgcatcatgttgttgatgttgacgaactgagcatcagcagattgtagccattcttgtgtttgagctatgtgttccgtgaggttgtactggatctcccccgtctgcacatcaagggtgtccattctcctagtgatttcacccaagtcccaacaagaggaactcgagtgccattcacttggagatggaggcacaccacttgatctggagggttgattgtccccccagtggatgccatgaggcgcatgccaccggtcctcactggcacttgcccaggttgagactccgatgctatggcgtggagcttgggtccatccgcgtgcatccccagttggtgcccaacctgcctcatacatctgcacgggtgtcaaggatgatgaactctctcgttcgttccttgtcatgttgcgcgtctccctgtatgttccacttccacgagattcttctatggtctgcaggggaatggttagtttatggaagttgtacaaatgatattcgcatttggcaacgagatttcatttgtacaaccggggaaaaagtatatcgaagttccatctgctccatgtttcaaaatatgcccttgcactagataagcctcatcaatacgcggacgagcggctgagataaaagcaatttggtcgctaacgacccctagcccttttgctatccgagtaatcagagaagtgcactcaacaggagcagagaattttatactttctaaccattgctttatcatacatttcacaggagaaattttgatttttctaaccatggcaaacatgataattaattcatctcccctaatgggtctcagatcacttctaggaaacaaagtcatagcaatccatttgtacatgagcctaagtgtaggattatggatgtcatttgttctaggtttcttgcaaattagagcacgagaaatatcttcccaaaacctatttttctcgaacccagaaattcctttctggagatcgattttacaggaatcgtgaaaaccaagaagtgtactcaaacctttccatgtgagcgtgaactccttacggaaaaagcgaaaagaaatgccatcttctatttcttcaaagtgcacagaaattgtaaagtaagcaaacgagaaccaggctcatctaccacagcaaatctctgccaaccaacagctttccaaatagagtgaaattcaacatccatacctatctttttcagcagctccggtgagtattctctcgtgtgagcatactcctggtcgctcagcatgtagtacgcttgtctctcccgataactgacaaggtcgaggtcagcgtcgtttaggagttgtcacggagcgtcggcgtcttccattgagacatcagctgatgaacgagtactagactcgccatgatgacttgatggagaactggaccccttgaatagacgagacaatcgcctcctcatactgcacaatggagcaagaatagtctaactcggcgggggttagaaatgacaagagtttcacccgccggttagtttcaccaaagcaacttgtatatatgcaactaaatttgtttttaatctgaaggaaactatcaaagcttgaatgatcttgagagcaaactttggagagggaatgaaaatgtgttgaaatggggtgaagtcccttctcctggccggttggcttaagtagtgcacccacaacggtcaaaatcgacgtatggggaccactagccgttaccctaccaaaagtggcagggagccgttgcctggccggttcagccgaaccagggtgttcggccgaacccctggtgggcccaattggccccactttcggccgttggattccaacggtcggtgtggtcgtggcacagtaaatttttgttgaaaattttaattttgtttgctcttaaaatttcatttgaagaatttcctcaaaattcaaaaatcctaaatgcaatgttgaaattcaaatatgtgatgatgcaaaaattcaaattgttgaaagcaaatatgcggatacataccaatttacctgttggcgaaggtcgcttcatttaaagtccaacgtgcaagacagtacctccttgtgttttagttcatggattttccacccgtctccggaggtggtggagcgggtgcctttggcttttccttccacaccttctttgatttcggtgcggaagacggtctcttctgagccggctgctctaatttcttggccagtacaggtgattttaccggcgtcctccaataacggttcctgggcattgttgtttccttttccaggaagttctgcataaatttcactagactgtccatcttgggtggcttcacttcgacctcttgaatattctgcgggttcggcccgtacttgattctgaccatggagcattgttccgtcctcggttgaaactcaaacttttcctccttcccgttgatatggaaatggatgctccttgttcccacatcaatgttggctcttgcggtgctaaggaacggacgccctaggatgagcggcgtctccttccccgtgtccatgtccagcaccacaaagtcaatcgggatgaagaaatcacgtatcttgactggcacatcctccgctatcccagccgggtaacggactaatgagtcagccagttggaggcgcattggtgttggtgccaacaccgtgaagttgagtttgtccaagacatattttggcatgacgctgacgctagctccaaaatcacataaggcctggtcgaattgttgtgccccgatcgagcaggtgatcgtgggacaccccagatctttcttcttttccgggagcttgtggagtatgatgttgctgcagtgttccgtcagcttaaccaccttcgttgttgggagcggtctcttgttgttgagtatgtccttgagataacgggcgtatgttggcacttgcattccatccaacaacggcacattaatgtgaatcttctggattacttcaacaaaacaagcgaactactcgtctaccgacggtttcctactccgttgagggaatggcagcagccgcgtgtcgcagtaatcctccggcacggtcttttctggctgaatctccttgtcagccgagtcattagatggcacttcttttgtcaccccattagttcctacagggttaggatacggtggatcacgagtggacttacctctcctcgtcgtgatcgccttgacattttcaatggaagagtcgggttgccctggaatcctcccagattgatttgcaaggactaaagatgccaactgagctaactgggtttctatcattttattgaagctcggctggttttgaaatgtggaagcgaagccatctaatttgacatttttgttctctaggatcttttcgttggctgcaagctttttacttagcgaatcagtagttttggcgtgtgcaaaaacaagatcctttaaggagggctggttagagaagttaccgttattgttacctccttgataatatgagcgtggttggttccacccctgacctccttgtggacggtacccgttgttgttgcccatgtacatcgcctcctcacgggtttccgggcaatcattcccagaatgacccgtgccgccgcagacttcacacgtgtgttaacaaccaaatttggtaatatctgcatcgggaaagaagattagatcgaagcaaagttggaggcggagatcgaaataggaaacagagcaggaattggctagagtccagatcggctacgattaggatcggctgggtttgagtcgggctaggtaagccgatgcaaccgattccgacaatgcaacttgatgtatgacatcgggttgaattgaggcgcttcaaggtgattgccgcacatggatagagtcctgagaaggcaattgtatctagtaattaggatgttttatgtaatttccttagagatatgattgggcaaaagtctgccgcaaagacttatggtatctttgagtttgttagagatagtagtcgtgtccgttttggacatatcttgtaattctcgggtataaatagacccgagccctatgtaacttttaacacacacgttcaatacaatctcggtgcatcgccacctttttgctttagttttattttgacgagttcttgctttcgggttgagctgcatcgatttcgatcttcaacaagaggtaaaacttgttatgatgaattatgttctcggaattagtgcttccatctttatggtactctaatcttgtctatgtaattcatcaagttatcatatatcttagataatcttcgacaatatcatgatctaacctacaatcggctaacatctgttaccagaaggcagttgatttggttaaatagtgacgttgacctagattatataagatatctaccactctatgaaacttccagtggcttgattgtctagatattgttcttcttttcatacctcatgctgcatcagttgagtttgatgtcttaagtcgtgcttagaatatcaatctctagcctgtactctggttgccgattagggtagtatcggagtttgagccgatcttatctgatttaaccatattcgatctatatgcttcaatgacatgttaaatccaccctttgtgtcaagataatgtcgcaatctaaatatattaagcttctgtttaatacattatacctgttttaatatcttgatatagagtagtatcggagtattagccgatacacgctagatctatctgatcggctatgctataaacatatataatcctgttattaatatatatttcgatctaagtgatttatactgtctcggcatggtgaccgatctatcccaatcacttgatttaagtatatattaatataagaactatatatcgttaatatctacagccgatcgaatagatttagttccttactatctgtttataaccgccgatcgattcgtatatgacatcggctcaaagataaatgatgtgtcatcggcacctagccgatcggctatcatttatagatttaactgtggtttctttgcttctatttcttgttgattacaggatcaaatcaactggcacgctcatacattcgaaggcgagctttggacctgcactggagttaagcagatctcccaggcttcgtgttttctgtcaacacgcttttggcacgcccggtgggacatttaagaagtcagccaacaattcgtcctcatggccgagaaacaaccaccaccaccatccccagctagcccagactctgttaaggaaaaggtgctgaaattagggttgtttgacgtcaatgaaggaaacgtcgtgccgatcgatccagaaagattcacacctgagcagagaaagagtttgaagcaatgttgcagcaagcacaggatcagttcttgaactcattcatgtagacccgaaaggggacacttgttcagaagtacaaaataaaagtggttgctgatgatccggggaccagttcttctaaggatggagatgggaaacaagctccagatggctcggctcagctgagtaacaaaagtgctaccgacagctctctaggaaatcaaggtgacaattctcaaggagtccatggagtgcaaggtgacggggtgcatggagttcaaggtgatggtgccgaggggttgcaaggaggaaatcttaatcagaatagtgatgcggcacaagattttttcagtaatttccaagatcgggttgactacactgtgcatcatgctttgatcaatcaatctggggtgttagttaataccttatcaaacatgatgaagtccatagccgatggttcaatagctgagcatcaggctgcaggcccggtttatttgcaaggaggtgtctttccaaattatcggtctttgattaacgatgttcagccatcaactcaggcggttccctccgttgcaccaacatctcagccgacggcactggcgtcaactcccctacctgttccatcagcaatggcgctaggccagccagtgaaccctcggttgttaataagagagcagccacagcatggcgggcaggttgtgaatcggctgacccaagatcaggttgctgccacgtttctgccacctcaatctattgttgatccaatacagcagcagccgattcagcagacgcccccaattcagcaggttgtgcaaccaatccagcaacaggtcatgcaaccagttcagcaaacaccaccaagacagcagcctctgcagccgattcagtagacgctgttaagacagcatatcgttcagccgatctagcaccaaggttcaataggcgcatcggccgggtttgcaacgcctggtggtcagcttgtacaacaattttcaaatcaagttgtcccataacacttggttcaccacatacagccggatggcacagtaatacctcaagttgttcctgagcgtttggtacgtaatacccagccgaaccttcataattaccaagggggtaacttgaattatcaatatcagtctccttccccgcaagcccaatatcagccagggggattggctcaacctcagtttgcgcctcaatacggtcagttcgagcccatgcagcaacagtcacaaggggtagctcagcaacaaccgtgggccgatgtgattgctgacataatgagggaacagtttgggcttaaaccaaaagagactggaagcttgtatcggcagccttactctgagtggtttgagagagttcctcttcccaatcggttcaaagttccggacttctccaaattttcgggacaagatggtgtgtcaacttatgagcacattagccgattcttagctcagtgtggtgaagcataggctgtagacgctctgaaggttaggttattctggttatctttgtctggatcggcttttacttggttttcctctttgccgtatgggtcgatcaatagctgggccgatttggagaagcaattccacacctatttctatagtggggttcatgagatgaaattatctgatttgacagcgattaagcagtggcatgatgaacctgtgcacgagtatattcagagattcagggagacgaggaacaaatgctttagcttgtgtttaactgatgcccagttagccgatctggcctttcagggtatgattgctccgattaggaagaaattctcgtctgaagactttgatagcttgtcacatctgatacagaaagtaaccttgcatgagcataggtctgcggaagttagtaaaaactctaagaaggttaatcatgtttgtccgtacatgtatgggtcggatgatgatgagaacaattctgaaatagctgcagccgagtgggtgaggagtaaaaaggtcataccatgccaatgggtaaaaagttctggaaaagaggagaagtatgactttgatattactaaagctgacaagatctttgattgctactccgagagaagcaaattcaacttcctgctggtcatacaatcccatcggctaaggaattaggcaaaaagaggtattgcaaatggcataattctgggtcccattctactaacgattgcaaggtttttagaaagcagattcaggtggccattgagggaggcaagattaggattgatgactccaaaaagccgatgaaggtcgatggtaacccttttcctgttaatatggtgcatacagctggccaaacagccgacaaggcccgtgcaaggggtttttaggtgaattcggctaagattatcaacaaatatcagaagaagtatgacaagcagcaggagaagcatcatgagaaatacgatgatggttttgatcctcattggggttgtgagttctttagattctgctggaatgaagggatgaggttgccatctattgaaaacagccgtgggtgcagtgatatcgtcgagagctcaagtcgatcatataataggggcaatcggctaaggcagacgagagtttccattcatcaaaggttgggtccagtaaatcaagatcatggccaaaaggaaaatgtaatcaggaagactcaatggtgtccttctggtattttcacgaagaatcagaagcgaagggttcaaagattgaggaacaaggagcgccttcaggaggttgaacaagaagttaatcatcggctgaagaaagcaaagccaaggcaagagtggcgtgttaagaatcaagttcctatagccgatgatgttgcagccgatgaggcaaagaggttggcaaaagggaagagtgttgtgacagcaccggttaacatggtctttaccctgccagccgaattcgggatcgatgaagccgatgtcgacgaggtggaagaggaatcggctaagttggttccatcaccagaacaggcagtgttcgagaaacccgagggggcagagaatcggcatcttaaaccattgtatataaacggctacgtcaataggaagccgatgtctaaaatgatggttgatggtggagctgcggtaaatttgatgccctatgctacgttcaggaagttgggtagaaatgccgaggatgtcatcaagacaaacatggtgctcaaagattttggtggcaatccattagaaaccaaaggtgttctaaatgtggagctgacagtcagcagtaagactattcctaccacattttttgtcatcgatgggaaaggttcttacagcttgtttcttggaagggattggattcacgccaattgttgcattccttcaactatgcatcaatgtttgattcagtggcaaggcgacaaaatagagatcgtgccagccgacaggtcagttaatgttgccagtgccgatttagctctttgggagatggattaccttgattgtttatctggaaaagtctgggatggagattttctaaaagtatccgattctgatatacagccaattgaacatggagaacccaagctattattttgagggcgtcgtggagggttcaaatgtctacactaaggacacggtagatgatctcgatgacaagtaaggtcaaggtttcatgtcggccgatgatttggaagaagtagacataggtccaggcgatcggccaaggccgatgatttattagtaagaacttatctccagagtttagaaccaagctgatagagctcttaaaagagtttagagattgcttcgcttgggagtattacgagatgcctggactcagccgatcgattgttgaacatcggctacctatcaaaccaggggttaggccacgtcaacagcctccgaggagatgcaaggccgacatgcttgaaccagtcatggctgagattaaaagattatatgatgctggttttattcgtccttgccgatatgctgagtgggtttctagtataattcctgttatcaagaaaaacggcaaggtcaggatatgcattgatttccgaaatttgaataaggccaccccgaaagatgaatacccaatgccagtagccgaccaactagttgatgctgcttcggggcataaaattttgtgttttatggatgggaacgcaggatacaatcaaatttttatggccgaataagacattcataagacagcttttaggtgtcctggtgcaatcggcttatttgtatgggttgtcatgactttcggcttgaagagtgctggagctacatatcaaagagccatgaattacatatatcatgatctaatcggctggttggttgaagtctacattgatgatgtggttatcaagtctaaagaactagaggaccatatagctgatttgaggaaggttttcgagagaaccagaaaatatggcctgaagatgaatccgacaaaatgtgcttttggtgtatcggctggccagtttttgggaattcttgttcatgagagggggatcgaggtaactcaaaggagtgttaatgcgatcaagaagattcagcctccggagaataagacagaattacaagagatgatcgacaagataaattttgttagaaggtttatttctaatttgtctggaaggttagaaccttttacaccattgttgagattgaaaaccgatcagcagtttatttggggggcagagcagcaaaagtctttggataatattaaggaatatcttagctctcctcctgttttgattcctccacagaaaggaataccgtttaggttatatttatcggccggtgagaagtcaattggctcagtcttgattcagaagttggaagggaaggaacgagttgtattctatctcagtcgtcggctcttggatgcagaaactagatattcccctgtggagaagttatgcttgtgtctgtatttttcgtgtacaaggttgaggcattatctactgtccaacgagtgtactgttatatgcaaggccgacgttgtcaagtacatgctatcggctccaatattgaaaggaagggttggaaagtggatattttccttaaccgagttgcggcgcgcccgtggggagaggccggatgggccgtggggagaggagagagagagagggggggggagagatgggccgggccagcccaagggagggaagggggactttttagggtttttctttttataaaaccttttaactttgtttatttcttaacaattattatttgtgctctgaaaattccactaaaatttatttacgtattttaggcttttaggaaatatacaaaaatcctctaagcattatttgacttttaactttgcacattttaatttttggaggctttcacacggattttaattattctaggcataatttagatgatatattttagggtcgttttgggacgtgacaaacctacccccctaaacggaatctcgaccccgagattcggaagaactggcgaagagatcgggatgggctgccttcagctcgtcttcacgctcccaagtagcttcttcctcagcgtggttgctccattggaccttgcaaaaacggattacccggttcctggtcctgcgctccatggcgtccaggattttcaccggtctctccacgtaggtcaagtcttcgcgaacttcaatttgctctgagtcggcctgctcggacggcattcgaaggcatttcttgagttgcgacacatggaacacatcatgcacgttgcccaatgatgcgggcagctccaactagtaagcgacttctccgcgttgagcaatgatacggaaaggacccatgaaccgaggtgcgagctttcctttcgtttgaaacctgtgtacgccccgcaatggcatgacccgaaggtacacaaagtcatccactgcgaattccaggtcacggcatcggttgtctgcataactcttctgccgagactgggccacctttagattctcccgaatggttctgactttcgcttcagcttctctcaggatatcagtcctgaacacttggctttccccaacttggtcccacaatagcggtgtccgacatttgcgtccatacaacgcttcgtagggtgccatttgtaggctggcttggtagctgttattgtaggagaactcggcataggggagactcttatcccaggtcttcccgaaatctagaacgcatgcgcgcagcatatcttcgaggatctggttcagacgctcggtctgcccatctgtctgcaggtgatacgcagtgctgaaatttaatcgggtacccaactcttcttggagcttcttccagaagtgagaggtgaattggcttcccctatcagatacaattttcttaggaacgccatggagactcacgatcctagcgaagtagagttcagctagtttgttccctccataggtggtcttcacaggaataaaccgggctaccttggttagtcgatccatgactacccatatagaatcatatccgccctgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgtttcatactaacccaccagtatttctcgttcaagtctaagtacatcttcgtactgccagggtggatggaataaggactttcgtgagcttcctgaagtatcagctgtttaagttccttgtcgtccggaacgcatacacgatttccgttccatagggtccatgttcatcttctgtgaaaccagcggctttaccttgtttcatattcttgaggatcccatgcatatctggatcattcttctgagcctcgcggatttgatcgagcaaggtaggcttggcttccagcatagccaaggatccacgactaactatgcttagattcagggcttccatctgttgattaagttccggtggaatgtcatggacgccaagagtgttgcaacggctttttcgacttagagcgtcggcgaccacgttggccttaccaggatgatagtaaattcccacatcataatccttgatgagttctaaccatctcctctgccgaagatttagatccgactgagtgaagatgtatttcaaactcttatgatcagtatatatttcacagcgattcccaatgagatagtgccgctagatatttagagcatgaaccacagcggctaactccaaatcatgggtagggtagttgccttcatgaggacgaagctgccgggaggcataggctaccacatgaccttcctgcatgagcacgcaccccaatccttggcgcgaagcgtcacagtacaccaggaagtccttgcgagtatccggtaagattaacactggcgaggaaaccagcttttctttgagagtttggaacgctttctcgcattgcgggctccacacaaatttttcttccttcttcagcaactgcgtcatgggtctggcaattttggagaaattctcgatgaattttcggtagtacccggccaaacccaaaaagctgtgaatttgagtgactgtcttgggttgcttccaatcagtgacggcggtcactgttttggggtccacagcaactcctttagcagatatcacatgccctaagaatttgacttcggacaaccagaactcacacttgctaagcttggcatacaattgatgttcccgcaactttcccaacacccgacggagatgttgctgatggtcttcctctgattgcgagtacaccaggatgtcgtcgatgaagaccacaacaaacttatccaagtattccatgaacactttattcattaagttcatgaagaaggcaggagcattagttagaccgaacgacatcaccgtgaattcatacagcccatatcgcgtggtgaacgcggtcttcgggatatcttcttcacgaatacgcaattggtgatatccggagcgaagatcgatttttgaaaagacagtggcacctttaagctgatcgaacagatcatcggtccggggaagagggtacttgtttttgatagtaacttcattgagagctctgtagtcaacacacatcctctttgtcttgtccttcttttccacaaaaatcacgggagcaccccagggggaagtgctcggccgtatataccccttttctttcaactcttccaactgtttcttgacttcggccagttcatttgctgccatacggtagggttgcttgtacagaggagttgttcctggagcaagatctatccggaactcaatctctcgcttgggcggcataccgggtagttcttccggaaacacatctccgaactcactgacgatgggggtttccgacagtcctatctgatgaagttccgaactgccgacagaggttgggggtgcaaagaaaactaccggttgttccggccctcggtacagagtgacagtgcgtttgcgcaatccactactccttggaattgagccaaccaattcatcccaaggatcacatccaagttcttcgtgtctagaagaatcagattcgagggaaaaggaattccctggatttctataggaacggcagggctataatactttgctgtcataacccctccaggggtggtgatgagtagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacatcctcggcagtcacgtggttcacacgaccccgaatgacatccttaccaccgttgttggggcggggaggcgcttggccttgctggcgcctcggctttgggcatttatccgcaaagtgcctgggcttgaagcagttgaaacacagacgctgctgaccttgaacgtctctgcggccttgtccaggctgcacggctggcgtaggaggacggggcgcacgggtcccttgctgactctgctgctgctgcagctgtggaacgcgcaccacgaattgagctcggggcgcggagtgaggttgctgctgctgttgctgctgcgaggaggatccccctggatagggattggtgtagcggactctttggttagccccctgttggttgcagaaatttgccaagcgatgcttgtgcgactccagtttcttgtgcttggcttccaagcggatgctcttgtccaccaaacgctggaaatccggataatccccggagaccagacgcacggacagctcagggtccatccctgccaagaacttctcttgcttctcctcatcttcacgaacatcctccggggcgtaccgggccaggttgttaaactcatgcaaatactccatcacagagcggttgccttgcttcaactcttggaattcccttttcttaagggccatgactccggcgggcacatgggtcctccggaaagcggcggtgaagcgggcccaagtaataggctgtccttctggctgcgtagcctggaagtggtcccgccatagagatgcgggcccctgcagttggtgagcggcaaagatgactttctcctcatcgttgcactgcacggtgtctaactttttccccacggcatgcaaccaatccaaagcatccacggggttattggagctagagaaggtaggcggacggatgcggaggaactcggcgagtttagagtgttgcgggggtggtggtggaggtggagcattatgctgtggcggattttggatgtggtggaggaaagcagccatcatgttggcctgctgggcgaggatttgggtgaggatggagttggtgtctggtggtggtggtggaggcgggggaggaggcggaggtgggctgccatggttgttgtggttgctaccttcgggttggttgccatcaccggtagtagcacttctcctggttgtcaccatctgaaaatcccacatagaaccggcaaacagagagagctgactattaaactaaccacccacgactaccataattcttgaatttattactgctattaaattggttcattaaggttcaagttgcttaagcaaataaaataaagacaggctccgacacagttataccacacaccggtataaccatgccccacacgactctggcagaaaaacaaacgagaagaacacacgcgcaagcctactaactgctcgtctacttctgcgacgggccagggcggaaggtgagcagcagcgcatcctccgtgctgccaacgccggaggctccctcctcctgaggaaccacaggcgcgggctcggcacgaggggtctcgacgaagcaggtccacgccagggactgacgaacaagttcgggcctggaggtactcttgcgggcggtgatcttcaggctgcggcagacgcgacggcgcttggggcgacaaacctctccctgggcgatcttgagctgacacagctgcgcctccactgcgtctaggtccttcttcagctgcagattctcctgacgcagctccaggatcttcatgttgttctcgaccaacccacgacgcaccatatgatggaagtcgatacgagccgcgtcgtaagcctccaccatgcgcgccaggtgcatgatggtggcgtcatcctccgagctagcatcccggaaggtggcgtagtcgcgggctcctccgcgacgagggtggtagcggtagggcgagtgctgcaactcgtctaggtagcgctggtgcagagtgccaatggcgaggagagcggcgttctagcaagcggcggagaaagaatctccacccacggtgactgccaacgaagtcctctcgggtgagccagtgaggatcactgcagtgacctcccaagtagcgtggggctctgcatcatcaccctcctgctccgggagttgcttgccctggtagtccactccatgcggataccccaagacaacgcacatgccccgcagctccaaaacgaagccagtcaggtccagaccacgacggttgatgctgccggccatctacaaacaaaaaaaacaaaagagaaaagcaacaatttaaagattagattttggcgataaatgaagcagcaggacagagagagactagaggattttcacaaataagaaaggatttttatttcgaaaatattgctaaggcttgggatctaaggctcgtcctagggtcaagggggctctgataccaacttgtcacgaccggaaataacccaacgggcgttccttacgtgcgtgcattattccttgtcccaggaggcaaggtgcataggccttacactcaatgataaacaaaaagatagcggatgcctacagaagcagcaaccacagttactcgacggaggtaagagctagtagtccaagccttcttctctagagcatccatcttctgaattagatgtgagctagaattagtatcacttatagtactcaacaagcaatactagagaagtacaataatgcatagggataacaaaggaatgtcataatatggtttatttttcataaagccaaagtttaaacagttcataagttcaaagtatattttaaaacatgatcttaatctaagccataattataaagttcacgaggctgcgcttcagcacaaccaactcaagtttcaccatcttaaatccattatgattcctttatcccaaggtttttaaaaagtcaaggccaacttggagtaatattgctaggcatgcccataactgagggtgtgataagttgaatagattctaacgacaaggcatgtcctctcgccatgtcttccatgcgtcacgatcaacaggtactcagacggagtccatgtcaagaccttttatgtaattcaccacaaaacaatgaaactcccgatggtgaccctcggtggaacccactaaagcactcacacaacgcccttggtcgacaggttgggactagcaattgcgagtggatacactcaatctgtgatagacccctggtccaaagttttgagatgcactaaactgtcgatcaggccttacccatagacttgtggtcgtacggaaaggctttgcaacagatgcccgagagagccccaaaacaagtttcagttttcacaaagaaacatcgtttgtcccactcaccaactgcccagttgatggtccaacaagtaatcaagtattcggtggataccacagcaccccaattcattcaaaaattctattgctgaatctaagcatggtaagcataaacctatggtaactagtaagtccaacatatagggtacttgactagttaatttattttgcctagggttctcaaggacatggatatcaaatcaataacgctataacaaggatcataggaataatattaactaatataacaagtgaacgatgcaatttataaaagtaatgcaatagtagtaaaacaatatagttttcacaattgtaggattcaacatgcttcaagggtaagatatgacttgccttgattgctcacaacgtattcgtgatccactatgaggaagaacaaatcttttagaactgcacctatgtttgcacgacaacgcaaagtaaacaaactagggtaagaaaaaccacaaaaacagtacaataaggcacaaaaataggttcttggcattataaggaaaaattagagacttcaacggatcgattcggagttcaaatggctaagatatgaccatttgaaagttatgtgctctttaaatggatatttttgaatttgttgaattatttttcttaataaaataatgatgcttccttcagctagagggagagggagagggggtagagagagagcgagagagagagagagagagacagaggggttggggtgtgctgacaatcggacccacacattagcctccggaggacaccggtgggtgggccccatagggaatgcacatgcgggaggccggcaccagtggcatggctacggaaggttgctggcgcgcgcggcgctgttgaggacggcgagggaaaactgagaaaggatggcgggctcaccaacatgcgcaacacgacgaggggaggacaagaattgccgacgtcgagcttgaagcagtggagatggcactagtcgatggtggcggcgtagctacggcgatcttcaagcaatgtgaaggtgagaccatcgaagaagttggtgctgcggtgcagacaaaggaacaacaaggtcagggcggtgcttcggtgaggaagaaagggtagctggaggttctctggcgaggaggatggagaggctggcaaggaggcagtgatgcggtggcctcctagtgaagccgaacaatgccagggatcgagctcgtcctcatggagctgagggaggtggcggcgcggcaaagcgatgcgctaacgaggagaaacaggcggcttgatgatgcccagtttggaggagaaagaggaggagagtggggaagcgtcaatagagctcaggatgggaaaaagggaaagtggggagggagaggaatccattttgtaggccgagggggagagctatccaaggtgatgaggaaatatgtcgcgatcttccaataggtattgataaatctcgatttggtgcaaacttgacacacacgaactggcttccgatcaacacgatccgaaccatgcaatcgtaggaccacgtttcctatagttatcaaccatgcactacctggttgacctcaccgaaaaggctaattcctgcacgcaaatcgaagaacacaagcaagaacaaggtagattgcaactcgattgtatatgaatagctaaacactcgaatttggggttctacaaatagaagatgaggcaaaactgcaatagcataaataatgtaagtaaaacccaactctaaactatgatgctaatgaataaatatgatttgggatgtcctagggttgccctagggcgtacaccaccatgggttttgtccacaacacaatcacatgtccgaaggcgcaaatcatattcggactggatgaggtatatggcttgttttgcagattctcgacagctcggtaggaattttgacatgggaccaaaaccatccaaaagtggattccataagttttccaagaagcactcatgagcctcaaaattcattttatatcagcggctaggtctgtttaaagttaatgctatcaggaggcccgaatccgaatacagaacgtgcagaacttcatctcttgccttctatggaccaaaagtgatgtggtgaggtaggagtagacttgtagaaggtcttgatttggtcgccaatcaatttctttcatagtccatgcattccttacacttggtcttatttcttttacccaagcaagtacctctacaaatgaaaagatacaaaaacacatggtgtagtaatgtttgttcaaacatataataaataaatatatagaacataatcaccttttgttgattaatacataagataggcatagtcatatctgagctagttgtgtcctcatcatcttcaccttcttgattggaaaccgtcttcggtttcaccttgtcattgaacctattgaacttatctttgttatcacaacaccaggtgagttagatttctttatgtccatatggttggattctaaaatcttgatagccgacaaccacaacactcccttttttgcaaaccaatatataactcatttaaacaactagaggaactagatacagaattacttatatgcatgtggttctctagacaatacatcttatcatgaaaaggaggtatattcaatttcgaacaaatatatactcgatgcacattatattatgctttactatcataattgctaacaacatggtaaatcacatgagaaggacatggcaattcagatctagcaaataatttcacctctaaacaattgagtggacaaagattatcaaattgaatatagccccaagtatttaaagaagattgtaatttaaactcttcattctcgccagcaatgtgaataacatgtttaaactcaacacatgatggttcaacaaaataacaaacatgctcattcactagttgtgccatggatataagtgaagcatcgcacaactcttcttcatcacaagaaacatcaagcaaattgttttgtgacaaaggtatttcaacaattgttttcactatgggttgctcttatatagcataaatagtggatatatttagcacgtcattactatacataccttgagtaaatctagcaccattatcattaccttcattcttatcttcaaaaattataggcacttggttaattaaacattcttcaaacatgcatggagcctcctcaactatcaatggttaacaacggttctgggtaggtcttctttctctacgtcttttttgtttcctcattatcttggttgttctcaagtacctgcaaaatattagaatccaaagaaagaggtacaacaatgcattagtttcataataactcaggcttagttgaaagcatcgcaatattagtatcatcccagatatataatatcattgatttgattatgtattaacaatatcattatgcaaaacattttatcgtatatccatggttgaccaaacaatagagaacttgcttgcataggcacaagatcaaaatttgcagtattatggtaacttccattcgaaaattttattttcacaattctacataacttggacttacgaaaagaattgaacaattggatgtaatatcgatgaggatgcggttttataggcaacccaaggttctcaactaaatctgaactcacaaggttgttgcaacttccaccactatcgaatataacacgacatgatctatgcttaaccatgaaccttgctagaaataaattgtggcactgtttttgcttcgctttctttatttgaaaacatggcactggttgcactaaagtacttatattttttatgtaacaaagtacttacattatctgcacttatggaagatgatgtagcaactatggtttgtgtctcatctaactttatctcatgcccacgagtggtgtaatctgccattgtgagtagaaaacaaaaaacaacaaaaaaaaagtattatctctattaactacggaacaagggttgtagtggaggctagaaattggaagcatcttaccaagcttttacaagtgtcttacaagcaatgataatgacgatagaaccgatggttggttcatgaacaaaacaattcatattcaactttatttcacaatccattattacttacctaactaattatatgtttggatactatatacttgacattaaaatctaacaaaaagatgtcaaaaattcagttcaaacttgtttgaactaattacaaagtagtaaaaaagttaatgttcatacctaaacattttaaaaaaattcatactcatttgaattaggtatatactcaatttaaatctttatacccgccaccatggaaccctagttaaatggcacataataataataatatatatataggacactcatatggggcaccataccatggtgcctgtgcaccatggtatgaaatatacaaattcgtccaaatttttcaaaattttcaaattgtgagtatatatctaattataagtattcgattcatacctatatctatcaacaaaacaactcaagcttaactttatttcacaatctatgattacgtacctaactaattatatgtttggatgctatatacctagaatcaaaatctaacaaaaacaagttcaaattcagttcaaacttgcttggaactagttagtaaagtagttaatgttaatacctaaatatttgaaaaagtttcatactcattcgaattggatatatactcaatttcaaccagggtggtcgggcaccatggagcaccaaacaaatttattatatgtgtgtgtgtgtatgtgtgtgtgtatatatgtgtgtgttggaggcataccacgaagggccttcggccggaccagccgaaaccaaggattcaagcgacaagcccagaccggacgtaagcggcgaagaccgagaagggaaccatgtgggcgagagtctcatggcgaaggccatggctcggacacccggacatcaccagacaaggacttcgctagaaggcagtgcgggcgagacgaaatctctggcaggagggcctaggcttcactaggtgccgaacctcac

SEQ ID NO: 28718 - DNA, 4224 bp, Oryza sativa
tgattcctcttcaattccccccaatttcccccttggatcgtgcccccaatcgccgggaacgcccgcgttttctccggccgctttccatggccgccggccgccattcccgtcgccgttccgccctctcccgtgctcggctcgcttccctccgctataaaatgcaaccccctcgctccgttctatcgttttagccccctcccgcgatctcccgtggtccctagccctctccccgccgtcctcctctctctcccgtgccgccggccgcctccagccgcctctccctccttgccggagcgccgtccggtcgcgccgtcgcctcctccagcatcgcagtggcctccccttccccggcttgccctccgtttcccgcggagacccccggagctgcgttcccgccgtcgcccttccctttcctccgcgccggccgcctccagccgcctctgtctccctgcctgagcgccggttgacgtcgccagcacctcccttggctccgcgacgccgccctcatccccggcatcacctcctcctcgcacgaatttcgccggaacaccgtcgcccgcgccagcctctccttcctcctcatcgacgtctcctccggcagccccttccgccgcgcccgtgcatcagccggcgctgccgtcccctccctcggcgtcgccgcatcgccctccaccccggctgctcctcggtttcgccggaacgccgtcgccgcgccggcctctccatcctcttcgtcgccagcgtcctttcggccgccccttcctcctccccggctcgtcggcttgctgcacctctaccatcttcggcatcgcagccgcgacgtcgtcctcggcctcgcctcccctccgaccgaacaccgccggtgtccgtcgtcgtcttcaccgttcatcctcgccggctcgccgtctggcggcgccgcctccgtcgtcggcatcgcagcggtgtgttccacgccatcctcgcctccgtgcagccgctgccggctgccctcgtcgtctcctcgccggccccggtcgtcgtcgtcgtcctctcgtcgttcccggtcgttgtggcgttcgtccctccgtcaagccgttctcgtccgccgcccgcgtttcgtcaagtgtgcagcagccccgtcgtcgtcttcgtcctcgcctccgcgtcgtcaagcctcgtgccggctgtgtctcgccttcgtcccaggatcgccgccgaagtcgttccctcgccgtccgccgcgcccgttcgtcgttgtcgttcccacgcctcgtcgcgtggtggtaaggatccgtcctctcgctgccccgtcctcgtccttttggtgtcgccccgtacccgttgtgcggtcgtcgaccccggtacccgtgtaccggtgtcggtagtcgttcacgtgagcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttctaggctagcgcttccacatgttttattgttgcaaagcttaattataataatccgcaaatctccatataacagcattaaacttcggatgaacatatcttggtcatacgaactctgaatcgacccgttcaagtctcctaatgtttgttataacctaaagaactgtttgctttctttttatgtgttgttattgcttctttataggcttgtagctttgcttgtgtgcttcgcgtagctttcgtcgttccggaggttcccgaagtgtggttcgcggtcgtcgccaaaggttcggaaggccgttctctctgagcaaggcaagtcacatcatccttgagcatattgaatcccagtttataaaattattttgatttaaattaatgcattactgctttatttaaattcccgcgttatcactgttttatttagccatgcctatttatcattgttaagacattattattgctattgttattattaccttgttcaccctaggaaaataaaaccccaactagtgggtactctatttatggttccactagtgtgaacttaggtagatgcttcgctggttaattaggcaacattaggtggttttataactttagactttgggaaatctcatatcatttggacattatggaattgttggattatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttttggctcagtctagttataaacaaaagtacacggatggaggtggatgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaataactaaaatgtggaatggttggcctgggttggcttgggacgagctgggacccagggtcgggttgccagttcagtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtacccccttgcattaattatgcatctgccggtgtggcttgctgagtactgtggttgtactcattcttgctctatctttctccccccccttcagtaagagaagcttcggagaagatgtcttaggtggagtcctggcttataccccagttgagcgcctgtgaagatggagccgtaggcccgctagtccgctgctgtttatttttgtttgtcaggcctgaagtgcctttgtaataatgtatttattatcgatataataaagatgtgccttttatatcatgtttgtttggtgtaccccggcttttcctgggacggggattaatacactagcgttcgggaaaaggcaattttctcggtcgcgacaagctggtatcagagccatctcgactgtaggataagccaagtggataaaacctaaggacatattttataaataaaactatttgcgaaagttcctgtttcctcctttccctaatgctatgtcacgtcctgataaattcatcccgaaataaaaatcattttttaaaaggaataatagaattaattaaaattcagaaagaaattggcaaacactaaaatgcgtacaagaaaaattcgaatgtggcccggagaatttttgttaaattctccttggtttaaaaggagccctcaaattttacttgaattttcagagcaccggaaataattattaagcaacaaaaacaattatcaaagtttagtaaaaagaaaaacctaaaaataaccttccttcctcctttgggccaagtttggctcaaagtccactctctctctctcggcccgcggccgaagtccctctctcctccctctttttctctccctctccctccccctcccctctctctcccgggccgttcctccctcccctcccggcctgcccggtcccgggccgccctgccccctcccgcctgggccgtgtcccggcccagccgagcctccccaagccgcgccgcacgcgcctgtcacgcgcacgccgcgcgtgcgctgaccgcgcgcctgaccggtgggtcccacgcgccgggtcatcgtcctcctcccgcccggccgtcctctctccctctcccgtgaaccctagcgccattcctccctcaaatccgcgc

SEQ ID NO: 28719 - DNA, 3238 bp, Oryza sativa
  unsure (1)..(3238): unsure at all n locations
actgtttaattttgattgccaggcctgaagcgcctctgtaataatgtaaatactatcgatataataagagatgtgtcttttatatcatgtttgtgtggtgtaccccgacttttcctgggacggggattaatacactagcgttcgggaaaacgtatttttctcggtcgtgacaagctggtatcagagccatctcgactgtaggataagccaagtggataaaacctaaggacatattttataaataaaactatttgcgaaagttcctctttttcttcttcccctagtgctatttgcaaaaggtttacccttttcttccttcttcaaatttcaactagtactagatggtcaggtcagtgaagaagaagacatcgtcagttgttcgccgaagctccggaagactgcaggatccgctagcgaagtggaggaagcagtgaagccagctgtgaaggagtgaagatcttggagaacccgtcgcagaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacaacacatcaacaagaagagttagttcctttaaggtcttgtccctagttctggtccattctttccttgtctgcttcccctctcaacctctaccttgtgacagatggataacactggtaacaaaggctatgggaatgatggatccgatgactcaagaacccaagccagtgggaatgagaaaagcatcaacaaaacctcaccagagctaatccaaattgtggttaaccaaaccaacatgttggcaacagcctttcaactattacagtattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacagtcgagaagaagctagggttgattcagtgcaccgaccaggagcgggttggcttcacaactcatcagttggttggaccggcttcagagtggtgggatagctacgaagcatcacggccagaaggacataccatcacctggaacgagttttcatctgtattcaagagatcacatgttcccgcaagaatgatcacactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactactcctagaggattatgaagattttgagaaacttgtggacaaagccatgcaactcgaaagtgagcataatcggatgacgaactgcaagagaaggattgtcaacatcccagtatttccatgtggtaaccaaagacagcgcactgagccacttcagatcaccggatcttctgttgcgcatcaagagttactaccccaagaagatggacacaacgcagacaacaacattagcaatactaatgctgatgataccaccaacaaccatggttcttgccccattcatgaccacttagatcaagcgtgcaatgtcaacagcattcaccaagatatcgacgatagtatcaatgaaggcacccagaatgacaaccctagcaattttgactctgagaaagactccaatggtgatagcaactatggtaccactgatgccaatgttagcaaggatttccaaccaccaattccaactccaagtcagaatgatcgttcccagacggacaactcagtaaagaagacattgatttgttacaactgcaaagaaccaggtcatttctccaaagattgtccacagccgaagcgtaacctgcgtcatcactccggccattatgcaagaagaagacaagtcactcgccttgtggtcactggagcaaacgccatacctgtgaggcctcgagttaatcataacccatagtagaaacaatgtaccgatgttaagcatcttccctttttgtttaaggtagtgccttgtattcgtgtaataagggagaaatgtgtaatacggacaagatttatgaggattcttttggaagatgctgatatgggattatgtgtataattggttactgtcaaaggagacctagggtctcatttcagaggaactatgttctaacctcgagttaatacccaacctgatgatggaaaagaaaatcaagtgattaaccaaagagacatttgtttggactaagtgtttcagatgtgtcttctttggatcaaaggcaacaaccgtcagtctagcttttgatgaaccacttcaaggtttcactgaaaggcagcaagccaaaggacctcattgtcaccagaagcatccacaactctcggagtgaagagtacttggttgacaaagtttaaaaggtgattgatagaagatatcagcaaaggtgtttattatcgggcaaagaagtaggtcgaaaggtgattgataagagaaatctaaaaaaaagaatacgtcagggttgaatgtgtaaaggcatactttgaatgctaaataataacaacatgaagagaatagtggaaagtgaatccgagttgcttgttcgtgagagctattcccagttatgaaccaagtgatatgttcgaagatagtttacagaggtcagattaaaatcacatgtaacagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28720 - DNA, 700 bp, Oryza sativa
ggcacaaagcggacatcaaactggcttagctcgactacccatttcgcaatgcggccgacaacgtctttgtttctcactacttcaccgagagggaaggaggatacaactgtgaccctgtgggcttgaaagtagtggcatagctttcttgatgtcatgattaccgcgcaaagcagtttttggatctatggatatcttgtctttgcgtcgtggagagcttcgctgacatagtagactggtcgttgcaccttctctctctcgacaacaatgacagtgctaacgaaatatggcgtggcggcaatatagagaaataattcttcattaggttggggggcaacaagtacaggtggatttgataggtagcacttgagtgcaatgaatgcctcttcggcttcctgtgtccatcaaaatttgtcttgctttttcagcagagcgaagaaaggttgtcctcaccctcccatcctagcgacgaacctacgtagtgccaccatgcatccggttaacttctgtacttccttgagtcttgtaggcgacttcatgttcttgattgccttgatcttctcgggatttgcttctattcctctaccagagacgaggaagccgagtagcttgcccgatggtactccgaacgtgcacttctctggattgagcatgaggcgatatcgtcggaggttgttatacgtttcccgcagatcgtcaatca

SEQ ID NO: 28721 - DNA, 379 bp, Oryza sativa
cttcgtagccgattggactatgcctgataacaggtcagacaaccaaatcgacaacgaaacgtggacaatggcgttcgacggcgcactcaacagccaaggagcaggggcaggattcatcttgacatcacctttgggagatcaattcaagcatgcaattcacctcaactttagggcgaccaataacatagccgagtacgaaggactactcgccaggataagagctgcagctgcactcgactgatcgtgaaaggggattctgaactagtcgcgaaccaggtgcataaagattacaagtgctctagccccgagttatccaggtatctcgcagaagttaggaagttgaagaaaaggttcgataggatcgaggtccgacatgtat

SEQ ID NO: 28722 - DNA, 1162 bp, Oryza sativa
tgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttctaggctagcgcttccacatgttttattgttgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagtcttcgtcgttccggaggttcccgaagcgtggttttcggtcgtcgccgaaggttcggaaggccgttctctctgagcaaggcaagtcacatcatccttgagcatattgaatcccagtttataaaattattttaatttaaattaatgcattatcgctttatttaaattcccgcgttatcactgttttatttagccatgcctatttacctttgttatggccttattattattgctattgttattattaccttgttcaccctaggataaacaaaccccccccccccaactagtgggtactctatttatggttccactagtgtgaacttaggtagatgcttcgctggttaattaggcaacattaggtggttttataactttagacattgggaaatctcatatcatttggacattatggaattgttggattatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttttggctcagtctagttataaacaaaagtacacggatggaggtggatgaagtcgggggtcgatggacatctctaggacaatgaaggctacacgagctgcggcccggtagtcga

SEQ ID NO: 28723 - DNA, 9090 bp, Oryza sativa
  unsure (1)..(9090): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaactactgaccaaggagcttctttcatgtcacatcaatttagtgagtttgtcgaatcttttagaattaaattgctgaatttgtcgccttattatgctcaagctaatggacaggccgaatctagcaacaaaattttgattaagcttataaaaaagaaggtagaggagcatccaagaaggtggcatgaggtgttgtcagaggctttatgggctcatcggatatctaagcatggtgcgactcaagtaacaccgtatgagctagtctatgggcaggaggccgtgttaactgtggaggttaatttacaagctcttagaatagccagacaaaatggtttgtcggctgtagattataggaatttaatgatggacaggatagatgacgtcccagaggaaagattgaaggccttgagacatattgagaaagaaaaattaagagtagctagggcttataataagaaggtgagagaaaaatcgtttcagataggtgagttggtatggaaaacgattttgcccattggaactaggagtagcaaatttggcaagtggtcaccgagctgggaaggtccttataaagttgtagagattgttcctggaaattcatattttgtgtagtctttgcagggggataagttgcctaaagctttgaatggaagatatttgaaaaagtattatcccagtgtatggcagggagcttgatatggttatggccggtgtattgtttgaaacatcgtcctcagaaaaatattagttatagtgtttttggtgaaatttataatatattaccaaaaacaggggggcatgtgttaataatgtaatttggccgattaggtagttcaaatggccagattatttttaatgagtagttagatgatttgaatatattctttaggactttggttttgttttctaagtgcaggtatgatgctatattatctggagagcagcagcagcagattgatggcttggaagattcatgcatgatggtctgcttcacaaggctgtgcgtgtgctgtctatctgcatggaggtgcatatacgttatgcgggtctttttgccgtatgattccatatacgtatgctgcagttgagtgggcctattggatcatgcacagaacaacatgggtttgggctatatcaagaccaatggatcatgcagagatgaggctggttgttttgacgccgaagcttatacggaagggaatacaaggtggcacgcatgtcagctgagataaggcattgtttgatttggtttgttttgtattcggcttagagaattgatcgctacttggtactttctatatacgtgggctaaatacatctactaaagaccggagcacgcctgtacatatatcaggtgcatggccgattggaagaaaaagaatcgaacaaaatcaatctacttatttagattttcatctatttctgttttctctttcccgtgctttttctctctactgccaagctctagggtttggtggatctttgccattttgcgcaggaaaacggtcggttttcctccacgaaagcgaggaatctttgttgctttgctcggaaagcatccggtgatcgtcacgtaagcacggtcagtatcgtgttgttgcgcggatcaatttcgcgtgccaacaggatctaaccatggcatccaagtgactttgaaagtacttagcccacttccggactgtgatcagaactccatgtaatagcttctggtcctatgcatagcgtgtcttggagccagccaaaacatcactgatgaaataaatgggcctctgaaccttttggatgtgtccttctcatttaatatccaacactgcactgacaacatgcgaagttgctgacacataaagtggcaagggctcttgtggatatggtgaagctagcatgtgcggtgtcataagaaaattcttgaagtcttcaaaggttttggctttaggtgtccattgaaaaagggcatgcctcattctccaagcctagagacaaaccgactaagagctgacaggcatctggtgtgtttttggatgtccttctaggtacttggcggcttcatattctgcataccattcatttcctctgggatggcttcgatgccacagtgtgacaccatgaaatcaaacagcttccctgatgctacttcaaaggagcaattctccgggtttaatttcattctgaagacccggatgttttgaaaggtttcctccaagtcagcgattaagttatccttctccttcatcttgatgacaacatcatcgacataggcctccacattgcgcccaagctatgattgcaagcatttctgaatcatgtgctggtacgtggctattgactgtcggtatcaagccatttcgtctgttaatatatccaaaataaaggagaactagctatgcttgcatgcatattttgtttaagaataatctatctccacttgtaattggaattttatttcgttgcagagaactttacataattggaggagaatcgatggagaataaccgaacaatcgattgaactccgtcgagaggtagacttatgggtggatgggattacaaatcaagtaaaataatatcaaatgggcccaaccaccacactactagaccaaagagtcatcacacgacacggctacaaaattctgggctgattgggccaggccagggttcggcgcaccgttgatctccccctttcacatggatgtctaggattgctccccaacgacggttgtagggtatttcggataattccaaccgtcacaaccgtcattggcagcctacagatggaggatagctcactccactccaacacatactcaagaagaagatcaagaagctctctcaattttagtttattgttctagtgctagtggagtaggaatggagtagttctcttagttctcgagtcttcatgtgatttcgggtatggctctagtagctcttccttcttttttaagacttataatgttaataaaatattctcctttatatactttcggtcttttacttaattcatattattcgagtaccgactttagttcttacttgtcttgatataattgtgtaactagcttaccagagatatgctatggtgtgggtttaatgttcatttcaatgatttctctatgtctgctgcagcgatatgaagtagtatttagtaatgtaagcgtggtgcttagattattagataccattaattggggttatatgctgcgggtcagtagaggtgagccgctgatggtgacagctcagtacgagtattcctcaatgttagtatataatcctaagagacttttctagcatgggaactcctccgtattcattaccggtcggatcgccatgacgggttgtcgtaaggaacttggcaatcaggggtgatctctcgaaacaccaggttgacattgtaaggaggtattggttgcatgattgtatactagcaagtgtaaactaaagatgtttatatactagaagtgcaggaatgattatttccttattctttctccactcagcctagattatatctaaataagtgaaaggagagtcatttctcacaaaattactgtgccacttcattcgaataagcatagtcgtccgatttccaatacaaaagatgtgagccgttagattctctaatcatcaaaatatcttcacaattcttcaataatcttcttttcacaaagaagtccttccacaatccacatcccaaacttatataaaaagaagcgaaaaaatgcatgctcttgcgtttgctgcttttcatgctgcatccggtcagcgccgcctcttcttctctttcttggcacaagcggctatcgctggcttccgtacctctgcctgctccaccttttctcccaagtcaccgccttccccaccacaggcgcctcccatctcttttccccactgctgccgctgccgccgcatcctcctcttcctcactgtcgctgccttctgttctcctcctcaacaccgtctcctccccgtcccggcaaggatcaggcagcagggctgcggcggtggccgtacctcctgcgaagacaagatttgaacttctctggtactgctcctttctgtcctctcacaccctagcaccaaatcgggagtatgcaccatagtccgtagatactgattcattgtgaaagtttattttactgtgttattaatttgtatccatgctgtttgtaattggtaatacctgcactaaatcaaatggtggatgtgatttagaacgcctaaatcatatgcccataccaaattctaaccacaccaatctttcgttggagttgtcaatcaggacactaggtcaacacggtcttgctaaatgttcagtcatgtaattgaatttttagcatatataattttgattgtaattgttcagtcatgttagtacaaccatattgttaataagcatttagttcataaacttttaagaatgctaaaatatcaggtccttatgtttttttctcgcttccaatttgtcataataatagaagttcaaattttattttatcaagcttccaatctgtcgtaaatagtagaggttcaattttcttctgtccatgcttttaagttactattgcaatgttggtttaaagaatttttaacacgtctttgtgctttgaatcaatggtacggagcttttctaaccacaagtgtcgctttgcatgttctctacaattatttgacaggagtaaactagagaagatttttgaggatgcatgcagggttcactggaatgattttgtattctcagctgaacattcttgagttattgagtttagcatccgtaaaatctgtaattttttcatcaatgaacaatgcaataccatgagccctctaatgtcccttttgtttccatcaaaattttcctttcaatgtactatcttttcatcaaaatttacgctcatgcacgtctctttcagcacaacccttatttaaatgtatgtgctgccgtgtcctgtgattttggaaaaaaaacaaaaataaaaatagaatatattatcatatattacggcatagatataaagggctttatagctacactttatgtaaaatgaagtatgtcgtgcacacacttatttacattgttaattattattataaatttaaacttattgctataaacaatatgtaaatatatttaagagaggttaaggttatagtcgtacgaatgcacgacttaataagatagttttagtgagagtatcttggttctttcttgtgtgtgtcaactttatcctacctatgaattgattaacccctacctacactttggtttatgcaagtaatatataaattattagcatggtactctcttgtcatatcttggattaaataaatacgatacattggattacttctgggtgaaatgctacaatgctatatccatgcgcttgcggattatatctgtaaccataaatataccgagaatacttcagcgccattgctgggaattatatttctagtaatgtcattaagaaatattaacagtggctctaacattcttcagactgaaaggcattgtgatgtaacaatactctccgaacggggtgataaacgaggtctccaagcggtcagactctttcatgctgatttgatgatatcccaaatagcagtcgtgaaagctgagaaggtcgctgatggccgtcgaatcgacgacttgatcaatgtgaggtaatccaaagggatcttggaggcaatacttgttgagatccgtgtagttcatgcatatacaccattgtcccatcttcttcagaactagaacagggttagctagccagttgggatggtaaacatccttgatgaatctagctgccagaagcttactctgttctttcttcatagcgtctctttgatcttgtgcgaataggtggagtcgttgtttgatatgctttgcgtcagtcttcacatttaatgagtgctcaatcacctctctaggaataccaagtatatcagaaggtttccaagcaaatatatctttactatcttaaagaaagatgatgagtgtgttttcctatttacaatttagctcggcaccaattatggtagtcttggagggattggcttgatcaagtgggatcttctttgtcttggcatcactttctcttgacttcagtatcttcttggcaggcaattcaccttcatgtgatgttgatgcaacgagtcagacctcttgctggtcgagtgccctcccatgagattgggtcatctcgcagctctccttgtcggaggtgacggcttgtttgacgtcgctacgcaatgagataactcgttgtgacttggcatcttcaacatcaagtaggtgtagtaggggacgacaacgaacttagctagagctggccttcccagtatggcataataagctgcctcaaaatcagcaacttcaaagcagatattctgtctggaaattattccgagtccgaaggtgactggaaggctgatctggccgagtagcattgaggatatcatagggacaaccctatgaaacggagcagaactcgacttcatcttggatcttggaatctgcatcttatccagtgtcttggtgaacaggatattgagcgcgctgccaccgtcgatgaggacacgcttcaacttaacattatgaaccactagatcttgtaccaggatgtaccactccgggtgagccactcggccaagatgatccgagcggtcgaacatcattgctacctcggaccaccataaatattggggtacttctggctagatggtgttgatctccctatcggtcgacttctgcttccttttggattcgtaggcgggtgggcctccgaagatgtggtttcactcggtcctgggatcttggaaggcccttctccgttgtttttattttgcccagaagttccttcgccattggtgatcttgagttgcgctttttgtgcttgtcgcagtcattggccacctgtgctttgagttcgggtgatttaggcattgcccattcataaccttatcgcagtggttgggacgacgttgtgattgctaattagatgttgtggccaccaagtcttcaggtttgtgcttgcgatccttctggttgttgagttattattcttctaggggcgccaatagctacccgactacttttcctcctatgatgcattgacagtgtccactgccttggcgtaggagttggtagtctcaaatagcttcatgactattcacgaaggcttgcgattgaacttgccaataagtaacttgtctcgaatgcctttttggaaagtagcggtgataacatcgtcagtgaccttcgggatcttgttgcgggcctccgagaaatgtcagatgtagtccaaaagagacatattggaacaacatggtataggtcaaagtgagtactgcgtctctcgtaggtgccttggaagttgacgatgaactagcttcaaagctctcttcaggaatcaatggatcgccttggaagccccattagccagctccttgttgaatcagcgagtgccataggtaggtaattcgccagtgccttgttgtctcctcctactgcacaaatggccagggtttagacggtcttgccatcgtacttttcaatccctcttgatttgaaaccagtcggccaatccactcgatacagatctcaagtaaaagctaggattcctttgtcatcgtagttgatccttacggtgagagcaattttcccgatcgtgatgacgttggttcagcgtaatcctcaagtatttgggtattcaacgtctgtgtccttcgtcatggtctcggtcgtcgtgatggctcgacattgtcatgattgatctggatgccgacctctgttttcttggtgatgctagatggaagcggtgtgacctctgctatattcaggttttatgtggcccctggatctatgattcgagggctaatgacagccaaccagagtcctgggggagtcagcattggattctttcggtcggcgagaagctccggcatcattttcttgttgggctgcagtggcgacgatcatagtcttgaccttattcaacatcaaagtcatgttttctggagctttgtcgatgtgggtgtcaatcaacgtgacggccaccacagcgttctattgaggtgtagcgaaaacattactgtcttctatgcgggtttggatgatgttgtgtgcaatgtgaccgcttctaatcagatcctgctgccttcactagcgttcctcctcagctttggcacgtgcttcctcttgatccctcgtgatgccggcttgctcgtctttgtctgtggtgccaccgacaatgaagacttcgaagaaaaactaaagctcaaattcggaagtcgttgtagctactgagactatcaatgtcgaagtcgttgtagccatctaaaaaactaaagctgttgacaactttcgtggtgctatgtcgcgcccgaaaatcaccctaaaattttatcgtctaaattatttatgtaaaataggtgattccccacgctttgctgcgggaattacaattcttaatttttttttgtcaatcaagtttggagtaaaaagaaaaaaataatgaaacatcaggatttatcagtcaaatggaacccgtgctttagagtgaaacatattgataagtatagatagatttgttaaaatattgtgcaaatgatatgagaggtgatgattagatatgcttgtattttgatttgtaaaattaaataaattgtagatgatgttgtatgcttacatgagattaaatatgtaattattactagtgggtgatgatgtgttatggttgcatgttgagttttagacttagtgggctttaacttcaacaattaaaaattaccatgtttcaactcaaattgatgtgtgggtatttttgttgaattcctcatgcttcaaaatatttaaacaacttttacttgaattttacataataaataattttaatgcaacaataacctttctcagattttattaaaaaaagaaaaactaaaataaatctcgtcgcccttcttgcgaaaatacattacgttgggcgaccggcgcggggg

SEQ ID NO: 28724 - DNA, 1530 bp, Oryza sativa
cgcgcgcccctcccccacgtgcgtactgttgggcccacccacttctccctccctttttccacaaaagatatttcacctaatgtacttccaatgtttcactctttatagatctaatgttgcagtgaattaaaatattcttttgcaaaaaaaaaacccacatattttggaaaatctctattaagggaatttggtttattttttgttccaccaaaaatgtttcacctagtgtactcacaatgtttcactatgtatagatctaatgttgtagtgaatgaaacattccattgcaacaagaaacccacatattttgaaagcccctattaagggaatttggtttatgttttgttccactgaaaaatgtttcacctagtgtactcacaatgtttcactatgtatagattgaggtgtagcgaaaacattagtgtcttctatgcgggtttggatgatgttgtgtgcaatgtgaccgcttctaatcagatcgtgctgccttcactagcgttcctcctcagctttggcacgtgcttcctcttgctccctagtgatgccggtttgctcgtctttctctgtggtgccaccgacaatgaagactttgaagaaaaactaaagctcaaattcggaagtcgttgtagctactgagactatcaatgtcgaagtcgttgtagccatctaaaaaactaaagttgttgacaacttccgtggtgctatgtcgcacccgaaaatcaccctaaaattgcagtgaactgaaacattctttcgctatttgctgaaacattgtttttatataaggtgaaacaacacccgatttaaacgtgtgaaacattttcgatctacttagtgaaacaattccgatatacctagtggaacatcgtgcaacatttaaaaataattcaataataatctaaattttttttgtcagaatatatctatgtgaggtcttgttttgaagatttaattgcaacaaatttaatggtgcaatcatatcatgatttagataagtaatttaagagaaaaattagtttaaagaaatttttcacgtaagtcgatggcgtcagcgtccgattttaccccctcccgatcgggcacccgaccgggagtcgtctcccccttcttgggccattttcggctcaaattcctcccctctccccctcggcttaaattcctcccctccctctctttcccatcctttctcggcccggcccagccgccccctccccggcccagccgagccactgctcctgctgcaggcgacgctgccacgccgcacatgcgatgcacgcgcgcaccgtcatgggtcccgctcgtcaggagcatctcctacctccaagccaggctattcctctctctcccatgaaactcaacactcccgcctcctttgatctccctcccctatcgttccgcctccaaattaattgcaaatctatttcttgtgtagcgggcatcaattcccctaacaaatcccattcaatctcgtattaaatcgcactcaatcgaattctttaactgatggactaaattgggagactcactgcc

SEQ ID NO: 28725 - DNA, 13025 bp, Oryza sativa
  unsure (1)..(13025): unsure at all n locations
tcgccgtcgttgtttcctcaccgttccagccgtttgggtgagcctcgccgccgccctcgcatctctcgtgtcgcgcaccgctgcaccatgaccgatagccggggttgccggctgccatgtcctgacacacctctctctccctctctactgtttccccctctctgctgttacaggcagcaagcacacacagtagtttttctttacaaaattaattcataaattagtaaaatgccaagcaaacaacacctagaatttaaatgaccatatattgactgtttgaattcagaaccgatctattcatattgctattgttttccttaaacagtgatgaacccatttttagggttattactgcatcttatatggtttttatttatgttttgggcctttttcgttgcatatattgtatagatgctgcatatctggaagagccgctctaccttgaagtggatctagaagattttggtagtgagcaaggcaaatcatgtcattttgatcatattgttgtcccaatttataaaattatgtttatctaaattattgcattttgctttattaaattccgacgcttatctttgttttgtttagccctacagattctccttgttatagccttattatttgtattattatgatccttgataactctaggaaaaataaaactagtcataacattatatatgtggtgcttactagtaaatttaggaatatgcttagcgctgcttaaatagaaacaattagatgttttccaataattacaaattgggaataacttgtaaagaatggtaaatatggttcagtggttgtttatccatgacatgatgttccccttcaaaattccccaaacatattttgggttgggctcagggtgcttggtttcgctagtcgcaccctggccgtcattaggacaggtcttcgaacctccgttgcaaagcatatgctgtacagccacctgtctgatgggtagggcttaacgcatcatctagtacggtcatgtacaaggaagacacggatagggatggatgaagcccttggtggggtcgatgactctggcagtacgccagggggcatagactgtctgctcgacccagggcacctggtgggggaagtctatatcagtcttctttgtttagggcggtactaagaggtgggttatgtcatgtcttatgtccgtatgccgtggtggcatgtggcacatggcaacatgtgagaaagatgtgttgcaatatacccaagttagaatttagttctattaattgcgtaattggagttgtcagttgttggcacgagttaaggcaagatcgcattggtgtgcggcttgaaaataatttgactagagataggtttgtgttttatttaaatgcctttaaatatttaaatgctttgaaatgctagttttatgcaaaaaaaatccttaaaaatgaattctttgtactcccttgcattatatctgcattttcatgacatggcttgctgagtacggtggttgtacatagccttgctcttttccccccttctagcagaggagtacttcggatatgatggctttgatgtctagctcgtgcctgccgtcaagcgcctgtggtgactctcgtagcttctggctttttactgtttatctttcattgttgggcttttggtcgcccatgtaataaagtactctatttaagctttcgcttatatactctattatttaccaactttgtaatgtgtaccttgcctccttggacaaggatttatgcactcacaaacggaatatattgttctattttccgggcatgacatgctatattatccaagtgattcgatcatgattcccgcctccctagttctgatctcgggtggacttgggacttggccgggtcgtgaccttggagaggaggttgatcatcccgaaagtcatggcgaggagcggagggagttgcatggcactcttgggatgctgcattgttggataggctgtgaagatttgttgatgatgacgattccctcagtggtttgaagccaactcagaggtgagaatccttgagtagatctcggcagtgttcggggcactgaacgaggccaaagagatggggtccctccctgattggttcaaatccgagtcgagtagagagatcttgacaaagtcatcggtgatgaagtcgatgtcaccgaattgatatgcctagcccggatggaaagcggagtcgccggctctcagaattaatccgattgcacttgtttgcgaaaaactctacgcaacccctaccttgcttgccaactattgattctagaaatcaacaatgagaaagggggacgagatctaaagtggatgagtaaaataacaaacgtttatacaggttcaagccttcttgatgaaaactaataccgtactcttgtttcgaggattgaatccaccgggtgttgtattgatctgatgatcgagttgtggttatgcccttaagagcatctccaacaacctctccatcctactctccaagctaaattttagcaactttggacaaaaaaaatgcactccaatagaatggctatccccctagccaaaaaatagcaatggccaaagatagggtcaagctagctaaatttggccagccgttggccatccacagcaactagctatctgtgggccccaccatctttttcccttctatctctccaccatccgcacatccctgcccgtgccctcccttcctccgcctattgctgccacgcccctccttcctcctcccatgcctaccgccgccacgggaaggaggctcgccgtcgcagccggcaaggagtgcctcggcttcatcgccggcgacaagatgggagaccagcagtgaagagggccaccgctgtgcgcctcctctcaatcccgctacttcatgggcaccgaggtgaggaccctctcccgctactccggtgactggagattcactgtatccacctccgacctcccctccagcctctcccccgccgccatctcctccctcgtccgacgacgctgtggaggccgtcctaatgctcctgtttggtgctgcaaggagggcgcgacagcaagagaggctcgacgacgcacgccggttgaggaggaggaggccggtgatctccatcatcatcgccatcgcaatctgttgtccaccatcaccatctgttgatcttcatgagagtatgaagcatggggaaaaggaaggaatatggggaagaagaaaggattgtagaggctgacatgtgggtcccactgtcatagattcagagtagagagggtgaatggagaggctgttggagcaaacatcaagttagacttgataaattagatggagagttggccaaatagacaaatggagagtgagatttgtgtcgacgggggatacccgtagactggataaagagggtattggggtacgctagtacgaggatctacgtaatatgacatcaagcaggcagaaaacaaagattatactagttcaggccccttgataggtaatagccctaatccagttgatatgggattatatgatggaaaccacagattacaaagggaatagtggaactcgacaataccgacaagatcgtagtcgagttgattcgactagatctcccggcgacttggctccgataagctccggcttcgtaggctgtggtggatgtgttggcagtaagattcgatcccttaggccctcccggggggtcccttttatatcgcaagtcaactggtctccaagtatgactcggagacatcgggcccggcacgatacaataacgacccagttctgtccgagtaggattccttccatctgtgaacttccataatgaatttccttaacttatgccgaaaacgtccgtatacgcgcaagtataccatatcgatatgtgacgtatatcgaagggtagagggtataccttacccgtaaccctaacagtagcccccgacttctgcttaaatgaactcgtgaaactgatcgcgacttctgatgtcgaggttgtcgttgttctcggtgtaaggaccgagagacaaggagtgatcgacaacgccgggtgaagctcaacggtcatgagtgaatttaaattgaagtccaaaaaactgccgcgcgtaacggacccagaaatttccggcggccatctctctcctttccttagaattcgcaccgtcggaggtgcgtctatttaagagagttttggggatccaagttgaagcccgcttgttgtgaaaaaactcaccagctttcaaacgtccctcgtcttctctgctcccacaaaaaaccctagctagctcatctcggtcctttctccggcgatccccggcggaaatggatcttgacaagtctacctccaccagcgcgtcgctgaagaagttgcaggaagatggcgcccttcccggtcgcgggaccgcggagagagaagtgggaggtactgaaccccagcctgtcctgggtcgcatggttgcgatcgaggactttattctctgtggttttcttcctccgccttctgaatttcttctcttggtcttgaatttctacggtgttttcttgctccacttgaaccccaattccatcgccttcttgagtatcttttcgcatctttgtgaggcctacattggggtagagccgtttcttgacctcttccgcttttactatgagttacgctggatggaacccaaaaaggtgtccgggtgtgttggtttccgactttgggatggcctgaagtcgcgatacatccccttccagtgcccctcatctcgcagcaaatggcgggggaggtggttctatcttcagatagaggattcggatccggtcttcgttgttcctgaggagcaaccaaacaagattccatcttgggccaccaaacccgccttgaccccatccctccaatctttcatcgatatcgttgacgacctccgagaacaggggttgtcggggtatgaagtcgctgccgacttcattggtaggcggatccagccgcttcaggctcgagaccatccggcctttgattattctgggccagaggacgcgacccgggtttctcctcggggtattttcctttttagttaaattgactcccttatgcgtgtgttcctcccggcttatcggattctggtctcgatctacaggctaggagcgccgcgtcagccaacttatgatcagtggcccgacaacggcgagcaacgtccccgtccccctttgcgagaaaggggcagccgagcacgacgttgccatcaatgtaagtgtactcagcggtccttttgcatttttcttccgggatcgcattatgacttcatgaagcgtaggctctccctctgactgatatcatcgagccacttgtggaccatctggtggcggcgtcgctgaaggagaaagtcgccaaggaggcgtctgacgctgctgctgccgctgccataacgagcggcggcaacgttccgaaaaaggggaggacattctcctctgtggtcagacatcgtcggaagacgtccaccccctcggtaagttctcctgccctttgatcgcgtagtcggaaagcttctacctcacatcatatcggttgtactccaggcctcggatgcatctcccacacctccacgacggcagtggctagtgacgcttggcgagaagtaagtggttgactttgaggtcttgtcactttgtcaaactgttgcagcctgtttcagttgcagctttacgcagggcggcgcggccaaaggcggcgcaagatgggtctagagggacctccaacgcgtctcctgtcgtggtcgcgcctaggagccgcgaggcgacacctaacggcctagctagcgatcttgcggctggtcggggtctgccggctgccgttctcacctgggaggagctccaggtcgagatggggtgcctcctcgaggctggtgctcgtggcattggccacgagatcacggaggtgaaggcggcggcggcgtcgtcggcgaatgagcgtgctgatcggcttgcgcgcgatttagcggaggttcgcgaggacctccataagatgcgggagctggtggctggcaatgagcgacaacggcaagggctcaagcaccgtatgtctgagcttgagaaccatttgtcagagatccgtggctcactgcaggtcacctacaccggcatgcaccagctcgccgggtagtgtggtgtcaaggccaccatcccgacgaatcccaacgagttctcgttgtcgtcttcgcttgcggaactggcaacggcgatggaggtgatcccctccaagcacgcggccatggtcggagaggagacgtccaacgggatctataccggggcgtgccatgtccttgcgtgtgtgaggctggcgcatcctgaactcgatctgcggaagatcttggatcagggggcggctagcgatgcgcgcaaggatgtgatggaggaggtcggcgacctgggggagtccgtcctcccgctttttgaagagtaggatcttagctctcttgtactctttagccatgctttgtaaaactcttattggttcaaaccacctttgtgtgtgcagtattttgatcttgagtactttgttgtcatttgtagagatgttgatgtcgaggatgtccagcagcgcgggcagcctgagttgccagtggtcgttccgttacttgcgtccgagccacatgtgccggagggcgatgtagctcaaaattcgcctgtggagatgagcatggcaacggctcccttaggttggttatctttgttttcatccactttactcttccgtccggatcgacttgattcgctgtattcttggaagagaagagcagtctaacttagtcgtttccatactaagtagacctcgagagtgcgcttgctgaccaggatcgtcgcatccagtattggaggacgaagtttgaggtcgcggaactcgagaggactatgttggaagtgaggaaggactaggccgtggagacactccgtggtcgcgaggtgtggttcaactcgtatctgaagagttgctgtacctccatgtcaagagtctttagagagcttcgagtaccccgtggggatcccgaggaatcggcggctggatacatctcgtggctgaatggggcctgcgcccagctcgagggcatcggccagcatatcgacgaggccctgaagcaggagtgtcgtcgatcgagctgatatgccggggggcatgtattggcttgtatacgagatcatcgtccgcagctgcacctcgagttcctccacgaagggttttctcgctctcggagaactcctacggagatagatggcctagcgaagtcgatggcgccgctggcggaaaaggtcttccagtctatggactggcgttggccttcctggtagtctccgtgtcctatgacaaatgtcttaggggaaaagtgtaatataattttggatttttatggaactgtaagaagtacttgtaaaatagaaaagaaatctatctaactaagctttcttactctggatgtagcgtgtatgagtgtcttctcacttcgtgactttgattagttgtttgagttatacactctccctagcccccagcctttgacctgcctcggttgaacaagcactgatcctagcccccagccatgaagttacaaaatttatttccgattacacgacttggttaatacgcacggcgagaactcttacacgaccagatcttacatggtctgtcgtctctacaggatccgataaggccttatcggctctgggcgtccccagccgaagttcccttaggttcctcggaggccttgtcaagacggcgtaaagggacatgaggataggtttcaacgctaggtgtcatctgggtaagggatcatcgggaaggaacactttgattgtagtctgtacctgaaaataggctttattgaagttgtaagatgtcttacaagtatggatactattgacttatacatagaatttacgtaattgatcaatgttctaggaatttgccaactcgcgactatcgccgtctgcaattttgaatgcgcccggccgcagaacttgtgtgatcgtgtacggtccttcccatttgggtgagagcttgtttccccctgcttggctttgaacccgtcggaggacgtagtcgccgatcgaaagcgtgcgtgctcggatgcgcttctcatggtaacggcgaagggcctgttggtagctggctgctcgaacggcaactcgttcgcgatgttcctcgagtagattcacatcatcgtatcgctgctcctcttgatcctcatcggaatacttctgtactcgtgtactttgatgttgtagctcggtggggagcatcgcctctgagccgtacacgaggaagaagggtgtctccttgttggatgttgtcggtgtggtacgcacggcccatagtactgatggaagatcctcgacccacttcttgtcgtgtgacatgagcctgtcgtagacgcgggtcttggattccttgtagtactatgccgtttgctctctcgacttgttcattgctctgagggtgagaaaccgaggcatagcatatcttgactcccagcctgatgcagtaatcctggaaatcggcactgatgaactaggagccgttgtctgttatgatacggtggggcaatccgaatctgcagaatattcctttgatgaatttgatggtgttgtcggccttgatttcccccgtgggtgtcgcttcaatccacttggtgaatttgtcgatcaccacgaataggaacctgtagctaccctgtcctcgtgggaatggcccgagtatatctagcccccagcacgagaacggtcaagtgagagggatagtctagagtgcttgcgctggcagctttgtgtgtttactgtggaattgacaggcttcacaccgctgaaccatgtcacaggcgtctttgagggcggttggccagaaaaacccttgtcggaaagcttttctgactaatgtccgaccggcggcatgtgacccacagatcccttcatgtatgtcgaggaggaggtgtctgccatcgtcggacgagacgcattttaggagtaccctgtttggtgccttcttgtatagatcgttgccgatcatacagtagacttttgctttacgggatattttctcggcttctgcgtcgtcctcgggcaactcttcgctatctatgaatttaatgagtggggtgcgccagtcgtccgtggtctcgagatcggcaatggcgtgctctgcctctgtagcccccgagctgatgttgggggcgaccgggctatcttcgccgcttgcctctttcactgatggcctggtcaggacgtccagaaaggtgccaggttcgaatggctctcgtctggatgcatgctgtgctagatcatctggttcgatgttgtctttgcggtatacatgtcggacctcgatcctatcgaaccttttcttcaacttcctaacttctgcgagatacctggataactcggggctagagcacttgtaatctttatgcacctggttcgcgactagttcagaatcccctttcacgatcagtcgagtgcagctgcagctcttatcctggcgagtagtccttcgtactcggctatgttattggtcgccctaaagttgaggtgaattgcatgcttgaattgatctcccaaaggtgatgtcaagatgaatcctgcccctgctccttggctgttgagtgcgccgtcgaacgccattgtccacgtttcgttgtcgatttggttgtctgacctgttatcaggcatagtccaatcggctacgaagtcggcaagtacctgggacttgnnnnnnnnnnnnnnnnnnnnnnnnnnntcaaactggcttagctcgactacccatttcgcaatgcggccgacaacgtctttgtttctcactacttcaccgagagggaaggaggatacaactgtgaccctgtgggcttgaaagtagtggcatagctntcttgatgtcatgattaccgcgcaaagcagtttttggatctatggatatcttgtctttgcgtcgtggagagcttcgctgacatagtagactggtcgttgcaccttctctctctcgacaacaatgacagtgctaacgaaatatggcgtggcggcaatatagagaaataattcttcattaggttggggggcaacaagtacaggtggatttgataggtagcacttgagtgcaatgaatgcctcttcggcttcctgtgtccatcaaaatttgtcttgctttttcagcagagcgaagaaaggttgtcctcaccctcccatcctagcgacgaacctacgtagtgccaccatgcatccggttaacttctgtacttccttgagtcttgtaggcgacttcatgttcttgattgccttgatcttctcgggatttgcttctattcctctaccagagacgaggaagccgagtagcttgcccgatggtactccgaacgtgcacttctctggattgagcatgaggcgatatcgtcggaggttgttatacgtttcccgcagatcgtcaatcaatgagtcacttgtcttggtcttgacaacaatgttgtcgacgtaggcctcgacattgtttctgagttggtcgctaagtgcgccctggaccatgtgctggaaagtgtttcctgcggttattagtccgaatggcatcttaacgtagcagaataccccgaacggcgtgatgattgttgtcttctcctcgtcctctttcgccatgctgatttggtggtagccagagcaagcgtcgagaaagctcaacaactcacaaccggctattgagtccaccaattgatctattcgaggaagagggaagtgatccttgggacacgccttgatgagatcggtgaaatcgacacacattctccatttcccgttggccttccgcaccatgactgggttggctagccactctggatggagtacctctctgatgaaaccggctttgagaagcttgtcgagttcttctcgtatggcttgttttcgatctggtgcaaatctccgcagtttttgctttactggcttggcatcgggtcgcaccatgagtttgtgctcaatcacctccctgggtacccccagcatgtcggacggctgccaagagaacacgtcagcattgtcgcggaggaaggtgatgagcgcgagttcctatttctcgcctagtgatgctccgatcttgacgatcttgtcggggttggtactggagagtggaacgatcttgattgtgccgtccggtttcggcgtcttgtttgttttgctcactttcttgggtggttcagctgtggcaggtgggctaggcgtgtgcttgaccatgtcgaggctctacttgtcgcattgcactgccagcttagcattcccttgaatagtgattgttcccttcggtcccgacatcttgagtacttgatacgcatagtgagatgcggccatgaactttgcgagtgcagttctcccaatgatggcactgtatgctgtatcgaattcagcgacatcaaaggtgatctgttccgttcggaagttgtttgcttggctgaaagtcacaggcaacgtaattttgcccaatggtttggacgatgactgaggagtgatttcatggaagggttgattggtaggtgtcaactcgcttcgtgggatcctaatcgcgtccaaggtgctggcgaagagaaggttgattgagctgccgccgtcgatcagaactcgtgcgaccttgatattacgaatagtgggttcgaccacgatcggatattgccctgggatgacagcagtcctggggtggtcctcttctgagaattctatcttctgctcggaccacttcatcttgggcgcagccccctgccacatctaacagacttcacgttccaccttcttgtattctcgctttgaggagtacgccgtggaacctccgaagatgtgcgagacatggagatcggagtctggatatgctgagtctgattcctgagtaaccgcctcagcgtccttctcaaccacaagtactcgcttgccttttaccaatgccatgtgttttgcgagcgactttttgaagacgaggcaatcttctagagagtgtctgtctgacatgtgtatagggcaccatattttcttcgcgtcgctgccttgtgggtctgggcgcttgggagggtccgcgtattctgttgcgagaacttccgattgagctttccttttcctactcttgtgattcttcttcttgcttgacttaggtgcgtccttggctggtttcttctctcctctggtcttcggtttgtcgttcttgtgtctcagtgcgtcgtccgcatgagcgcatcgatcgacaatttctaataatctcctagtagtcgtgacgtgcctcgttgccaactcctgagtagtatagcgatctctgataccggacttgaaagcgcgaattacagaagcatcggtgataccggggattgtgtttctgcactcgttaaagcgccgaacataatccctcaaggattcactcgggttctgtgtcaatgcatgtaggtcgtcttcgatcgcgtggcgcttgtaagttccttcgaagttggctacgaactgctgccacaggtctgcccacgaagagatcgagtaggggaggagatgcatcagccatgaacgtgcagagcctttcaatgcggttggcaagtaattcgccaacacgttgccgtccgctccagcagcgtagagtaccgtagagtaaacctgaaggaattcttcaggatcggtactcccatcatatttctctattgttcctagtcggaatctttcaggccatcggacatctcgaagtgaacgaccgaaagctctacacccagcgctgggcacggtgggttgtcggcgatcgtatgtccttcgtggatgtctatctgatgatgaggatgaggaggatgacgatgatgacgatgggtcgcttggttccggcgcacgattacgaggacgtcggtcgggttctcgagaatcctgttgtcgtcgcctgttgtgtctcagtgccgatctccatcatcgtcgtcattatggcgacgtcctcgaccagtatcgcccagcccccgccgttcgtgatcgtcgtgatcgcggcggttgtggcggttatcatggcctcggtctttgctcaaacggcctcctcgatct

SEQ ID NO: 28726 - DNA, 6611 bp, Oryza sativa
ctatgaagagacgcaatgtcgagaatggttctcgttgtctcgtgtgcgtcgcgcctctcggcagccattcaggtgatcgcggagatcgccggtgccgcgaggtggaggggtggctcgatgaggcgattcccgccgttcagggttttcaccattagcatcgccagttggtggctgttccgggtgcgccgcagcagcggcctcttcgaacgcgttgctgaggttggtcactaactctcgtaaccattctgtccatcgtgcgagatcgtcgttcagaacggggttgtaggaagtttccctcagtattgtattgacggctctgatgtgctaggccggtgtagtcacttgattctccgcttccgcattggtgcgtgctgacgtgccgacatcgtcgatagccaatacctcacgcggcgtactcgttgttgatgaaccatagccttcgagcaggtgcaagactgatggttcgtggggatcgatgtcgattacccaacaaatcgatctgaaatcggcgtcgctccttgttccttgtcctcatccctaagggggatgcatgactgctggaccttagtatgtggtgtcttcatggcgctgaaaagaccttgcagctcgagaggttgtgattctttgtcttgtaaataggacaaaagacatcacgagttggagaggtacgctgaattccacgctctttgcaggcacgaatttcagcatggacgttcagaaaaacccaacaggcttgcaaggtgtgttttctggttttgtggataggacaccaggaccttgtcacctcggaagtaatcctcgtcggctcgtgattcctgtcggaaagacaaggcttggccgcactagaatccttctcgggctcggatgtcgtcgaagtttcgatttccacttcggcgggaggatccttcgacatggagtcgtcccgggttgtacccactgcgttctcatttccggccattggcggaccagctgagattggcactgtggtgtaaaccggaaagacgatttacccgacttgagtccacaccagtgttgttgaagtaggaactccttggttgaggttggtgttgacgctgttgtcgacgaagctggatgtcatagtagtagaaccttgagcaccaagtccccctacctggcgcgccaatatcaacgggggatacccgtagactggatatagagggcattagggtacgctggaacgagtctctacgtaatacgacatcaagcaggcagaaaacaaagattatactggttcaggccccttgataggtaatagccttaatccagttgatacgggataatatgatggaaaaaacatattacaaagggaatagtggaactcggcgataccgacaagatcgtagtcgagttgattcgactagatctcccggcgacttggctccgataagctcttgcttcgtaggctgtggtggatgtgttgccagtaagattcgatcccttaggccctcccggggggtcccttttatatcgcaggtcaactggtctccaagtaggactcggagacatcgggcccggcacgatacaatgacgacccagttctgtccgagtaggattccttccatctatgaacttgcataatgaatttccttaacttatgccgaaaacatccgtatacgcgcaagtataccatatcgatatgtgacgtatatcgaagggtagagggtatatcttacccgtaaccctgacaatttggagagactgttagagatgctctagggactccatgtcttccttatatagcttcaggggcaaggatataaaggagagaacccaattggacacgacttggttccattatacatttacataattgtatgctacaaaacgtatggtacatgtcttgggaaacacgacaatgtaatttccaaagcttagtctatttacataatatacgtatatggcccaccacctatctcccgtcagagatgctgtccacatgggtatatggtacctataatcttcaaagggcacaatggaggtaatcagctaatcaacaatgctctatgttcctcaaccaagtcgaaaacattagaaacaacaattaacatacacaataatagaattcagtaagaaaaaaaaacatcatttgatcagcaagcataagttgttttaacagagaactttttgctgcagaagttgattaggtcctctagaattggaccaaaaagatcaatcagcatgatattgtacttctcctctccaaacaactacacatgaggacttccagctgaaatttataaccaaaacataaataaaatgagtgaacaaatttatttgaattggtaaacattttttgttaggcaggatgccagtctctttgttcaccttttggaaactagtaatttgctcgtactaacgctacggtgacatttaataaaataattagccaaccaaaaatatatacaatgcatgctttagtgattaagactataatgcgcaatatagttttaagatcacgcaaaagaaaagaaagagaattagattgttcaaacatttatcaatatgatatatatacataaataggtccaaagtacacgtgttcggtacaatacataaatacctttcatcagtagtaaaacacattgtctgctaaggcaacatgttgcgcatacaccatcatccattagagcagacatggtcagtacatggctagttgttatgtaacttaagacatgttgatcttcaggatgcgtttgcacagcctcacagatttaggagaaaacatattcgtagatcttaaagcgcaaaggaggtcaacaaaatttaattggttctatgacaataatctaacatccacaacactataagaagtgatttctaaatggtatgagtaggttggtgcacagggccatcgaaggccatgcgcgagcacagtggccgcacatggctcccaatttttgagggggcccacctcggagtaggcctacagcctggcttgaattcagcggcccataagtgaggaggcaaggagttaggaactatgctagacgcaaacgagttacagccaattattacagagtaactgtttagtgttcactcacggagagacgcgagttgctgcgtgtgtgcagcacaggcggcagcgacagcatcacgcctcacggcagcaggcagcacatcgctgatgttgccgagcggagcaacgggaaacgacgagcggcgcgctgacacagagcagcgccgaggccgcgaggcccagctctagttggaaacctggaatcgataatttactttgaatcaaggctaatgaaattacactgttacagtattttcaatgatccatcattccattggattgataattattgaatcaaaagtaatgtgaacgtcttcactttttttataaaacaggaagacctcaaatcctcgccagatgatgcttctcactggaatattagatcagtactacctttactcttttaccattaatatttgaaaatatatttctatatatcgtagaaaataacacattaaagttatataattaactaaaaataacatattatttttcaaaatttagggtctcaatttgcattcgttccggggcacccaaatcctagagacggccctgttggtgcagtagtgcgtaagatgcaacttaaaccttgaagcccatgattttcaccctttggctctagaaactctagctctgaattgtcatcatccactgagatgaagagtattatctgaacattgtagtattatacccgaaggaaatgaaaaaaatgtttttttccaatgtaccggatgcacgcaaagcaatattaaataatagcaactacaattatttttttctccgagtctaaccctaccaatgttgagaaaaatagtaagggcaaaatatataaaaggtacagaaaaaaatatctagtgtcagaagttccgtgagaaacatgcttgacccttttgtatttcacaccataattttatataggctcctaaaacacaattcggatatcaagttaatcaaacaaaatgtagtatacatgaaaaaaaatcattctacattaaatttaattgtcaaaacgtgacataatatttaccctgcgatattcatctatcatctcatataactccagcattcaggtttgtaaggggcatctataaatttggtgaaggaacctatcaaagttcatcactcagctagttacagttcttataagtgagtttcgtgttgaacatgtaacggttttccgattgcaaaaaaaaaaacagagagaacttgcagaaagcaagttgagatttcattaaaaaaaagagttcaatggttgggagtagagaagaaaataaagcttaaaaatgttaatgtaattgttgaaattataagcacataatgatttaatttcttccataaataaatcatgacattgcagatgtaaacaagcatgaacgcatcattagatgcaaagtgcataatgatgcaaagtatttcagaaagtataatgatgcaatacggttgtttatcagccaagtgcataatgatgcaaagtatttcagaaatcatatacagtatttcaactcccatttatcattcacgagccttggagttacccttgaccaacgagtcagcactgtagtgggaactggtgtgtatacatttcgtgtgcacggtgcattgtaccatcgcctggataatttggttccaggttctcaagggccgcgccatatgcagctttacttttatgatacagaagatgctgatgcactagcccatagggttcgcaggtctcctgaccttgatatcaaccttgttcgggtcattgtacgtattttggcgcaaaagccgtacgtacagaccttcagcagagttggatccatgcccaatatagatgactacatgattgagctcaacactaatgtaacgcctgaccaacgaagatggggatgatccaatgagaacttttgatagacaagtcttggtacatgcaaaaggtgataagccctgttacatcaaagcataccatggttgttatgaccctttagcgtatcctttatttaaccctaatggggagactgggtggaacctgaaaatgccgtacaacgatcccaaccagattctgcgtgatgtggaaatggatgaacagtgtgacatcatctttaggtgatgtacgtaccaacgaagaaagcacttttgatgatcttccaggtacgtacactcgtggcttttgtcgaataatttctaaactttatgtccttatccattgtttatgtatattattatgtaagtttggacgcagagaacgaggttgtcgacaattatctagacaatgaagatgataatgatgatagtagtaaatccggcaaaagggaaaaaggacaagtttgtcacagcgagggagtactattgcttcaggctgcaggttagaaggtgatgcggacatcactacctcggatacacatagcaatcctcctacggtcattcaaggaccgataacaagagctcgtgcgtgacaattgaatttagaggtgagctcgttcctatgttcttctttgtatgaattcgagaatagattgctacctaatgattatattgtgattaggaacaatggaggggacaaggagacacttggggaaggacttagagccatggatgatcatcgaggacgtccaagtcaaggtggaggcccaaaccaattcgacctcgggtgcaattcggagtctaggaccagtctgcactaaaacgggcgcccaggtcgcatatgtgctcggattagggcgttctttatatatatggaaagctaagaacataacctttccaatggttttggtcccacatccaaattcttcccgagtcaatgggaattgatcgaacaagttgacgtccagaatttgtcccggtgctgcgtcaccgtatttgggcttttggcccgtgtatcgtgttggaacccattagggttgtgtcgagagggggttgcacaagcctaaactctatatatcagtacccaccgccatctttaggtttttgggttttgcttagattattctttcaagaacagtttcgccgctagatcggtttgtaagaccccaatttgtgagcttaatcattcatctgcaattttggttgttttctatctcgttcttgtttgtattctttgattggcaaacaaggattagccttctcggcgaggtcatccgcgtttcgacacgggtgataactagaggagacatggtgctgcgattgcggggctcaagagcatgcgcgttcaagaagccggatcgatttgtgttgcgactccgcccaaatcgttgtttatcagaacctctcggaagatcgggaaccctagtgcacatcaggaggggacttctaaacatcattttgttcggaggatgacttttccaacaatgggctattgatatgtacatcaaaatcgagtctatgaggcttgattggtactcaaaacctgagaagcaaaaaaagattcaggctgagctataccaggtaaatggtgtaacatatttccacaactattgacactgtctcccatctgtgattcaacataccagttatttgatcatggtgttatttaatgattgcagggcgtggttgatgtgctttcttctggagagaagcggttccgcagttggtaaga

SEQ ID NO: 28727 - DNA, 267 bp, Oryza sativa
cactcctcctccttcttcccctcgtcggcgtccaccgcgtcgttctcgtcgtcctccgccgccacctacaccaccacgtactcctcctcctccgccaccaaccagtacccgtactacgggaaagcggcggcggcggcggcggcgccggtgacgtgacgacgaacaaccacggaagtcgtcgtcgtcgtcgtcgtcgtcgtcggcggcggcggcggcgaggaggaggcccagcaggaagaaaaggtacgaaaaaaaggcggcggcgga

SEQ ID NO: 28728 - DNA, 35043 bp, Oryza sativa
  unsure (1)..(35043): unsure at all n locations
actgtcacatcaatgttgaggcttgtgcaagcatcaaatctgtgaagtacctctataagtatgtgtataaaggacacgactgtgcatctttctcggttgatccaactggggaaataaacgagatacaacagtacagaaatgccagatacgtgacaccaccagaggctatatataggatgcttggtttcccactgttcggtatctatccagctgttctgcagctccaacttcatcttcctaacatgcagtatgtcacgtataatgaggatggtaatcttgaggatgttgtaaatcgtccatcttctaccaggacaactcttacggagtatttcaaaatgaatcaagtagacccggaagcaaggaagctgctatacaaggagttccctgaactctaccgttggataaccggacagaatgtgtggcagaaaaggaaaatgaagagaggccaagttggacgggttgtgtacgctcaccctgcagaggtggagagatactacttgagagtgctcctcaaccacgtgcgaggtgcaacctcatttgaagatttgaggacagtgtcaggtacttcatactctacctttagagaggcatgcgagaagagagggcttgtggagacggataagtcacatgatgattgtttgaatgaggcatccactttccaaatgccatttgctttgcatcgattatttgcaaccatattggtattttgcgaagtcactgatatccgtgcactatgggacaatcacaaggatgcaatgtctgaagattatagccgagggaacactaaccctgcagtagtagagaagatggtgctacgagacatacatgatttgcttcattccatgggaaaggatatcacggagtatggtcttcccgaggtcattgatataggtattttttgttatactatcacgtcttttccttattaatttacatttgcaccacccaccaatagtttcatcatgcatatatttgttttcactaatcaggtgaacgttgcaacgacgtaatgacagagattatagaggaacttaacgtgctagtggatcaagaccatttagacatatacacatcccttaatgatgagcagcgtgcaagatttgatgagatcattgatcatgtaactaataaaaagagccaggtattttttatcgacggcccaggtggcactggcaaaacatttatgtacaaggcgtttcttgctagagtgcggtccaagggattaatagccattgcaactacgacgtcaggtatagcagcgtcgattatgcctggaggatgtaccgcacactcgagattcaaaatccctattaagattgctcacaatagcatgtgcaacttcacgaagcaaagtggcaccgcggaattgcttcacatgtcgtccttaattatttgggatgaagctgcaatgacgaagcgtcaagccgtagagacccttgataggtctcttcaagacattatgggttgttcattgccatttggaggaaagtttattgttttttgcagtgattttagacaggtacatcccgtggttacacgtgggacaagggcccagataactgatgcaacattacagatattgtatttatgggataatattaggaagatcagattgtcacgtaacatgagggctcaatctgatctattggtttcgggatatctcctttagaatnaggaaatggcactgaanacactatcagagatgattatgttcgcttgcctgatgaaattgtgattgcttatggggatagtgaggattcagtacacgaattgattaatcatgtgtttccctcgcttgaagatgaaaagaatgcaagctctgcatcttatatgagcacacgtgctattctatccactaaaaatgattatgtggacaagctgaatgcggatatgattgacagatttccagggcaggccaaggtttatcacagctttgactctgttgatgatgaccctcacaacagttatcctctggactaccttaactctatcactccaaatggtctcccaccacacgagctaatagtaaaaatcaattgtcccgtgattcttcttcgcaaccttgatccaaataatggattgtgcaacgggactagactaatggttagagcttttcaagataatgcaattgatgctgagattgttggtggacaacatgccagcaaaagggtgttcatcccacggatccctttgtctccctccgacgatatatctctacctttcaaattcaagaggaagcaattcccaatacgtctcaatttcgcaatgaccattaacaaatctcaaggacaaaccatcctaaatgttgggatctatcttccagagcccgtgttttcacatggtcagctatatgtcgcattgttaaggggtatgtcaaggctaacaacaaagattttggctaagccaaagaaagaagttgattcaacagggaagagcactagaaatatcgtgaataaaaacgttcttgactggtgaacaaagataggttcgcatgatctaaattaattcaaaaaaatattgaatatagtaaattgctcatcgaatgttactcaccatcgtcctcttgtttggtacagcacgccatcaccttttatatggaatgccgtgtgattatcttttacaaactatctcacactagatgcgtcagtttgcaccagactgtcatttgagattgtaaatatggtctgtattatataaagggatacatatgcttacaaaattgttctggattattatttttctatatggttcatccatacaacttaaatgaataatgcaccgtagacagcccgaaccaccgccattgccatcaccatccaccacatacagcctgcaccactaccatcaccatcaccaacgccgccgccgccgcttgctctgctgtttttttgggagaaaagacagagagggagaatagggctgacgagtgagccctacgctttttaatttttctcctatcacttacatgtgagcctcatcttgtaaagttttattgtgcccacgcaatatcatagtactgcaccttacatgaaatatattttatataggatatgaattgaattaaagttcaaatgcatcgatcatataaaaatattttttgctaacatgaaattctaaaaattattaaagacatatacaattgcaccgtagcgtttagcacgggcatgttactagttaaatttaattgtcaaaaggtgacataatatttaccctgcgatattcatctatcatctcatataactccagcattcagatttgtaaggggcactataaatttggtgaaggaacctatcaaagttcatctctcagctagttacagttcttataagtgagagttttgtgttgaacatgtaacggttttccgattgcaaaaaaaacagagagaacttgcaaaaagcaagttgagatttcattaaaaaaaagagttcaatggttgggagtagagaagaaaataaagcttacaaatgtgaatgcaattgttgaaattataagcacataatgatttaatttattccataaataaatcatgaaattgcagatgtaaactagcatgaacgcatcattagatctacacatgtaaactaagcagtaaaacatgaacagatcaaatatgcgcaacatgtcgaacacgtaccgaggtgatggaaagaccggttgctcggcaggaactactcgcggttgcgggcatcgacgagggcacgcagcacgcgagcggagaggaaggcgagccgtcgcggacgaacaggaagcagtcgcgcgaagcgcttcccaaaaaccttattaccgccttctcccggtgcaggacgtcgaaggcagaagttccggagacctgctctcccgattgccggtgcacgccagcgagcgagatggagtagtctacgagcgacggcgcagcatagagtaggaggcaaaccctagattgatttcgcgtgtgttgcgtgaagacggcggctcggtttacatagagataggtcgcttgatcagggcgcccgcacgatctccactccgcgtaaccgaacctgataagtcgctcataacctatccggactccatgccattttcacgcaccggattgtttggaatgtttccaaaacaaaacaaatctgaatcttccgcaacaaaacaaaactgcaaaaggagaaaaaaaacctgcgcaagggtgaggagccaatttgcggaccattcgacgcgtacgtcgtgcacgcgcgccgcctgccctgccaggccaggcgaggcgagcgagcgcgcgcatgtgttccccctcttctctccaccacacatgctttaagtggcaaggagggcatcctcccttttaaggaggtccccctttcctagaataagtaaggtggtactaaactccacatgcatgctatcctatgaggtgggcttttgtgattttccaaagaattaatcttcgagtgggccttagcccatccattaattccgacaatccccccaccaaatctcaaaatcccactgagatttgccttttccaatataatgtttatataccagcggttcgatggagaccaattatggttgaacatccatctagaactccaagctacacttactcacaacttgaacaatggactacgccttgaattgcaagtcttgtgcaagcaagtttcactcagagtcttacctggtactagatcgtctgtagactacccctcgggtggagcgtataagtcatactcctaggtctttagtaagcttcctagaagattcacccaaaatctccatagactgcgaccaacagtcaagctcacaaacgtgaattctttcaagaatgctttgcaggacagcaccttcgctaattaaagccagcagaactcattaaggcattgccaacctgccttgcagcaacgagagtacatgcatcttcacttagagagggtataaattggtactctcctctactttactaatggttagttcttcccaggttctaatccacgggatctccgatcacatagactgggttaccaccatagtataactcacatgggtctcaaacccatctccttcgatgcattgtctatcacgtttcgtgatagtcccttcgtgaagggatcttccaggtttctagctgtttggatgtaatccaacgttataactccggagtttctcaatttcttgacagacttcaatcgtcttttcacatgtctagacgatttcatattatccttagaactattcactttgacaattaccgtttgattgtcacagttcataaggatagccggcaccggtttttcaacaataggcagatccattaatagatcacgcagctattctgcctcaacagtagcagtatctagtaccgtcagctctgtttccatggttgacctcgtcaaaatggtttgtttgcaagacctccacgaaacaacaccatacccagtgtgaagacatatccactagtggatttgatctcatccacatcagagatccagttagaatcagtataaccctccagtaccgcaggatacccagtatagtgaagccctaattccatagtacttttcagatagcgcattactcgctcaagcgcacaccagtgatcatctcccggattagaggtaaaccggctcaacttgctcgcagcaaaggatatatcaggcctagttgcactagccaggtacatcagcgagccaatgatttcggagtattccagttgatccctaccatttctcttgttcttgcgaagcaacaagctaggattataaagtgttggagaaggcttactatcaatgtagccaaagcaattcaagatcttctccacataatgggactgcaagagtgtaatcctattctcacctctaattagcttaatgtttaagataacatcagctactcccaaatccttcatatcaaaattttgagaaaagaatgatttaacctcatttatcacctcaaggtttgtcccaaatatcagtatgtcatcaacatacaaacacagaataactccctcacgcccaccatgacgatagtacacacatttatctgcctcattgactgtgaagcctgcagatgtcaatgttttgtcaaatttctcatgccattgcttatgagcttgtttcagaccatacaaagacttcaacaatttgcacaccttaccttcttgaccttcaactacaaacccatcaggttgatccatatagatctcctcatccagctctccattaagaaaagttgtcttaacgtccatttgatgaacgagaagaccatgtgaggctgctagggaaagtagcacatgaattgtgttcaatctagcagcaggtgagtaagtgtcaaagaaatcttcgccttctttctgagtatagtccttagcaacaagccgagccttgtacttttcgatagtaccgtcaggcctaagcttcttcttgaacacccacttgcaccccacatgtttacacccatagggtcgctctgtcacctcccaagtcccgttagcgataatggaatccatttcactacagacagcctccttccagtagtctgcatcaggagatgcatatgcttctgaaattgacttaggagtgtcatccacgaggtacacagtgaaatcatcaccaaaggacttagccgtcctttgtctcttactctttcgaggagcttcactgacatcctcctcagtgatatgttcatgtgtatgttcagtttgttctggtggtgtgattgaaatgggaattatttcaaagggttggctcgaaccactatgtgtatcattcatagggaaaaagctctcaaagaaggtagcatcacgagactccataattgtactaacatgcatgtcaggtacctcagatttaactattaaaaatctataggcaatgttgtgatgagcatataccagaaagacacagtccacagttttaggtccaagtttgtgcttcttcgttattggtacattgactttcgtcaagcacccccatatgcgcaaataagaaagtgatggttttctcccaatccatatctcatatggtgttttgtccttatttttgttaggaactctttttaacacatgattcgaggtcaacaatgcctccccccaccatgccttaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcatttgagaaaaactctcaagcacgatcagacctaagtctttttatctttctgtcaagttgattttcaacatctaccttataaattttaaaatagtctagagcctcgtctttcgttttcaacaagtacacatagtaaaatctagtagcatcatcaatcaacgtcatgaaatatcgttttccacccttcgtcaacactccattcatttcacaaagatctgaatgtaggagttctagtggtgccaagtttctctcctcggcagccttgtgaggcttgcgaagttgcttcgattgcacacaactatggcacttagaacctttgacaatggaaatcttaggaattaaacacatgctggaaagtcgagacatcaagctaaaattaatatgacataaacgtgagtgccaaatattagcctcatcatccacactgccacaaatatgattcacagacttattgcagaaatcaaaaagggaaaagcggaacaggcatccgcactcataacctttaccaataaaatatccatgtttagacacgactactttattagactcaaaaaccaacttaaatccgtctctagtcagacgggagccactaacaagattcctgtcgatagaagggacatgttgcacgttcttcagctgcacgatctttcctgaagtaaacttcagatctaccatgccaacaccatgaacagaagcatgtgacccattcctcattaggacggtggaaccccgtgcgacctgataagaagaaaacaatgagatgtcagcacaaacatatacattggccccagtatcaacccaccaattaatagactgattaactgaaaaaacagtaggtaaattaccatacctgcttccatctccagtattgccaatggtcacattagcagacttagtctgccctgcaggtgccttcatccccttgcgttgtggatacttcctggccagatgaccaggttggccacacacaaagcaagtcctctcatcctgattaggattgttgttgttcttcttctccttcttgaagttggtggtctattgagctttgtatttccctttgctcttgttatgggccttgtgcacaacattggcactggacagcccaccatcgcccttagacgcagcatctttttcccaagctttctcctcaacatcaagagacgctatcaacccctcaacggagtattcttgtctcttgtgtttgagtgcagtaccgaaacttctccaagatggaggtagttttgcaataatgcacccggccacaaatttgtcgggtaagacacacttaaggagttcgagttccttagccatggtttgtatctcatgagcctgttcgactatagaacggttgtcagccatcctgtagtcatgaaactactccatgatgtacagatcattgctagcatcaatagcaccgaatttagtattcagtgcatcgcacaactccttagcgttggtcatgtgcatatacacctcgaccaaacgatcgccaagaacactaagaatgtatcccacaaagagagtagtggcttcctcgaattgcttctgctgattagcagtaagaattccttcaggtttaccagtacacatacagaagcatttcatagctgttagccacagagtgatcctgatctgccatctcttaaaatgcacaccggtgaatttatccggcctcaatgcatcggcaaaaccagccatagtaaaatcacaacgcctataataaggttttattgaaattataagcacataatgatttagtttattccataaaaaaatcatgacattgcagatgtaaactagcatgaacgcatcattagatctacacatgtaaattaagcagtaaaacatgaacagatcaaatatgtgcaacatgtcgaacacgtatcgaggtggcggaaagaccggttgctcggcaggaactactcgcggttgcgggcatcgacgaaggcgcgcagcacacgagcagagaggaaggcagccgtcgtggacgaacaggaagcagtcgcgcgaagcgcttcccaaaaaccttattaccgccttctcccggtgcaggacgccgaaggcagaggttccggagacctgctctcccgattgccggtgcacgccggcgagcgggatggagtagtctacgagcgacggcgcagcacagagtaggaggcaaaccctaaattgatttcgcgtgtgttgcgtgaagacggcggctcggtttatatagagaaaggtcgcttgatcagggaaaaccctagattgatttcgcgtgtgttgcgtgaaggcggcggctcggtttatatagagataggtcgcttgatcagggcgcctacacgatctccactccgcgtaactgaaccggataggtcgcgcgtaacttatccggactccatgccgttttcccacaccatgacaaaacactgcaaaaggaggcgtacgtcatgcacgcgcaacgcctgccaggcgaggcgagcgagcgcgcgcgtgtgttcccctctcttttctccatcacacatgcttcaagtgactaggagggcatcctctcttttaaggaggtccccctctctttaaataagtaaggtggtactaaactccacatgcatgccatcccatgaagtgagcttttgtgattttacaaagaattaatcttcgagtgggccttagcccatccatttaattccaacggtaattacagggaatgaaattgtggtgtaagcattgaaactatcagtgatgcacgggttaacttgactattacctgtaggttctttgctccatcactaactgcatggctactgagtcttgccaccagtgccagcgagggcggtcgctgccttgcctatgagagtgtgagagagagagatcggggagagagaagggaggaggcgagaattgagaatttaagaccgatagtgagagcttcccaaaaaaagtgagagaagggtgaggaataaaaggcaagagagagaactcgacttggatcagtcctgcttttatgaaaacccagtagagcagatacaatagcaggctataagccagctataaatatattttaaagagataaagatagagagagaagagcagcgggcaacaaatctgtagccagctacaacacggactccaagatgtaatgtgtgtatgataggtgggaccagatattaacagtatattaagcaactattgtataaattggttattacattggctatagatggtttggagctagcacacatcaatgcctttctaaaaagaaccgacattgataacatcagagccagttattctaatgaattggtattggtatttttgtctcatcaataccgtttttttaagctgacactggttggttgcgtggggttctgatgaacgggaaccactattggtgtaagatttagtcgaacagacactaacaagggtattagtgaaaaacatatctctatctctatctctactattataaaaattgaaaatgtttttgtcagattatttggaccatcgtcttagaatctcaatcgctcccgttcgtcgtttttcttttcagcattcgcatgcatttcctttttttcttaagtccgtaacgcatagcttagctccgtatcagtgggagagcaccgtgcaactgtgcacctggaaaggcccacgtgtgtgtagggctgcatcttctatttttaggcccactcatcctgagatgtctattattctattatataaaggaaaataaatctctactattataaaaattaaaaatattcttgccgatattttggtgcgtcatccgtgtatgagtcggttatatatatatatatatatcaagcgaactcccacagtgaatattatcttaactaaaccatataacaataataaaattaaaataaacttcacccgttgtaacgcacgggtatttttttctagtctacttaataattattcaaatttaatatttcataaccctggtgctatttgaagtttgaactaatttgcagggtagcagaaataagttgttgctgcaggagcagaagagtgaggcctggtttacactactacaaaacatcaaataggtgtcaccactataggtgccggtagtgctaaaactggcacctatagaccttttcccacctctgcgggttaaaatcgtaaaaaaccgacacctttaagtaattataggtgccggttctaaataaagtcggcacctattctattttgtgttagttttttttaaaaagggaacctttagtattaaaaaccggcacctataataaattataggtgccggtttatgtaaaataccggcacctatgaattgagtcgagctgggatgagccgagccagcgggccccaccacgaagcttcgaggagataaggccgctccgcagcgctcgtctctctctgtctctccactctcttctctcctctcggtgcctgtctccactcatctcctctcgttctctccgctctcttctcttctctttctcctctcccggccagcggaggcggcggcgggggccgcgcgctcccctccgcaagatccggggaggggcggcccagcggcagcggaggggagggaggatgcggcggcgggatgagaggcagtggcggcctggcgacggcaccctcccctctcgattccctcgctgtccgcggcttgcggaggcggtagcagcggccgcgccctcccctccgccagatccggggaggggcggcccaacagcgttcgcagaggggcagcctagcggcggcggaagggcggggggatacggtggcgccctccctccatgagatctggcgaaatgtttcttaaaagatttgtgtgaaatgatttgtatgatgttcttcaatgtttcttgatgttagtgaaatgatttgtgtgaatgacttctatggttggggattggggattagtgaaatgatttctgtgatttatgtgaatgtgttgtgtgattggggattggggattggggattagggattgtgatgcagggtggatgagctcgatgcatcggctcaaatcgagccgatgcatcgagcctttatttttttttgctcgcgagtggtatcgaaggttctggtttttaaaataagattggtgccggtttaatgctgccttcatagtgccggttgggaaaaccgacacagaaaggggtttctcaactggcactaatctcgtgtcctgtggtagtgttagctcctaacttattcttcaaacttccaacttttccatcacatcaaaacttccctacacacataaacttttaacttttttcttcaaacttctaattttagtcaaatttctaattttggcatggatctaaacacaccctgaatgttcagattgctaccgctacagagcgagttgcccaaatactccttccgaaactactgtgttcaaaatcaaaaagtacaataaacataggagcagtgtgtgccattggaatcggaatcggaatatataaaggggcgcgagttgggcaagcgaggacgggtgccacgtcaggattttgctacagtatgtacagtgcgcgaggtggtatttttgtgaaaaaacccttcgatttccagataattcaatcgaggtccctcaagaatagtgcctctgaggtgtttattgcattaaggtccttatagaattcggatattccgtgcatagaaaagaaaaatcgtgaattaaaaccgcgttgtaaaacttaaaacatgaggggctttttcggaaaaatggctcacactaacccacccaccccatgccctagccgtataggtgtccaaacgggcggcacgccccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccggcagctgagctgcactggccgccaggccgccaggccgccagccgccaggccgccagtgcacagtgttttttaaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagtttttaaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattttactggggttggtctggatccaggtagagttgctcgaactgggcggccaattcttggttgtctgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacttgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgacagccgtatgatccggtacctcctccacagatggtggagttggagccgatccggaggtatcgtcaaacctcgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttcaaattttgtcaaaataaaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccctgctttcggcctggcgcgtgtgccgctggcccgctttcggcctgacgggccgccggtgaaacgggccgtgccgtgccgcgggccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctacctagccgccgccgcccttctcccctcctccctctcgtctcaccctctccctctccctctgccgccgccgagcaccgtcgcctccccctcgcgccgtagccatcgtcgtccccatcgccatcgcgccaccgccaccgcctccacccactctgccaccgccgtcgcgtcgccgtttcggagctcctccaccgccgcctcgcgctgtcgccaagcgcagctatctctgccgagcaacggtgaaggcgggcacagccttcatcagcgacgaggtcggacctccgacgaccacgccacaggcggcgcaaagagctaacggcccagatcctggcatcgggagccacgccgctgcgcccgccgatggtggcggcgaggaggaggaggaggccccgtcgccgcgtccgtctccgccggttgctacaccttcctccgatcctcgtctcgccgcggcaggcaccggcgccttgactcctccgcctccgcttccggggcggcgcatgtggtcagggtggaggtggggacgacgaagggggagaggagcttgttcccctgtcgacccggccgtgctcgaggccgggctggtgtggcgcctcctcgcgggggccgggcagctgacccgcggcggcgcggtggcggtcgccgtgnacgctttgctgttcgagcacctgtggtggctgcagcatacgccgacttcgtccctcccctcaccatcgtgggtcatcaattcccctagcagccgacccctcgcgccgcccgactccgtcgacgtcatccctcccctcgccatcgtcggccgtcgcgccgccaccccaccgccgctgccctcccacgcagcaggtccatgccgcaagacgtccactggccacaaccatcgctgccctctcctgcagcagatccacgccaccggccgccgccctcaatcacaatgtgatttggaggtggagaagcttggtgtggtacgagttcattttcaaatccgctaccctcgatgacagcccaggctgcggcttcttcgccaacaccagggtcaaccttgccaacgacatgtgagttagcttcttcctctctacagagatttctggtgatttttgtttaggcggaacaacgactacacgttgatgcggttgctggcacaggcggacgccatcaacttcatcttcttcaccaagatggacattggtgggttgttgtgctgccttcaattatgcagggttgggttggactctatgagggtttcgagggcgtgtgcattgctgaccatggctgcgggtggtcctcacaccaacagcagcctgtgactccatgaagtatcgtgtctggatggatggtgagtgactggctttcttttttaactttctgactagccctaattgccacctaattctatacattcacctgttcatccagcgattccagaatgtggcagtggcagtgcggcttgccttgatttgatttgttgtgctccacgattatcagttcagaatgtcagataagtgaaggttggttggttagctagcaggaagttccctgatcattctgttatttgtcaaaatgtgacaagcatactgatctctttgttttgtagtgtggtgctacctagctgggatgccggtagcgatcgctgtagtggccgcggcgacgattgcttcttccttggatgggagccaccgttcgccaaccttgctgctgccgacgctcgcatatccttccctgtctgtgtgccagaggtaaacggcagtttcttcctgttcttccaccgtttgtgctgatgaatgctgtgcattccctccttgtttgagctcggccatggaggagtcactggtatctctgggctggcggtgctagaacagtacacatggtcgcgttgccgagggagctggacggccttttcagggtgggttcctgcaggacagggcaaagatgatggttttgtcgaggaatttctgtgatgttatgagccattatgttgatctgcttctgtttcccttccaggatttgtgggatgcaagcaacagcagcaacagcgaccgggcacgtctgattccagctatgttcagcatcatgtatgggaaggtggggatcagtgccgacacccccagttctacctccgattctttcttcagtgatagtcttaatagctcttgtgggcagtcattgataggcatggtgtgtacttaactgcttattgaaatgatcaggtttactttccattcctaccggttcatacattgttctgctctaaatattttcttttattcgaggggataggcagatgttcgcacaggcatggggcaatccggtttcctttctattttgtttgtattgccatggtgcacttcgttggattgtggtgttctgtgtagttttctactatatttaggtttaccacggcttgttgtttactggttgtaagaaagcacataagaaatgaaacctgaatatctggattgatgggtgatgggggaatatttatgtttctgcttaattggatgggtttgatttctctgtcaattaatattccgtatacatagagcctcaatttttggtagagggagattgtcaatgctcttgcctcgctcgctatagatttcctttctagataattatagacatgttttgttagtttatatatgtgttggttggctgttcctatttactccgcatgcagaggattgttcaaggtgaaagaaagagcatggagattctctgtgtcgtcctatctatatttggatcctattttatcatgctcagtgtttttttgttgtgcaatacctttggcttttattttcgtgccaaacagttttagaattggttcagacatccttttacttctatggctgcaatgaggttgcggcgtgatggagaatccttcttgatattataggtgcagaggcttatgcgttctttcctttatcaaaaaaagatagagttgttcttaaaaaggcactgcccatgttctcttttatagttctctgtgtatttatcgctatgggaaaaaatgatccgtgataaaaaaaattgttagcttgaacgtagagtgtcaacatgttccttaggtgctggtcactacattttgttatttaaaggtcggtgtgataggattcctttatttctggtagatgttcagttatatatgctattggtagagtgcctgcagaaacatagagtgttccagtttcatctattttgtttccaggtgctcatgcagcattcgatgccgcttttgctcgttcttactggtgtttgcatgttggtttatgtccctgtgtttctgctagcatggtgcattccattgccttgtggtaccctatgtgattttctatttcatttctgctggcatggtgcattccgttggcttgtggtcccctgtgtaattttctattatatttacctttgctgcagcttgccatctactaattgcatggaagcaaacaggagataaaattttaatatctgcgttgatgtgtaaggagtggatgtttatatgcgtgtttaattggatgggttggttccactgccggttaaggttttatatagataaggcctcaattgttggtagaggaaggttatcagtgtctatggttcacttgttatgcatttcctttgtggatgattatagacagattttgttaatctatatatatatgttgattggctgtgcctttttattccgcatgcagagtgttgttcaaggtaaaaagaaagaaagtagaaattgtctatgtcgtcccatctgcttttggattttattttatggtgcccgatgttttttattgtgcagtgcctctggcttttattgttgcgccagacatttttagaattaaccgagacatcctttcctttgtttcctgtatagtttcaaatcaaatcaaacagacatgtgcatcaatcatccaaggtatcaatatcagctatcagcctcacaccagagcaattactatttctgccacttccactgaaggttatcctttatcatttctcatacaactattatttttgtatatctagcccatcttatgtgcttgtttcttcatctagagatacacatatataaatgactgtttattccaaccatccaccacatgcagatacatcagacacttcttccaacactaaaactgatctatcatctgataccccttccaacaccaccatgacaggtaaatctaatccttgttttatgtaaattaattaaatttgttcacacagtataatgaagatcaaataatctcgcatgataaaactacatggaaaacaatcatgccaagcttcgtataatgttgtcagtacattttactcacactgaccttcttaaaaaaaactccgccagctgacacctaacatctattttatacttatgcaattttcacttcacttacagtcattacaccctatctagcagcttgaatactcctcagctagatctcttaaaactccgtcctaagttttttagatgctaatgtaccagttgcagcctgcaaaaactctcttcatcagcaacttttaaatgttcattcagttctttcgcaaacaatgcaaatactaataggagtattttcatacaggcagcactaagcgtgcgtttaacgagctgtgtttctgtgcaaagaatgttgatccaacagctgacttgaaaaagtatatcgaagatcttgagtgcctagaccgttcaagcaaattctatgctgttgctgtgaataacacattcatgaagcaggatagagttgtaagttcctacatctgctactcatttatttatatacaccatacatggctatctatcttaccaattatgagtcaaggctgatatacaatgccaattacagtactgtactaaagaattttctcaagactacttaaagccattaatggaaggcaaggaaaccatcagcattggagttcaaattgcaggtggtgtttcaaagaatatgatcctccatatgtcaacggatggtcgatgcaacctgaagaaaggatgggcaaaatttgcaacccacaatcacatatacctacaatcactatgcaccttccatttctacaaaacaactcgcctggaagccaccttcgatgttctataaagaacatagcaatactcatggctatgttgcagccatccttttgctgccatcaaccaggttgatcactgtcaagataacatgtattagttctaggccttacatggtaatcatggaacctcctaatatgaagaaccatctatatatgtacttactgctattagagacctctaaatatcaagatgcctgtgtgcaatttgtactgtggtttgcttctatgtaagacacttcctcgtactttcttgaccctggttgcgtccaggcggcatttcctcgtactgtcattggcgcgcccctagctctagtgtgatagtagggtggactttctgtgcccaccggcactcgcttgcacagccacaagctataccgacaaaaacttcagggaagcagctagaagtcaaaagttctcttggagtcgagagatccttcgactgttactgatcatcttcacttttacttttcgcttcaggctgtgtttagatttaaacttttttcttcaaactttcaacttttttatcacgtcaaatgtttagacacatgcatagagctttaaatgtggacgaaaaaaccaattacacagtttgcatgtaaatcgcgagacgaatcttttgagcctaattatgtcatgttttaataatgtggtgctatagtaaacatttgctaatgacggattaattaggcttaatagattcgtctcacatgtagtttacaggtggaatctataatttgttttgttattattttatatttaatactttaaatatgtgtccgtatacttaaaaaaatttaacacacaaactaaacacagaaacagaacctaatctggagagatgcctgtttgcagatgtcactctggtacgagtgcgacacgcagtcagtccagtacacataagagagcaagaacaggtgtccaccatgtgattgatcagtgcgccccagtacaccaaacaaaaacaatgatcatctgatgaaaatgatgttatttttcgttgggctggaacacaatatttttacttgagcgatcgatctatggaagttggaatatcgttctcacagggcagccaaatggcagcacgctctgagaattttcacaactcgatcgatcacagcacagccgaacttacaataggaattgaagctagctagagaggagaggaaaaaaataagaatgtgccaacatccatgcacgatcatgcctcaatttctaccctagcaagcaatgcaacaaatcgcaatgcaagcgcgcctgcctcatctcatctgatggaggtggcagaggcggaggcgaggacgccgtggaaggtggcctcatcgcagggcagggtgatacccatgtcgtggtcgaagccaaactcctcctcggccttcctgagaagctcctggaactctggcgccgcaaggcacgccaccggcacgatgtagcgtctccggctgatgccgacgtacacggcgaagtggcccctcggcacgtccccaggcagcccatcgtcgtcgccgccggcgccctttatcccgaggctggacgagcacctccgcagcatctgcttgagctgccccggcttcttggaccccgtgatcgccatatggcgccggtcgatgtccaccggacgtccggacggttagtgcgtgcagcagtagtagtggtacgtcgagcagcgagacatcgacctgccacctgcggaatagcgtggtatttaagggggaagggtgggagacacgcgggtgcatgtgggcgtgggctcgctcgggcacacggcggcagcggcacggccgggtgggtgttagtagtagaaggctggtagctagtgggtcgcgcgcgaggtggaatgtacggtcctaccacgctactgcctggcgccgatcgcgcgccgcggatatggctgatttctctactccggtttcgcggcctctgggagcgtggcggggtagggaccgtgtaccgggcctaccggcacgggtgcgcagggcggtatgtggcgcatgtggacgttgtcccggcacctgctacgccagaagccgttgctgcgtactgtactaacccggttgctgcttctctggagagagggataacaagggagattttctgtcttgcgcggtcaattgattgaatgattgattttgattcgggcaggacggtccttttttgggcgggtttatcaggccacagaaggctagctagtactagctgtctatactgattgcaggatttccgaaacaccatgttctctacactgccaatctgcgatgttcaatgaatctactcccaaattgcatctgggaatgtactgcttttcgggggttgctggctggtgatcagtagggaccggaaatggtaggtgaggattgtacgtaacactgtacgactgtttgtactcctcgcaagttgcagccaatgctcccaaaaaacatttctttatgccatatttcaaatacagtaaattaatcacttttgggctgtcccttttaaagaaactaggtgatgcgggaattagtaaacaatgctcaatttgtttttcaagagaaaaaaaataataaaacatcagggtttatcaatgcttatcatgaaacaaacaaatgataccccgtattaatgtgaaacatattgataagtatatcttaaatattgtaaaaatgatagatttgttaaaatattgtgcaaatgatgtgaggggtgatgattagatatacttacatgttgatttataaaattaaataaattgtagatgatgttgtatgcttgataagaatatgtaattattactagtgggtgataatgtgatatggttgcatgttgagctttagacttagtgggatataactttatagaaagtacatatgaaagaatacatagataggcacgcttctcaaactactaaacgatataattttaataaaaactttatatacatatgaatttattaaaaatctgtttaaaatataatttcaactttataataattaattcattctatggatctgtttgggggagcttctagcagctgcagcttctcctagaatctccagtagccagaagctccctccaacagttcagctttttacccagattctgagaatcaatctgtagtcgtagaatctagaaaatgaactagaaaccaaaagctgggttttctagcttctctagattctcaccagctagcttctcagcagctgcttttcataatgttaagctcccccaaacaggccctattccatttagaagccgcgtgcatatagatactatagtatccatcctcccttaacaatacaatcactggtggagaagaagtttttactcccggttcgtaacccccctttagtcccagttttccaatcgagactacaaatccggaactaaagatcgctatcgttagtcctgggtgaaataaccgggactaaaaatctatctttaggactaaagatattgcctttagttccggtactaaagatagagccaggctgatcccggctgctcctttattctattcttttcttcattgtttttaatatattgatttcactccatccccatctccaaaatcccaaatcaattatcacctccaaatcctcaaatcgatcatctccaaatacatcacaaaatcttaaaaaaaattacatcacaacttctaataaattcatcacatattcacatcacacacaaatcaaatacatctcagatccggatcacaaattctcaaaaaaaaaaaacaacaaaacaagccgccatcttccgtctgccgcccagccgctgccttccgccttccgccggccagcgccgcgcgaggccggcgccgcgcctgcagaccggggaggaggggggagggggaggagaaggagcctcgtgcggcggcggcgccgcctgcagatcggggaggaggggggagggggaggagaatgagaggagggagaggaggaggggatcctccgcgtgtaagatagcgaggagaaggggatcggaggagaggagaagaggagaaggggaggaggagatatgtatcttgatcccgcacgcctcgatctctgtgcgcatgccgatctttttttccggttgatgttactaaccaggactaaagattgattaccaaccgagactaaagatcaaaaagtacctataacctttttcaaccgagacttaagataatctttagtcccggttttattgtaaccgggattattatggaatctggtcgaccgaccaaagatggtttctccgccaatgaattataccatgttcagacacgaatattctacaccgctcgattattgagtgtaccgatgataatgagcaccatctttgctcttcaacttatcaaacgtgaccatattataaatttgattttttttcatgtttttaacattgtttaatttaaatatataaaagtttgaaaagaaattcattttttcccttaagctatttcaccagagcactcgacctctaaacaatttttgttcttcttttacacctcaaactattggagatggtcctacttaatccctaactgcatttctctttttcccttcctatatattacttcttctgtttcaggttataagactttgtagcattgcacatatttatatacatgttaataaatctaggcgcgcgcgcacatatatatatatatatatatatatgtatatatatatatatatatatatatatagattctttaacatatatatgaatgtgggcaatggttgaaagtcttataacctgaaacggaggtagtagtaagtaatattctcctataagtctcgacactatttataattttttttatcatcattgttcgcatggtttggaagctccaaaagactgatctaaaaatcaattgctctacaaaactacagcataaaaatatatagcttacatagaaagttttgaaaagaaaaatattattatggataaagtaaaccattttcaacagtttagagtaaaatgagcaaataaatagtataagggttaaatgatcccatgaaataattcgactgaataaaaaaagttttttttttctaaagggacataaattaattttttgctactaagcattgctgcctaataattaatgacagataaaatatcgtaaattgatcgatttaattgcatcttttagataatggaaagactcccggcctttgcttcagagaagctacaaccattccctaaaaaaaaaaagaacctacaaccacttattacatagttcactcaataaagagcacataaaaactaggaaatgatgaaacaataactaataactcgaacatcgtttattcaagtccatttggaaatatacacccaaagttagcaaatatatacatgaccattgtttctaggtttcagcacgcaatatatattagtttcttgtcctcgtcacatctttgaagttgtgcccagaaccgaaatcggtacgttgcccttaacaggacctgcagataagatttcattaatgatttgttaaaaatcatatcatttttacaaaacaaaaaacccaacatatagcagatgcccctactagaataagcttctttgtttttgagtcaatacctttaagccaatttccatcaatatgagaagtactaactccatcccaaaataagtttatttttacacataccaataaaaaacaaaaaaaaaacagaataacccaactttattaaatcccaatgcaactatttctcactttatcaaatcccaatacaattattctctactttcacaaactccaatgcaatgattattctaaaaacaaacttattttgggacaaatagaagaagcttaaaatgaacctactacgggatagaggaagtaatttttagaggttccaagccacaagaaatatgtattgatctccaaagaaatttagcaaaatggtactaaaaactgataaatagtttcacttttaataaaaaaaaagttatattgctattccaattccttcatggtaaattatctttagttaatattacttctttaaatggtaatacacaaaaatgtttattttaagaagcattttaatttctataaaaatatgtttctcttaatatggtcattatttattaaagccaagtgcatagaacaaacccaaaattaacaaatttgatgaagattccatctaaatagtcaatatcatcattcaattgaatatgcacaattaatattggtcactaaatcatgccaattttccaggttctggcctaccaataatgcacttttaaagaaaccatttagtggaatagaagtcatgaccgttacaactgaaacatttctctttgagcaatattgtagagaattggatatctatccataaagtagaggaaatatttcctaaccattatccttccaatatcttacttgcttcccatcatttactacccatgatcctaatttttttaataaaattcttgacctttatgaggcttgaccaaaaatgagaatcctcttgttttctcttaacttgggtgactgtattgttttataaatatttttctttaatatgtccggccaaatatctttctaattaatcagtttaaaaacaatttgcttaacatatatttattatgatttctattttatgcacccctagtctatcctggttctttgattgagcaataatattccatcttgctaatctatatttcttttttatcatctcctaaaaaatacgatctataataatcactttaattgcatataaaatatgattgtatcaattatacactaccagcgacgtacgtcttactttctactagcttgtggtccactctagtagtacgtatttatttaatttaagttcgattgctgttcaataaaggtcccgcattatctaatagttttaatttagacaaattttacggtacattgtactgcaaatatatactaccagtacattttatctaacggtgtaaattaatctgatttttctctaaattattctgcaatataaattaaatagggtatatttgtcttttcatctatttgcgtggagggtaattttgtaaattcgcatttcctcacttagtcagatccggtcgataggcgcccagtcaaatccgctgctgggggaccgtgccataggcgcacagctgcggcagctcgcagcggcaagggcagccgagcggcggcaggtggaagtagcagggcggcatgcggtagcagctgggcagggaagccccgcggcggcgatagcctataagtaatgcaaaaatcacaaattaatatttctactagacaaggactcttgtccgaccatgacgaccataaaaattcacaaataaaccaattcacaagtgtttgtagagaattacttcgagttgaactaattagagataggtttaattattgcttgtgtatccattgtcccgggtgaaataaccgggagtaaaaatctatctttaggactaaagatattgcctttagttccgggactaaagatagagccaggctgatcccgactgctcctttattctattcttttcttcattgtttttaatatattgatttcactccatccccatctccaaaatcccaaatcaattatcacctccaaatcctcaaatcgatcatctccaaatacatcacaaaatcttaaaaaaaattacatcacaacttctaataaattcatcacatatccacatcacacacaaatcaaatacatctcagatccggatcacaaattctcaaaaaaaaaaaaacaaaacaagccgccatcttccgcctgccgcccagccgccgccttccgccttccgcctgcggccgccagccgcccgggcgcgaggccggcgccgcgcctgcagaccggggaggaggggggagggggaggagaaggagcctcgcgcggcaccgccgccgcctgcagatcggggaggaggggggagggggaggagaatgagaggaggaagaggaggaggggatcctccgcgtgtaagatagcgaggagaaggggatcggaggagatgagaagaggaggaggggaggaggagatatgtatctcgatcccgcatgcctcgatctctccgcgcatgccgatcttttttcccggttggtgttactaaccgggactaaagattgattaccaaccgagactaaagatcaaaaagtacctataacctttttcaaccgggacttaagataatctttagtcccggttttattgtaaccgggattattatggaatttgatcgaccgaccaaagatggtttctccaccaatgaattataccacgttcagacacgaatattctacaccgctcgattattgagtgtaccgatgataatgagcaccatctttgctcttcaacttatcaaacatgaccatattataaatttgatttccggcactgatgatagtctgctagttacgaactgacactgatgttattttctgtagtagtgattattgaggaaaacacagaccttttcgaacgctagaatactgttctcctcgctagaatctatacgcacgaatgactagaataaaaccatgaaaaatagatggaagaatggcggaatctattatattattaaaacagcttgtgttgacaacgagtcacagctctacaccttaaacacgttgtgtgcaactcgtggtggcaccctaagacagaccactgtacggagtgcgtagatgtcgccgaacgaacacccgggagaggccccgtcagggtggacgttacaccggtttattttcgactcggcaggccagttagaacgtcctctaactctgtagagacgagagacaacaagcaattttgagattggaggagaatacatttgggattggtagtaagaaggagggtgatatagaatatagagggtttggatactaaatagatttggacaattgattggttgtttattcaatcgatcttagcccacttatattaataggaggggcgggattccttcccatggttttttccacgtccaattaggtgtagaaaccaattaagactctaaaatcttaggctttagcaagaaaatccgaggaccgacaaatcagacttagaatcggactccgttggtttgaccggccccctaccgtctatctgactggccagatggctatggtcagactgacctcacgtgacaagtctttgcatgtctgggttattttcaaatttaatcatggttttctattattagtgtaggagcaaaatttggattaacgccttgaaaggaagcaccatgttcattacggaggctaaaaactagtgagaaaagaagacttcgactaggaatacatttagaagtaattgaaattcgaaataaaaaataaaaataaataaaaagaagagttcatgtaaaactcaactaaagagattggactaatccaatgtttaggggtcggagaaggagcgatggcggagagggcgattgggcggcgactcctctcgcaggagagttcatcggcggcgagggtctctccggcgacctcggcggcgctcagagacggaggtaaggttcaaggggcgggatccggaagtttgaaagggcatatcgcgacaaaattcctcgcgggaggggtttcgcgctgcttttcggaagtttctggggaagggcccaaggagctcatccatggcggagggagattgggccatctagcccatccctatagccggggttttggccctagactttcacgtcagctggcacatctggatcggcacctgaagcatctgtggggatcgaatcctcgagagctagggtttagaggggggtggagaaaagaggagttgagggaggtgaaggcggcggcggaggagtggccgaggctaggaattggtggcggggaatcgaggtggacaggtacgatcaagggagatacgcgcagatttgagaaggttgttcgaggtcggattccagcaatggcgcaacaaggagggggttggagagggcgcttccaaccaaggccagcgttccatgggaggcgaccgctaggagtggagcatcatgggaggcaaggccaggagggagttcgagcagttcatccactaccagggcgcgctgaagaaaagagggatgagcaagtctcggctgtggcaaccaaagaggggagtttagtgcagcagatcaagccgatgcagatgcaggagaagaccgaagtgggaattactgtctcaaacctcaagcaggatgaggcgaaagctgaggttgcagcttctcgtcctcctccccaagcaaacccaagacatggtatgaatccgaactctcacagaatcttttgtgtgagatgcaaaggtgttggtcacttggttaaggattgtcatgttgctgtgttttgtgtcaattgtgctaagcctactcacaagactaaggattgtctatatgataagcaacccagacctattgccaagttggtgagatatggtgctccagggcttggatgtatattgattcagaacactagatctgagccagcaaaggaacacattaatcctttggcaatgatttcaatcattagtggagggggattaactgtggcgcaattggaacaaggttttactcagcagttcaagtggaattggatatggaaagcaaaagaaattcctaatgggacctttcaaatgaggtttcccaataggatgaggtttgatgagctgtcaaactttgatcactttactgtcaaggggactaatgtgcaggttaatgtcaaagaatggacccaagaacctgaagctgtagggaagatgcatacagtttgggcaagagtgacaggtattccggatgaaatgaagacttaccctgccccttttgaggttggttctaacttgggactagtgatggaagtagacatgattactttcagggcaaaaggtctcatcagaatcaaggtgggtatgatggatttggaagcccttcctctaaaactaattctgactacaccaaaagggctgctattccaggctcagtacactttggaggaagtggtagagcaagggtggtttagagagcaagtctttgaagaggataaggaagctgtctatactccaaccaaggtgggatagagggaggaaaaacaacatgtcaatgaggggggagaacagggaccaagtagtaacaagggtgtgtatagggctgggaagggggatgaagttgtgctagtactggaccctggattgacaactgaatctgatgtggctaagtgtgttcagttccatagggacagagatttggccatgaagttgcaagatgaggagatggaaaaacaatctgctaggattttggtccaagaaggaaatgtgattctatctaaaagcaaaggggctgggaaagggtctgagatgtctgaaattcccattgtagaagagacacgtgctggagatggggctttatctagtggtgggacaggaactttaagctgtttggaggtgatggctgagactgaattgggccctaggggagaagaaggagaaagagttaacttgggagacagtgaggatttcctagattcccaagaatctgaaggaaactttgccaagcaagttggtgtggttctgactgaagagggcatcgacagtcaagaagaagacacaaggagaagcaagagactgagagataaagaagacaaaaaaccacaagacatggcaatggaaaggaaagaggctcagaatgcctttattaacaaaggtcaggcttcaatcccttctattattgatgaaccaaatagctctctcatgaacattgctaatttgttaggagttagtcttgggtgtgccttggttgatgttgattctaatcttcatctaataaaggatatggagaatgctagagtcaatttgtttatgaaaaatcaagaagcaattttagacaaaactcaagagagcaaatcaggagattttcctgaactctctggcttgggagaattatactctttagaagatgatgtggactctgaacttgatgagatcgaaaatttgattaaaaacatacacacttccagtgggaaagggaaaagaatgaagggaaaccttgacactgttaaggtaacacccatattaggtaagagaaaagggaaaaataattctaagaaaaatgattggacttttttggaatattaggggaatggggagtcctgaaaaaataggtcacttgcaagacctaatcaaggatcatcatttagattttattggcatcattgaaactgttaagcaggaattttctgctactatgttgggtagtcttggaggtggtaggaatttggtttggaggtggatccctgctaatgggagatcaggtgggattcttgttgggatagattctgataggcatgatattttagatactagctttgggaactatcatgcgagattgaagttacaaaaaatagatgataagaggtgttgggatcttgtggtagtatatggggcagctcaatacgcacaaaagaacaactttttggctgagctagccaatgttttatattatcagaacagacccttggttgtaggtgaggatttcaatattctgagaaaggaaagtgaaaagaataaacctaggggatacaacaaatggagtttcttatttaatgccatcattgagcaatccaatctaagagaggttggtatggggaatagacagtatacatggtttaacaaccagattcagtccactctagaaaagtagataggatttttatcaacaatgattgggggggtgcttttcctttaaccatggctagaattttagtgaagactttctctgatcatagccctgttctgatgagaactgagggcatttgttaataaaaaacatttgttcagatttgagttaggttagttccttagggaagacttggggagtgtgataattgatgtttggaataaacagtattctggcaatagtattgagagatggcagaaaaaactcagggcgcttaggaaaaaaactcaatgggtggaacaggaattgggagggtttatataggagggaaaaagaaaacattctaaaataaattgatgccattgacatcaagattgaagcacttggtatgacccataagtatagggaagatagaaaggagttagaacagaaactagcctatgttataagggaggaaaaatggaagtggtttcaaaggagtaaggttagagaaattctagagggggatagaaatacaaaatactaccatgcaaaagctaatgggagaagaagaaattgtcaaattcattctcttagtcaagaggaaggagaaattgaggggcaaagtaatttgctgtgttatatcactcatttctataaaaagttgtttggtcattcagttgaaaactctatttctattgaaatggaagggatctgccaagttactgaagaggataagaggagactcactgagcccttctctatggaggaaatcaaaagagtggtctttgaactgaaacaacacaggcccctggccctgatgggatacctggggaattctacaaaaaattctgggatttaattaaaaatgatttgtttgaactccttagtgatttccaaaagggtttgttaaatgtggaaaggctcaattatggcatcatcacccttgttcctaaaacaaaagatgctgcccaaattcaaaaatttagaccaatttgcattttgaatgttagcttcaaaattataacagaggttctgatgagcagaatttatcatgtgatgtgttatattatctcaaaaaatcaatctgctttccttaagaacagatatattttagaaggggttgtcattttgcatgaaattttgaattctcttcatcataaaaagcaaagtggcattctcttcaaagtcgatttggaaaaagcttatgacaaagtgaattgggtttttgtgcatagaatgctagtctctaaaggtttccctgatcaatggtgtgactggattatgaaagtcattaagggagggaaggtggctgttaaagttaatgatgagataggtcctcttttccaaactcacaaaggtctgaggcagggagaccctttgtccccattgctgttcaatttggcagctgaagcacttactttactggtgcagagggctgaggagcactctcttctggagggtctaggtaataatgaagaaaataagatctctattttacaatatgctgatgacaccatcttcttgctccctgacaacttagaatatgctaggaacttgaaatttattctttgtctgtttgaacagctttcagacctcaaaatcaattttcataaaagtgaggtcttttgtataggagaggccagagatagaaaagtgttgttcagccagcttttcacttgtaacataggtgatttgcctatgaggtatttgggggttcctattgatcaaaaaaggattctcaataaagaccggaaaactgctgagaatacaatggaaagtaaactgagctgctggcagggcagactccagtcaattggggggagattgattctcattaattccagtctgagttatgttcctttatatatgatatctttctatagacttcccactggtgtgaaggaaaggatggatttctttagaaggagattgctctggcaagaagatcaggggattaggaaatatcatcttgtacagtggcctgtgatttgtactcctagagatcaggagggtttgggtgttctagatttggatcttatgaataaagctcttttaggaaaatggatttggaaacttgagaatgaggacgggtggtggcaggaggtgttgagggataaatacctgaagaagaaaacaatgtctatacagaaacctaaacctggtgattcccacttttggcaaggtttgatggaagtaaaggagagattctataatttttgcacaaagaaagtgggggatggaaggtccattatgttttgggaagatagttggctcgggggcagacctctggctcacttattcc

SEQ ID NO: 28729 - DNA, 607 bp, Oryza sativa
cccttgcagtggcagacatgttgacttcatcggctgcccgtacgtcctcacggagcgtgtgggagggcatcaccgggacgcacgacttcgaggtggtcggctactcgttgatggacggcttcggcgccggaaggcacgtctgctccggcgacttcagcgtcgccggccatgactggtatgtgcgttctaccccgatggcctcgaccaggattccgccggctacgcgtcggcctgcctcgcctaccgcggcaaggagaggctcgtgagagccaagtacagcctgagcttggtggccagggacggcagggcgtcgccgctcgccggcgacacgctgcggtcgcactacttcacgccgacgagccgcagcgccgacgtcctcaagttcgtcgagaaatccaacctgtcgtcgtcgccgtcgtcgtcgtcgtactcgtgcctcgacgacgacaccctgaccatacggtgcgtggtcaccgtggtcaccggcccgcgcgtggtgagcgtcgcgccggccaaggagagggcccccgcgtcacggtgccgccgccgagccttcacgagcacctggcgcggatgctgcgcgacgggcggggctcggacgtggcgt

SEQ ID NO: 28730 - DNA, 27436 bp, Oryza sativa
  unsure (1)..(27436): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgctgctagagagactagattaagttctcctcgcaattatacctgtgagagattgattatataatagcaacaccggcttgtccatctatttactacaatctcgtgcatactttagtaccaacaaatctcatactctacaaatacggttgtcgggtcccgtcgacacgtaccatttgtcccttactcattctgagattttcggaattttgcacgacttcatagatagtggtctgaacgaggtactagagcttggaacaatgaagagtgaaattgttataggaactacaatttcaattcctctaagattgaaaaaaaagaaataatgacactcgagctctaactcaccttcttgtcaatgtttctttagtggatagaaataatgacactcgagctctaactcaccctatatagctttagtggcctttaccagagacgtaaaagcctgtaatgcaaaaggtagattcgaaatttcatatataacggttagaataagtagcacaatttgcaatttgcaaaaataaaaaaaaacatgagttataactcattaatagaagggagagaggcactcgtaggctgcaatggagtatgttcttccgtcgataggagtcaacaatgtaacattaaggatctttgaaaaataatgtattaagaaattttagcacataatcaaggtacaggatgctagaactatgaaatatttctcaaatacttactatttcactactacttgcgggctgcgtagttgctactcttttcaattccttcaaaacaagagtagtgagcttggtgtagtttgtcctaaaaacaaaatgtaggagcaatagaataatttagaatatacaatagtgttagcagtttgtaacatctattaggcattttttttccaaatatatgaataatacatgatatttgtgcagttaataggaaatggcagtcaggccaactaataatgttaggggcaactggcaggtagatatagacggggggcattggcccctagtcagttctacaccaagcgggggcaaatgccccttatcaatttttattttcttattctacctaagtaataaactcttcgttccacccattttacttcttacatccacccatgacagctacaaatctacaatcatcaatgttaaactctactaatcagagctcatgaacttagaaattaagatcaaatactaatatctaaacccgaagtcttgtaggtatctactatgaatatatcttgtccagtaggaaatcttgcggacagatcttctgctttgcttccaccatagtgatgagtgaattaacagccttgttaaattctttttaccaaattttgatagaggaaatatcgctatgcatagaaatcaagtgtatcatgttagtcttatcaaactgaatcgtcacgctgggaatctaaaagttgctagttataatagatgatggcttgcattctagatgcacatactatctgcacatcccctagagcatggctgatgcatttcttgcatgtattatagtgtcactgcgacactacccaattgcatacatatgctcttctgtgagcttagcaaatagattagcaaaggaggataggagcggatggggactccgggcacccttctccttccccttccccggcccgaggccggagagctcgccccgcgccgtcggccgcccatcactgcgcctggctcagcagtgcctcctccgttctccctccctgctctctctctctctctctctctctctctctctctcgtgcccttagcttttgagctagcacccgtagcactaccgaacgcgcgtgtacgctgccccgagcccctccgccgcccggcatggcctcgccgccattgccgtccgctcccggaggccgctgctcgtcgccggccctccttggtactccttcgtcccatccggcgccggaaacggattccttgaaccccggagatgctcccacccctttgaatcgaacccccgttgctccggtgaagtttcccccttttctcgccgctggcgtgcgccgccgcgatccgtcgtcgctggcctccctccagcgaatccgatccggtggctcactccctctcatccgtcccatcgttctggtgtactccctctctctcgaatcgtcgcgacgagctccggtgaactcggccgccgtctgccgtccatctcggcctccccttcttcctcctcccaccgacccacgtggctgccacgtaggcgccacgtcggcgccacctcggctttgaccgggccaagccggtcagccaccccctccctccgtcttccttcccatgtgcacggtccacggagagcctaacggctgcgcgtgggcctgccacccttcggtccacccggtgcaccagaccgtgcgccactcctacccgaaccctagcgcgcgccgcatgcaccgctcccacggtgagccgcgccactgacaagcgggccctactcgggaccctgcaaggtggactcggcccaccggccctccatcttcctcactctccccgtgccccttgggccgcctcttcgggccggccggcccattagttcgaccgagctgcgcctctcctctcgggccgcgcccaagccgcccgaggaagtctaaatcacatccctccttcaatttctttccaaaaagggtttaataaactattaaatcctttttcctttgattagaaaatcaatatctctctatccgtaactccgattgactccgttcaacttccagcaattccgtaaaattgagatctatctaatggcactattaattagtctaaataggatcttttgggtcttgtgtaggtttttaattgtttgcgtatagttgcggttaccggattttcgtcgatcgtggatttctcgaagattcgtgaagctcagtgaagaccttgagcaaggcaagtcaccctttgatcaattgctcctataattggaaaatcattattactttgtttgcaacttgcattattagaatcacacacttaatttgcttggcctcggtttgcgtgccaaaccgacggacctacccagtagtcgcactaactcctgtaggttgtactaccctgattccttgttgctccacccttgtggtacatcagtatccgtgctctctgagcgcgcataccaaatatcccacatacaccgttgattgtcgaaaacttgggaaatgggtttgtgaagccttgaaaacccgacatgtgatgtcggtgtgtttgaaaaataaaatgaattgtgaaaactcacgatgcgggagctgtggctacgtggcgctgtcccgtattcgcatataaggaccgattcctgtgggaaactcatcgagcataatcaaagtgcaaccacaaggtggaatgggacaccctggctaagttaactagtcggttcagggaaacctcacatgccaatagttgggaacgccggggcggggtcggttggagccaaaccgggttcctggtaaggcaagaatgagaagcttgctaacttaccgatcgagatggttggagtttgatttgtgaaaactaaaatggcctaaatttatgtgaggatttgatccttctatgtggcatgaggtatccctgggtcggtttgggaaaggctttgtcgcgaacctctgacaccggccagtgtctggagtaagttcgtgtattgtgggtaaagtgtacccctctgcagaggttaactaactgttcgaacagccgttcccacggtcatgggcggatgtgaggtggttcccgttgcgtagatttgattgcctgtgctttgcgaaaagttgttgtggaatgggaatcgtaaccagaatcagcctatgtggcagatggatgacctgagtggtcagaaacgaatctgtgtgattcgggatgtcagcgggcatcatagactaggcttcccaagtggaagcggattgctttgctgctgggcagctggactctgggagtccgcaaaaatgaaaaagactctgggaaccgcctaatcaagtgaaatagctctgggagccgataagtaatgatctgacccaggaggtcggtacattaccatttgagttgttgaaaagcatctcttaagtcgaatcaagacgcaagtcttcttttgacccaaacttaaaaagaaataaatcgcttagtgatttcaaaatgatttcaaataaaggatttgcaaaacaaccttgcctctcttccaagcttgcattaaacacctaaattcccgtgacttgctgagtacgaaagtactcgcccttgctctatataaatatatatagttcctccgccttgaagagaagatgaagcgaagtgaagattagggtttcgtcctggttcccagccatcgcctgtggtgttgggtgttagttcgttggttccgctgctgctgctgttggtgtttcctcgtccgtgtcgtcggttgcattctcgggctgttctgagctgcaacctaagttaaggtaaataagtcctctattttaaggattgcaatgattcatatttgtcaccgtgcgtaccagcgctaagtcctaggactggtactgagatcgtggtttcgtaggaagcggttcgcgccgttttcctacgacacgctcctgtcaggtgccgttgtacggtagtaccggattggggtgtgacaagaaatttccacaataacctaaaaaggtaaaatgaccatctaattattctgggtatgtagtctaaacaagtactgttatattatttagggtcttattgctacgagttctaataaagctaaaggtagcccaatgcatggacataaggactcggacatgaacttgaggtgggaaaaattaggaagtattttcttttgtgaatattcaaaaggcttgcatgtacacatgtcaaaatgtgtttgggacctggaattcgataggtggggtcgtggcctcatggggagctgtgttagtgattcagtgtaagattgcaaatagatgcggaggaatgtgcaagacaacagagttcacaaattatagcaccgataaaattttgagaatcggagatggctggagttgataaacaactcggcaaaatgatcaatacacataggtctatttaatctcctcaataatttgcatttgtcttaaaaaattaaaaactggtggatccacctacatatttgagagtcccgactccttttttttgcccttccctctttatctcaaaatttcgtcccccaagccggtgccaagtggcatccattactaactgtcttaccaacccttatagtcaaccgcctctctagctcctctgccttcttctctgaccgtcttgtgctagatatagatggccctcctcctgtggtaaggatgaaggcaaatagaaagcatgcgaatgttgatcttgcaagcggcacaactaggcaacagcggaaggacgtagccctaagcacaaccaatcaacattgatgccccttaagtgctttggtcaaaaaacaaatgaaaggagagatcaggaaaccgttatatcgatgtggccaccgtcctgaaacatccagatctctccctctcccccaagctccccccatctctctctccatatcaaggcggtgatgggccttgggaggagcccatcaacagcatccctttgtgagaagccattgaaatggcttctggaccgcaacaatgaatccttctctacctctccatatctccatcttaagactgtagtgggcctcggggaggagtttgccagctgtgcccctagggacaacgtcgtccctcgaatgctttggtacaaagtgaagagcagagatgaggagaggagaagaaaggaagggatagataggtgtaggaagatggtcataggcaagtaggcctaccattctttattattatttttgctgatctaacggccacttcatcatataaacaaaaatcacctcaatttgtgcaaggggtgaactaaatggttttgatagttgaagagggttcaatacccagttttaaagagtacgggtattatttgatgaaaacaaaataacgaaacacgaataacaggaaacccaatattttattagtcatagatgagtgtttacaaatagacggggttcccataggagtctgcattttgatttcgcgaggatagtttatatacatctgtatgacgtgcaatctgctgattcctggcacctagcaacgaggcgatcaattaattacatttgtaggaaaaagcctatcgaacaccttcgattaaactgtgctcatggtcatcgccttcaaaattaattgctcgtcgaaggttgaggttagtgtagatttaatggtgaatatagtgaatgtggaacgggtggttcgccaaaatctgaaaatagtacactatcatcacgctgatgtgtagaggaaattttgtgaagggagtgacttttgcctcgtcaatgccttgtcacgtactccagccttcatcaaatatggtctttgtggttgcttttgcctagttgtgccttgcaatggtgtatccatttcccatccattttggacgtgttaatagtatagtgacctagcctcgtcggtactcggccatggtttcatatagcatcgttagtgatcaacacaaggtacattttggtggttgcagttttgtcagcttttagctgagatatcgtcaggtcttgtcagtctcgcacatagtgtagatgatgattgaggccatttaatgtcatcgacactcgaccatgatgtcgatgtgtgttttgaatatgaacgccttacccttgtggctagcgttgctttttaaagaaacaatcttgttattttcaaggaagaattgctcccgtgtgtgaacatgaggcaaatatcacagtatagcttaatagacatgatcaatctaacaatagtgatcgactttgttttagtcgtcaaaagatcaaatagtacatctgcagtctgattgataggttcagacatgcttagtacctttgatcaagcaacttgctcaataacaccaaccaccggcactggaaacggatctcgtcgaaaccatcgccatcggtgtggatggttgtatttcgggatggtacacctcccgtgtgtgacacagactggtcatatttgtaatccttctaaagtcgaagggaatgcacctatgtataaattatggttggtccattgccaatgatacttaaactccacccaagtttatacaagtgattactcaaaacccgcaagatagattatacgatttaatgccaatgaggccagatgagccttgtatttgcccacacgtacacaccgttgatggtaattagctcaacgatgaacaatgatcatcttcttagtgaagactacttgatgagggtttcatcgtcgagattctattcctcaatctcttggtgaagatcagtagatgagaatttcattgccgggatcttgttccttgatcacttgttcttagggtgtgttcgctacggccagctcccaacgtgcacacagtacgtgcggaaaacggagcggtctattagcacgtgattaattaaatatttgctaatttttttaaaaaatggatcaatataatttttttaagcaactttcgtatataaacattttataaaaaacgcaccgtttagcagtttgaaaagcatgcgcgtgaaatacgagggagaggtgttgggaacaccagcatcaaacacagcctagtgaagtccggctgatgagaatttcatctcctgaatattgtttcttgatctctactatggccgtgtttagttgcctctaaattctcaacttttcatccatcgtatcacatcgaaaactttcctacacacataaactaccaactttttctccaaactaccaactttctctcaacttcctaacttttccactatctaaatacaggctattaagaccggctgatcagaattttatcgccagaatcttattcctcaatatcactcttggtgaagactagccgataagaatttcatcatcggtttcctttatctctaagtgaagagttgccaatgagaatttcatcaccagatcttgttcctggatctattaatgaagacctaccgatgagaatttcatcgtcgggatcttgttcccacagcttgacttttctgttagccgggctgcacgcttgctcaacgctatggcatgtgtgttggctccctctacgtgccgatgccgggttacacaaatatatacgtgcaacactatggcgttgcttgtgctatcaatgatgaacagttgatgaagatgggctgtgtatatctattatggatgtagaggccagattttaatctattttcaaagaaaaaaaaagttgatgaaggccggtgaagatatcgttgctgccagtgacctaaaggatttggttttcatttaggctttgggttgagatacgctccggtgctctctacttgaagtattctactacaagtagaattaatctcaaccgttaattttataggataaattagtaatcttctaatatagtttaggggtaattttggcatgggatgttttcttcggttgttcgcatcaggtccgacgcatcgcatctcgccccgacgcaagcaccgcatctctccccgatgcaggttttcgctactcctcccggcaggcagcggcacgacgccgctgccagcggcttggtgtggcgaaatcctcaggtggccactcctcccactcctcacccgtgtatccgttccccttcctctcctctattccatgccggcatcccggttcgccgtcgtggccttccgtggaggagcacgccctcaccggcgccccctctgtcctctgtgagtggccgatgctagtctgcctatttgctcgctgtctcagtggtgaacatgtcttaaatttgcctgtataaatgcatatactagcttgtaaatggctgtgtataggaaaaagtacgaattacccccctccgaatcacaaaaccagatattcttcacccccaactatgcataccggacgaattacctcactcgacccaatccgcggtggttttggtctacgtggcgtacacgtgatagtccagtcaacattctatttataaaaaaattgtgagacccacctgtcatacactactctatcttctctctcactctctctctctctcttcctctctctctctcaccgtcccacgggtcagcggcggcggcggcgcgtgacgcggaggcagcggcggcgggggatgaggagctcggcgcggcttcccccctccctctcggtggcgtgcgcgcggggacgagcacccaacgaggcaaacatccattcctagatccactcgcccacgaccaccactcccccgtctcgctctcgctgttgccgtgctgagctctgaggtgagctgcttggtgggtggaggggtgggtttggtttggttggtcgctggttggcttggctgcgtaggtgcgcaatgcagtgagggaggtgggtaagggggggagggagagatcaggtcaagcgggattatagggtgcgcacagtcgcggatcgagaacgaggaggcggtggcgaaatgcaaggagcggaggcagtggatgaagtccgtcgtgcaggcacggaacgcgttcgcggcggtgcactcggcgtacgccatgtcgctgcgggacacgggcgccgcgctcttcgagttcgcgcatggggagggcgtgctgccggcgcccccgcccccaccgacgacgacggggccacgggggaggaggcgcgccccgtgggatcatactagtactgcagaaatctctaggcaatcaaccattcactctgtttttatttctggagttactatcaatctaaccatgttttcagatgttaacacaacgttattgttcagcaaatactcctcttcaccgagctggagctgtagacaggatctgaaatcttctgaattttatttagatattgaaatcttctgaatatttgtccctgtcatgtacagcacgagaagttgcagcaatggaggagacctcatcaggggcagcagatcgctctctgtatcagaaggcagcagcgatggttgcctcctacacggagacgtaccgcagcaagcccttgtccttctggctgctgctcgtcctcagcgcgtgagcatcccggcgtcgagcctcctgtcgcggctgtactacaacaacggcgggcagagcaagtggatcctgtcgtggtccgccgtcgccggctagccgctgaccgccactactggaaaactgatctttgctcggtcgcccaaagccacaatagtcccggttacaaaaaaacccggtttaaaaccccgcagcattatacgatctatagtcccggttcatccctgtcagtcccttgtcaaatgggcaaaccggaactaaagatcaccattttagtccgctgaagacctcttagatctttactcccaactaaaatcacgcatagtatataatctctattctctatcctctcccccacaccggcctcaatctcctcaacaaccggcctctcctctcctcagatccatctccctctcctcctccccctcctcctcccatgcccagcaagggccgcctcctccccctcctcccttcccgcacgccccttcctcctcccatgcccagcgagggccgcctcctccccctactcccttcccgcacgcgtcaggcggctggtggggccgcacgcagcaggcggccgtgcacgggccgagtagcgagcggcagcaggcggtgctaccggcatccattcttttttctttttttttttacaatttgtgattcactgagatgtataattttatgatttgttgtatggatctgagatgtataatatgtgatgtatttggtttgtgtgtaattttttaaagatttgtgatgtatttgatttgtgtgtacaagtaacttaagatttgtgatgtgaatgttttgggatgttagtttgatttggggagaagtagagagagaagagagagtagtgtatgacaggtgggtcccacaacttttttttataaatagaatgctgactgaactgccacgtgtacgccacgtagaccaaaatcatcaaggattgggtcgaaggggtaattcgtccggtatgcatggttgggagtaaagaatatccggtttatggttcggaggggtaattcggacgaccgtgatagttcggggatactagctcgtacctatattagagaatctatatttgcggatgttaaattgaactggagatctatcttaaaactgtttttttaggctgactgattgcggtggacgagagtcaatggctcgtttaggataatgataaattacgataatacccctacgcgaattattatctctggaacaagtatatccctctacgtttctactatcactaactcaggcggtaatagaactagatcttaaccatacgattaaatacgttaatggctcggattactttctatcacaaatagaaagcaccggagtagggctcgttttattaatatctgtagaatagaatatgtatgggtgtgtcataggtttaacaccgcacagggcgcttcatgcgtagcgcctggcggcggcatcgcgcatgtgcctcagtgcttctacgcgcatgtctcagcccctcgcgagcaggggtcctttgtataggcagagaatatggcaaaagtgtgtgttaatcctctattacattcaggtagtcacacgttataattcctttggataaagagaaaatctattatatacgtctgaaatatagctaacctcttatatacctttgaattttgcttccttcattacatacccacaaaatttgattttgattccttctatattccttccgttagttgatcattaattgaccatcccattgctataaaatgactattttaccctttggatgaacataaaaatttatgaattacattattgaaaatgcaatactttgtcgcatgaaactattatagttatgagtttgctatgtgatgacaaaatttagttttagataatgaaataaaaaaaatatgtttttattttattttttaaaaaatcataaaaatgaggagcattcatacaaagatagaactaccaatgctcataatattttttttatgaatgctttgaaaaaaatccattgtcctattataatttcaaataaaatttttaatttattttattttttattttcaaaatttatgtcaaaattttctatactagttatttagtctcattagtttcataaaatacacatactgtgtatttaaataaaattttcaatcgtttttcaagcttatattcaaacgtaaatcatcgagagcataaaaaacatttcaaccaaacataacagaaatgaaggaaaatgtaacggcaaaagtatagaagggatgaaatttctgagatatagaagggatcagctaaatttttcgatcgtcacctccaactttcgtccatcatccgcatcagacctttcgtcctacagcgcgtgcatcaaccatcgctagcgagtccgtgtcgatttggtccgtcgtcctgcctcatccgtttcggcgccatcctattttttttttttttgcctaaccatcatccgcgagacatgacagattagaatctgtgcgtgacatgaccaatcggacgtgatcggtcggacgtggccatgcggcgttaggctacccctttgaagttggaccccatggacgtctgtctgtcggaggatgctacgcgtcggacgttcgatattttgtaaatatcggacgcccgaccctacactgtcgtgcgcatacatatgcatatatacatgtgttctattatttctactctagttgattagctcgtgtaaaaagtctatatgcttgtgcatgcatgactgttgtttatactctagttgattagcacgtgtaagaagcctatatgcttgtgcatgcatgactgcatagttactatgcagtacttgtctcaacctactttttattttttttaaattaaatttccttttaaattaattatccgatttatgattcgatttcaccattaaactccttgcaattaaatctttacaacaagatctcagatggttatattttgatgagaaaaaaataaacattgtttcaccacttgtaaaaaaatgtttcaccacttggtcaaatgttccaactcagtctataaaatatttcagacaaatacaacattcaagaaatactaaatgcaacaccgataatgaatgtatgaaacattgagtccccatgagtgagacataaaaatcttggtcaaatgttccaatttagtctataaaaatgtttctgagaaatacaacatttagaaaatactaactgcaacaccaataatcactgtatgataaattatgataaattgagtctcaatgagttagacaaaaaaaaacttggtaaaatgttctaactcagtctataaagtgtttcagagaaatgcaacatttaagaaatactaattgtaacaccaataatcacggtatgaaacattgagtctcaatgagtgagacataaaaataaaaaaacaaatgacataaaaacccatatgaaagatataatatatttgcaaatatgaaatattattaaaatattttcatgtaattataaaacattaagttattacatctgaaacattataaaatacaaattggaacattgaaaaaacaatatgtgcaacatttacatatgtattagcgaaacagtactagttgacacatttaaaagaataaaaaatattttttcatcggaatatagccatgtgtgatcttgttgtaaagatttaattgcaacaagtttaatagtgtaatcggattgtaaattggagaagtaatttaagaaaaagattatttaaatataaaaatgtatacgtgcatcggtgcatgatttggtaaagtgctctacatagagcaagggagtagtaaagtgctttgcatggagacaaggcagcggatagaagcatgcatgtgatgagataatgttacgtccgatatttcattggagcgtcggacggccgatgcgaagcattttcactgtctgttcgatgtttcgtcatcgtaggccgtgtttagtttcttccatattctcaactttccatcacatcatatcacatcaaaaacttttctacacacgtaaacttttaacttttttttttcaaactctcaactttttttaaactttcaactttttttaggaattaaacacaccctaaggcttgtttagttggggaaaatttttgggttgagttgtcacattggatatgtggacacatatttgaagtattaaacggagtctaataacaaaacaaattacatattccgccaggaaacaacgagatgaatttattaagcataattaatccgttattagcaaatttttactgtagcataacattgtcaaatcatggcgcaattaagcttaaaaaattcgtctcgcaatttacacataatctgtgtaattagtttttttctatatttaatactctatgcatgtgtccaaacatttgatatgagagcgtaaaaatttttgttttgagaagtaaacagagccttagggcttatttggcacagctccagctccagctccagctccacccctcctggagttagagcttagccaaacagcttcagctccacccaaactgggagtggagttgggtggagctctctcacaaaatgtactagagttgtagagctgggttttggcagctccacaactccacttcagactcaactcctaaagttatatttaggagttggagctctaccaaacagtcctagtcctagtatcgaccgatcgccgccacagccccaccacctgccggctgccacggtcgtcccggcggctcccccgccgtcctacctcgctaactcgatctgtgcgctagctctgtacgtctctacctcccaacagtggttccttcggatcctcctagctagctggccagtccgggcgctctccccctcgatgatgccttcctgcagtctgccatgccctagcctctgcctcaccgcaagttctggcttgccgccgacgccgacgcagacgcagacgcagccaactgtgtgtggttgcgaattgcgatccgtcatcatcgtcttgactctagcacctgccggttggggcggggtaactcgatcggttccctcattccctgatctggtgtacggcatctcgattgtccttgtggccttaacacagtattaattctgtttataatgttatactgttagtattaatcttttctttacctattataatattataagaattataaagatgattttgtactcacccctcccttcatctgtcatctaacaatccatgcgggagtcctgatctgctcacgatttttttttttgcgtgcataatctgttttggatcaggctgtccatttccttgcttttcgtccatcgcgtgcaagagatcgtgccctgtgcgcatcagtcacccgttctagtgtgcgccggatcgtgctcgtgtgtctccttctcccgctctcgcgccagtcatcagcttgcatatagagtttggccaacctcgataatatctggcgcttgttcacataccaagatcttgtagccggcgcacggtgatcggacagaagcgtcaagcaacacgacgcggatgtggcatgtggccgtcgactggccgttgcgtaggctgtcaagaattttctgtgcaactccaacgaactcctcccggattcgggattcgttgtcttggccgctatttgcatcaccagcatctcgtagccaaaggtcttgatccctgttgttgacttcgcttgcatcacctaggtcactgccattgctcagtctcgatccatcttttctgtagcctgtagcaaaatatcgatctgatctgttgaggatgtgagtttgaagagataggtgcagcacattctgatgattccccccatatcaatattcttgttccaatttgtcttttcgatctaaagtctcaaatatagtgtttatctcaattttgatgaagttctgggcaaatattgttctcggtgtgtctgaattttgatgtaaaattatctgattttggtgaagttattgacaaatgttgttcagttacgtttagctaaatttttagatcaatctagctgtacaatttcaaattatgttcatatttaagcctcgagagataatgcaatgttcatggctacatctaatcggagttagacctgttgatgttcgtcattcatatctaaaatatgtgaaaattcaagttgggaaaaattcgtgtcaacgcacttttgtcaaaacactaccaaaaccataagttcttcatcagacaaatagggctaaatttacaaagccttgcatgtctttttaccactaagtcatcttaagaaaatgggagtaaacctgagcattagttcaaaaaccaagataaaatcataactgaacataaaaacagagttaaaaacagagttaagaacataattgcctattgtctttttaaccaagagtaaaaactaatgatgctacgttctgcattatgatatggtcaaccaaaatagccatctcccattgcaacgcacgtgcatatttacatattaagatatcaaaatttatgataattttatcatctctaagaagatatcggaatatatcatgttttctagtataatatttagtatctttagatactaggtatattaagatatcaaaatttctagtgtagaatcttgatacctccaagaatctactctgtactcttacaaaatactatagtggtggactggtggtgtactcgtgttgagtctgccctcgtaaccaccaactaacatgtaagcctgtgagattggtggatctcacataagcaatttaattgccagaaaatcgccttttcacataaatagaggcaaaatactttttttcttactaaataaataattgcaacgcactgatattttgctagttttcaaaggatcgtaaaatttttccacaaaattaagtttagagacagcttgttcgctacactattttttttttttggagatagttaccttgccctctagccactggcacttgtttgatggatgactagcaaatttcaaagtcgtgatctatagccgtcctctttccgtttgaatttggaaatgaagttacctcgcgatttcgtgaaatatggaggtgacattgaagagaaaatttgataggttgatatttatatgtgctccgttcatgagggggcagttgccgcgagagagatggcggcggcggtgctgaacgccctcgcgccggcggccccgtcgcgcagctcgccggcgcggacgcggcgcggctggtgtcggcgatcctgcaggcggtgcgggcggcccggcggaaccggagggagtgccgcctcctggcgcggcgcgcgatgatggtgggcgacctgctgcggctgctgccgccggagtcggagacgatgcgacggccggaggtgaggcgggcgctggacgggctgggcggcgcgctccggcaggcgctggagctcgtggaatcgtgccaggagagcggcgccgtgcgcggcttgatgacggcggggaggcaggcggagcagttcagggaggtgcagggcgagatcaacgactacatgctactcttccccgtcgtcagccacatcgacatcacccgccgcctcgacatgatttacggcctgctgcttcctgcagactctcaaccccaccaggtgaggtgattgctcttcctaaatgacatttatcgaaaaaccggggttaaatttttagatatcgttgattcaattccacccctgattcctctatgatgtaaaattgttaatccctaggagttactgtaccattttacaatccttggtaatttctgaaatagaggaatgttagttgtgatgaaggaatcgtaggctcctagctttgccagcacaaccgtttgggggaattgactgacagagaaatgccaggggccttccgattaactccacaaggtggtggggcagtgggttaaatgtcctgggttcaaagcctcaccccttctaattatttgatattaggtcattccctattatttgcgtcttttttttttttggaattgactgaaaaggcatcagcgtgggatctgacagaaaagttcatatctagtggcttgcgaaatcctataggaggaagaggaggctactaagtcgagggccatcacaaagaagaccacattttggaggaggttaaccaaagagattgcctgtttgtctccaccacactgggagttcgccaaaattaagaaaacaattttgatgtccatggcatattagccaagcaacaatggcagcagtggtaccaaaaaaatatatttaagtgaactagtggcatgaaacagaatggcaaaattgcgttggcaaataaggaaaccacaaaccagttaatattcagaaccaaatcatgatttttttttctaaaattgtgcatgataaactattgtcctctgcttgattttcagtgattaacatcgtattgaactgtattccagatgccagaggatgcgccaggttcacctggcgaccattttgaagctgatgttaggttggtcagatgttaccaatgtattttgtaaatatgtgacacacgacagtgttcagatgcacatttgtgatatttttaaccatgcattgttgttcgaattgtattaatcatgcattatgtacagtacaatccattagaatcatgcttttccaaagtccacacagtaaaacaaacacattctcttgaactccaggataaacatcgttcatgtatttagctctgctagactacgaagtaacattcctttcttactctgattaagggtaaagagtttttttttctttctaaaatagtgaaaaggttttttcatactcatgtggccaaaaaaggaactctatcttttcatgtgtgtaactttcaggaatgtggagatcactgcagctgaggtaattccgtttgaaagcaatcaaactataacagagccttttgagttcggtgaacaccatgtagcaggtgtgtgctgacttctagtgcacatatttatttatttattttatttagatacatgaagtaatccaaacattaaacagtgtaaagtaaaaaaaattctaccagcagacttggtaggaattatgttggctaaaaaatgaagttctacaaaaaaaattcttatacatgaagtaatgcaaaaaaaaaaaaaaatggcaactgaattctgggggtccaaaaggagatttagtgtaggttttgacaatgtatcgaaccttttgttctgtttccattaatggaaattgggggatgccctcttgatccgtaaaggaaagtaatgcaaaaatttgtatgttcttataaataatgttttgggacattgtatctaggtcatcaggaaggtttggaagagctgctgtccaaagtgcagaggttgaaatggctttgctggtggtctcagcatgattctctaggttggtcacaaaagtcatctcagcatccaccatgatgcgcatccttgtgttgagtaccacatccgacatttaaaaaggattcaattattataactttatcctgttaaacataaataaactgttaaattctgctaaaagaaattttaatgcatgaaattaaccgaactccattccttttgacagagcgtccatcaacttatgacttattaaaggctgctacaaataatttctcatctaaaagtaaaattgcaagtgggggttgggctactgtttacaaggtagttcacaattttccatgcccttattatatgtgttatcgtataagcattttaggatgaagctgaaagcaatagtcatattttttctgattgtttaaaatatcttatcaatcatcagaacatttttttataataatcagaatatgaatattctttaattgtgttatatagttcttgtgtttattagtaaatgataatgagataaggaattgagtttatgctaaattatgactctttttaccttagtgccagatcatcgattgaatgactcgaacaaagccaatttgttggcatgcttatgtatataaagcactgcgatatattcaactagatgaaaccccgcgcgttggtgcgggagtttagtatgataatagtagaaataacgtgtaacatagctagacgttttaagcttatagaatttgtatttttttatcgatcattggaaaaaggctataaaccattaagttgatgtggtttatgataatttaaatggtatatagattgataatccaaaaaaaagtaaggtggtgtgacttcatgaaagaagaaaatgggggaaatgatttagacaatagattaatcatttaaaggctagaaacaataatatggtttaatgggagaatatagatactgtagaaattgatggggatatatatgttgaaatattatgtaaattatgtgggatgatgatttaacatgcttgaatttgaaagcttcaaaatataattaaatatagatgatataacatgtttgcatgaggtttaagatttaataattgctaatgaatgataatgtggtatctttgcatatcgagttttaggatgtaatgagttgtaactttatagatagtatagataagcttatagaaaacacataagatgccatggcccaaacctatgcatcttgtaaacagcattgaggtatacccttttaggtatataaagtgttggaaatgaatttgtccagcataatttaactgaaggtacaatatgcaaaacttttttttttttttgtatttgtagaacgggcaaggaatattgtagttatttaattattctaattttgtttgtacgttccctttatatgttgtaaccaactgcacacttatatgtctgttggtccttgatgtctctggtttgaaatatagccaagcaagatatatatgatatactaggagacaactcattttctatctggacaaataactctgtcatcaagaataagttttagaaaaccccaaatttcttgtcgaagtgcagaaaataccaagtattataactcgtcatatataacaccgggttttataaatgtttctgaaagccccattgcaaatccaattccaatcctacatattttactatcttggaaacaatagcccaaaacaacaaaagaattaaagacttcatcataattaagtaatgtacagttcaacacgcataaagattttgtgaaaatgtgataaaaatttaagtaaaaatatgtgatcaacatgtcacagggtgttatgagaccctaagacaagaaacctccggttatatatgtaccacaaccatcagacccagggttttctacaacttcaaccataaaaccttggttttctgcatttactcttatattcatgttaaaggagcatttgattttattagtttttttgtatgagtggttcaaggagaacaaaatttagggtctgttaggcacagcaccagctctagctccacctctcctggagctggagctcagccaaacagtttcagctccaccaaaaataggagcgaagctgggtggagctctctcacaaaatgaactagagaagtggggctgggtttagcagcttcacaagtgcactccagacccaactcctggagctaaatttaggagttagagctttaccaaacaggcccttaatacctagctgtggtttcaaagggcacaatggtcacttcctttggctttcctttttgatgttgcaatatagagaaaactaacattttatacactaacaagattaaggtgtaaaagtgaaggtagcctagtcagtgatcaagacccctttgctccacatgcttggatttttttaacgttaagtttggatgttgacgagattgattttgcataaacttgggctaatatgtatatgcataatccctcatatggttaggatattcaaacacttacaatatgcaaaagctttgctgcacagattgataatcaatctcatttagagaaaatatcttttgacttcactttccaggctcaaatgcgtaatagtcttgagattgcaatcaaagtatatcctatgggcacgggagaaaaacgtgtattttcccagtacgaaagggagcttaatttacttacgaagcttcagcatacgaatataattaaacttcttggacactgcactggagaatgggagctgattttgatatatgaatatatgcccaatgggagcttggacaaatttatacatggtattctttctcggatcttgtatacattgtttattattgaaccaatttccacgtattgtattgatcttgtatacattgtttattattgaacaaatttataaataattgccatgttgcaggcccaaatagagaagtatcgtttgactggttttcgtgcttcaaaataattcaagggatagcagagggtctgctctatctacacacgtatgaagctgagatatgcattgtgcatagggatttgaaaccgagcaacattctgcttgattcagatatgaatgctaagataggtgattttggtatagctaaaactataagcccggcacggcagcaagacacatatgtatcaggcacattgtgagaaattatgaaacgcgtggatgattagattttataattttacatccattaaattcttctgactggtaatgtgtactgattctatctcttgaattgcagtgggtatattgctcctgaatatcttcgtggaggtattttatcaacaaaggttgatgtatatgcctatggtgtcattcttctagagattattactggcaggaggtcctgtattccctgtctaaaagatgatgagtatgtgcatttaactgagtatgtaagtaaattataatctaaacgctattcaatctctaaattttgggccaacatccaaacaaattaaagaaaactgcataatattttgtacaccctccatttcaaattacttcttgttgtagatttgtccaagtcaaacattttaatttttaaccctgaagtacctccacgtagaacgacaactaattagaacggagggagtacatatttataggacattttctgaaagacgattcttttcgcaggcctgggatctatggagaaccggaagatcagctgagcttctagatgcagcattgcgcaatgaggctcgaattgctgagataacaagctgcattcagatagcgttgttgtgtgttcaaaaggatcccggtgaccggccttccatgttggatgtgcttgcgatgctaaaagatgagaagattgtagctgcccctaagaaaccaggtgatcttctccttggagacgaaacgagcgtagagtcaggtgatcttctccttggagaggaaacgagtggagagactgcacattggttcgcaagcagcggcgctacttgcagttctactgagttcacggtgccccggtgagaagagattttgtcatatttgaagctggtggctacttaaggtgcaagtacgttatgtataaagctattacctttgattattcacagcgttgcaagcaaaataagcatggtgaatgtgtatttcagattctgagtaattatggatttaccatatgtgatggaaataaattaaacatacagaaggtggaatgtatagtatatcataaatattttagacaaaattggctacaagcaatataattctgtggcatttgcttatgggcgaaagtaaaaaaccaaacatttactgaaacactagcaattttgttgcattttgctatagaacactgacagttaaaatagtagccctgtacgtggaagataggcagagacggaagaatcagatgatagagtttgtgtcgaatacgtgtatatggtaggttatagtttaggacttggagttgtattagatatagaaatatagtaagagtcagattctattctagaattgatcttaaataaagaggtagacttgttggaaccacatgatgacttagcatagcgatatgtaatggctgctggcggtgtccggccaagggtcgttgtaactttgatatactgtattatgctaaattgggaagtagtgtccgtaattagtgcccctaggatgtagacttcggttgaacctcgttaataaatatcgtggcccggcccggtatcattatcgtgtttggatctcatatgatatttttcttccacgtagtatacaaactctatttgcgtatgtatacaaagtttgtatacgacgtatacaaagttgaatacatatgtataaaacccctgaaaaaatatgcacatatacaaagtttgtctacacatatacaaaattgtatatacagttttactttgtataggtgtatacaaagtttatatgcagagaaaaaacaaaaaaaaccataagaaactgaaataaccggagaagaaatggaaagaaaaaaccagaaaaaaaacgtgccacgcagttctgccaggcccttctcttcacgcgcaccacatgcattagggattttgccacctataggaggtatggaaccccgacccgatcttggtggagtagtttgtttttactttgtttatttacggcggtttcgttccccctccatccgaattattgaccatgttccatggattgtatgacatcgaatatatgtttcatctaaacccaatctccattgcttttatgagtgtttttgctcatctgtacaagggctgttttggcgttgttacacacacattcaaattgttgttttgaaacgtacatcttctaaattgttgccataatttacacccagcttgcaagttcgtacgccatgagtcaatatcatagttccgaaaatattcataatatacatggagttgtcccaaatacacaacaagacatgttttacttggcgtttcaagcacacaatactttattataggtttaccatttgttggtcgaggcttgcttacccaactcttcataatagtggtacagctagctgcagatgatcagtatatatactgatgaaatgattttccccttgtcaggtcgaatgattacctggctctagcttgtgcttccttgaagcgttcttgtgcttctttcacaagagaagagagagatctagcaggcttgattgcctcatgatcattaccagcaaagaacatgcatttatcaagttctaacaagttctctgaagccttggtcagtacatgatttcgatcatgttcattgaagtccttggcgcagctcggtttgtgctgaattgctagtatagccacctgacaggaaagcttcattattctcagacagtcagctgtggcatcgttatttacatctattatctctatcagcttcttcaacagttctctgtccacatgagcaacattagagaagtcatctgcatcaatcagtttctcgcatatcaccattgtaaaggatagcaaggccgcaagcaatttcttttcctgagatagtatatcatcttgctccgtaggggacttgtcctgaacggcatcttttggcggttggctctcttcatctctggctattgcagaatagtcgcttctctcgcctctgtcgcagcacctgcatagatgcttgaatctgaacctgccactgcatttctttccgtattactggacaatattaggcccagagcctgtatatagcagcacaaaataaaagttatctcaaaggaataagaatatacacaatactccctccatttcatattatacatcgtttgatttttttcctagtcaaactttgttaagtttatatttttctataaacttggtcaaacttaaaagaaatttgactaggaaaaaaatcaaaacgatttataattgagagaaacgattttacaatcgtgccatgtatgtatatgctgattcagtgaaatgaaatacctaccgcaaactactatgattcagtgatcacacatcacttaatttaggcatcaaattagcactagcaggaaatataacactatttacggtttagagtttagaccaagaggaggaaatagcagagatttaccgttgtcaaaagattgatggcatcctgcttcgatagttggcagctcttcaggaagcgagaacataggtgctccaatattgctgctgcgctaatctggcactgcttgtccttgacaagcatttcagtgagttgatcaaccacggtgccgtatctccttatatccaaaacatccttggagtcgccttcacacaagatttccatgatggtccctgctatccgtcgccgttacttggagttgagagagattttacaagcagttcacctgcttttctcctcaatgttatccttgttgccgaagaagatgtcccgaagcagactaacaaactcttccttggtcatgagcccagtataaggccccaatgcaacctgtgcaaggatctgtagtgccggttcctgcagtcgaagccagcgatcgttgtttcgcttgataatacgtagcaagttgcttaccatgtcctggctagttgaggtttcctggagcagccttgtgctggcttctccaggagaactgataagcctggccaggactctgagcgatgtgcttaatatgtcaaaccatacatcatcgtcttcgcaaacggcgtcaaggaaagcacgtgaagtgatcggagctgtgatcttggacagcaggccttgggtgtcgcatatctctctgcagttgtgatcgtcgccagcgagcctctcgatgattagcaggattagttctttagctcctctgggcttgaaggaacttgcactcttcctccttttgacgtcctcacggagcctctctcttctagcttccatcaattgtttggaactgctgactcatccggttcttgtcctcttcttatttgcgtccatgttgcctacttggcgatgacaaactgactcgttggtcagcagtagtgtcagtatgactcctctctgatgacgtactgttgaaaagcttgcatcggcgaaccacatgtgtcatgcttttggtggtgtccagcacaatcaagaaggcaagacacggattgcagtgctcctgggaaccgagctatgtgtaggtcgccggcgatgcccgccataatccttgcagcacgctcccttatctctctttcatccagggtccaacttgtcgggcgcgagagcatcgtgagcagattttggatggaatgcctggaggatagcatgtggcgccgtacagatctcgtcttcttgacgacgaacgtgtcgagcatccgtactccggtgagatggtcatcatgatatccagactcgagcaggatatttgcacatttcgatgtggtttcttgaaggtatcccgtgggctgaaaaccccactaccgttcgaacccgcattccgtgtcacaagtctgcgcaacaggaaccagctatagaagcccacaccgtgaatcagagcaagagagtagaaggcaaacaatgctgccttgagttttcctttgccggcatcatcggagctgtagtaatccagctgtatgaggcgcatcactgat

SEQ ID NO: 28731 - DNA, 11571 bp, Oryza sativa
aatataattacataaatactatagaacaacctcccatccacacgggatgactaaataaccatccagctgcacatcttatccatatcagtaaatcacgtattctccttcccctcccccctctctttctccatctccctctatccctctctctcccccttcccccctcctctctctctctccccccttcaccctcatggctcatcggtggtgggcattatgcagccatcggtccatgtggtcaaagacgaccagtgtgctaccgtgaaaggccgatccactcgaggtggagggatcgtgggcgtgattcttgaggcttcttcgaggtggtgacaaatcagatcggcgagctttttgttggttttttatgtggtttttaagcatttgagaggtgatttctcaggttagtttagctcattgatttgagttagctagccatattgaaggattttgtgtgccttttcctatactcgattacttgtttttaggggcaatggaaacgtgtaggaatgttctggctatgggggtagtttgttcttgtttttattagattttttctagagttgaaattatttctgttgatttttcttgagttttcttttgatagatggatgtccttttagatatctcagtgattctctaatagtatcatgatactatagtgtatcacgtcggtgatatcatgatactcatgtatcagacgtgatacctaacgatatcataggtgatacctacaagtatcatgcttagtacctgggtaccacggtctagtacccaggcaccagactttcgataccaagatctggtacctacggacccgatacctggtacctaggtatcaggtatcggatctagtacctataggcatagttattaagaccggaccggtgaatgaaccgcttgagctcttggttcactggtttagtggtcggaccagtggttttactggtccaacctggtttgattagtaatatagaataaatgtttttctactgtcacgagctgtacaatggtcacttggctagcgcgtggtgcactcaacccatgacctgaggtcgaatctccatccccaccagttttctttggattttacgtgcgcctgcgttggtgccaactagttgggcccttctctcggcccattaaccgaacttggctggttcaaccagctcggtttaacctccggttcatacaaaaaccacccgggttaaccggtttcatccggtccgactgcatgcccgaccttttcaggggaccggaccggcgggggtcctggttccagtttttacttggtatcaagtcgaggggagagacgatcgacatgccactagctcttcttctcccttcctctcctcgatgccgagaaagggagggagcaagggagagcgttgctgcttcattgtgttcttcttctcccttcctctcctcgatgccgagcaagggagggagcaagggagagcgtgtttggtatcctaggtacttggtattaagtcgaggagagagacgatcgacatgccactagctcttcttctcccttcctctcctcgatgccgagcaagggagagcgttgctgcttcattgtgttcttcttctcccttcctctcctcgatgccgagcaagggagggagcaagggagagcgttgctgctttattgtgttctacacatggttgtgcaggcatgtaaagaaaagagaagggttcattaaatgtaccattctaacggtatcccgtaccgtagcagtcatgtataattatctatctattatatattaaaactttcaacaaatgcttctaaaccatcacattgtgctataataaattagaaaaataaaaaatattctaaggaaaaaaaaagcaaaacatcaagcccactaatgaaattggtactgatacttttcgtccatccggatgtttttttggaatcagataggttcggttggatagttccggatattttcggattcggaaatgaattcggattatttttcctcgaaaatagaaacaaatacggtaagtgcactatccgttggaaagtattcggaatttttgcggatatccgcaaatcctatcttactataaagttgatggccactaacttctaaaggtcaacatgaaagtgtgccacatcatcacacactagaaattattatctagagtactttaaattacatgcaagtgtaccacatcatcacccactagcaattattatctagagtattttaaatatcatgcaaatatgacatatcatttacaattttgttgtatttttagaactcaatattcaagcaatgtcaaatcattatctccacatcattttatattatttaaacatatacttttaccatttttagaaatgtataacatatatacatatcccgcagtaaagagcggggtatcaaccagaatattatataggttcaggtcgtatatatttgctggtggttggtttttttttttttagaaacacagtacaaacgcaggcgctcacaacgtgcgcacactcacccctatgaacgcacacacgcacaccctacccctatgagcacctccggaagactgggccggcatatcttggacctccggaagactgggccggcatatcttggttttttttttgagaaacacagtacctccggaagactgggccggcatatcttggttttttttttgagaaacacagtacaaacgcaggcgctcacaacgtgcgcacactcacccctatgaacgcacacacacgcacaccctacccctatgagcacctctggaagactgggccggcatatctacgcacaccctacccctatgagcacctctggaagactgggccggcatatcttgagactgacgaagtcaccacaggcgcctcgctgtcgacgggtacaacgcctaccactgaaagaataattagccgtaaatacgagcacccgtgtcaaatctaggatttgaacccgggtgggctagttccatcacaaggaacctaaccagttgagctatgctcacttcgcttggtggttggttttttattgatttaggaagatggttttaagggtatatgtggacctattctaggcctctatgctaatgttgtgtaacgccccgattttcgttcgggattaaaaatcatttaataatgcattttatagaaattaaataaaagttaaatcaatttaatcaagtgaaatattgagggaattaaaattttcctttaaaaatcattggccgggaatgttttgtgatattctttgtgccctaaaatactctctgaaatttcccgcgaattttcggagcttaatagctaattttaaagtcacaaagctcattgcatcaatttaaataaattgaaaaccaaagaaaagctccccttccttccttgggccgccttcggcccatgcctccctcctttttgggccgctcggccgttcccctcctttccctttgccaagtccgcatcacctccctcccctctctccctctggctgacaggtgggacctgtgggccccgcctatcatccccgagctccagccgggtcggcaaccgccgccatggccaccgattttacccactcctctcgccgaatacgcgccacctcacccaccgcatccaccccgcacgcgcgcgcacgcccgtgcgaccttctcgcgcccgcaaccaccccactccccctctatcctcgcaaaaaccggccaccaatctcctccacgtcgccgcccactccatcgccggttgcctcctctcctgggctcgatcccgccttcccgagcctataaaagtgatcctcgtgctcccctcctccgtttccccctcctcccgagctccccgcgcctccctaccgccctccccacgctgctcccgcgcaccgccgctttccgatgagctccggccacccgccaccgctgctccacccaccgccgcgccaatccgccaccaccgtcggcttcgcggcgccgtgccgcagcccggcccctactccatttcccctctccgcctccggaacaccgccgcttcgcgcaccacctctctccgccgccgccaccgactccagccgcgcgccaccaacgctcccaccgccgttgtgctgcgccgtttccattgacggcttctccgcatcaagctccaccccggcctccactccaaacccacaaaaccaccaccaaaacaccattccaccatgcatctgagccactgccgcctcccgtcgcgtaaaaccggccaccaccgccaccctaaccaccgcaagggcaagctcggccaccacctccccgtcgatggaaactcgctgaacgttcgcttcccgtgcaccgccgtcgcttgtcaccggagttccgccgcctccctccgcctcgagcttcgccggccgccgcgttgcgccgccaccgccggtggccatccggctaggccgccgccgccactgttcgtcgctgctcggccggccggtctaggccacgcccgccctgccctgtggccgcccgtggaccggcgtggtcctggtccacggtgcgcccgaggccgcggtggtccgcgtccaccgtgggcctcccccttgagccgctgacgcctagggcccgcttgtcgatgccacctcctcccctcggtgacgtcataaatgattaataattgcctcataattcgataataattgtagaaattgatttaaatggctcaaaacttctaaattcatatctatttcatgcgaactccgaattgagccattcaacttgcaaaattcatataaaattgagatctacatgtttgtttactttttatgtactatttcattggtgtttattagagtttttcctcattttgcgtgccagcgtgtagaatccgttgtttcggaagatcgcggttgcaaggaaaagtgttcagaagatcgtttgaagaagcaaggcaagtcacacattccccttgagcatgttgatcccaatttacaaatgttttaccatttgcaaataaatatgcatgttttgctaattacatgggatcagggtttacctatctgcttgcttgtgccatgtttacttgatatctgtcctttgtcaaccttgggtaataaatcgactagctcaggttacttatgtgacctagctagaactatatgcttagccatgcttaattaccactagctcagttgatgtgataattgcagtattagatctttttagtatcagaacgacctgcgtgctcgagacacctgaccatgttgcattggtcgtaattatccaactaaaatacgactgaatggtgggctgtgggtgcatggtttcgctggtcgcacctatggcaattaaggaccggttcgcgggatgcactggaagacatacagcgcttgccacaagcgggaatgggtaactgtctgacttgaagtatagctttcctctagctgacattcctaggcaagagtgggcgtgatggagttgggtcggccggggtgttcggttgatcggcttctggattcaccgtggcatgagaggggactgcccgccgccttgcgaggagtgggggtgaaacctgaggtgtggtgcgattggtcaaagggggttatatgaagggtcttgtcacaatcactcgacatggtgatgtgttcatcatgggcgcatgatgatgcggtgacatgccggtggattgtgtcttgtgggtacagttgtgcacctctggccagagtaaaactattcgaatagccgtgcccgcggttctgggcgatcgaccagattcaccgtgattagtctcacacttaataaatcgactcaatgcactgtagttcaggtgtgttggttgggcctgttcaacatggtgttgtgttgatcagtagagatttaatattactttaattactcaacagttttattgtttgctcaataaaatattttacaaccgcctttatgcaaatagccaggagccattcttgaatccccttgcacgtctgcatcattggtgtggcttgctgagtacggtggttgtactcagccttgctattattcccctttttcagaagtgtagtgcttctgagctgaagacgaagttaggggactaaggctcagactccagttgagttttgcctgtggagtggagctgaagccccgctaggatcgtctttttctgctgctgctgctttcttttcggtgtgaggactaagtgcctcttctgtaagtattttatgctttatttacatttagaactgtatattacttgtcgttttgtataccctggctggtactggactgtgatttaatacacaaaatagtctgaaaatttagggctaaatttctgggcgtgacatgttgttgggaattctaatgagggtaattggtgggtgcatcgaggaactcatcatctctagctcaatggtgtagggagcaatagggaaacacctcacacccgatgttgggtgttgaccatgtactaatatagccaatagtatgtacaagatcctcaattagagccatgttgacgattattatagaccaattttgaccgtcaatataattgaaataaaggagaactagctatacttgcaatgcatatttatttttagaataatctatttacacttgtactttgaatatttttttgtttgcagagattgctacgtaaacggaggagaatcgacagaaaataactgaacaatcaatcgcacgccatcgagaagtagacttatgggtaaatggaccgacattttctgagtttgtatccgtactcgatactatccgtgtccgacctgattctgattataaaatttgggttaggatatgggaagggtgagatccgactgaacccgacccattttcacccctagctgccagggaagaaaagagataaagacgcatgcaccacaattttttttattttaattttgctgactaggatgccatatcagtgaaaccgtgcatccatactgctatgggacctaaattgtacggttttgtatagtttaggggtgaagatttctggtattgaggattatgttggctggtgaacttaatccattttttttttatctctgacagcatccgaaggagcccataaccaaagcagcccaaagcccaaccgattgacggtgccctgccgaagtgccgagagctcgagagacgaatgcaaaattaatctgtccgtacggctgaataatccattcccccttccctttcctcccccccctccgatccaaccgccggcggcggcggcggcgaccggcggccagagcgagctccgtcccgatccggcggggaggggcctccccgcccccacgcgctaacctccccaggcggcctcctcctcctcctcctccgcagcgatgggctccatggagccgttcaaccggtgagtcccccctccgtttcgcacgggccctggaaactctaaccctagcgggtggggggtgatgagatgtgcccccaccctcgcctgcttttcgtcgctgacctcggccgatcgtgcccgctgatgatgatgatgatgcaggctggtgaggctggcggcgcgcgccttctacgacgacatctcgatgaagggcgacaaccagcccaagacctcccgcggggacaaccgggggatggctgtcgtcgtcctcgacgcgctcaccaggtgattgggtctgcttcctgaagattctgtggggggagaatttctgtgttcgcgaattcgtatacctaggtctgggttgaaggcgggggttttcctctgttggtaggatcgtgaggggcgagtggagttagtagaacacagttcatttgggtccatccggaaatgaattgataaattggatacttctaatgagcacacttagatgatattgttgctgctgcttagggacatctcgatggatgaaaatggtggaggtgtttgcatgaaccagaattcccccaattggactgttgtagttaaatttaacagtgatgtgccacagcaattttatttgagttttgactctttcttcctttgactggttttatatgttttttttaaaaaattggaggttaaagatgataacaattgttaaggaattctgtactcaggaactgcaaatttactaatggatcaaggataaaatcctagatgtcctcttttcttggttgttaagacatgtagattggagccaacgaatgaaatgtctaaatccttataaaacattctttcttaagaagtttttatccacaaatctttggacctcagcacttcagctacatcatgtttgatggattgttaattttatttattagtcctcatgttttccatccacttatttgtgccttcttttccatacacattgatactatcaactgatgccttttatgcaaattacattgtcttggtataaaatggtttttggctctgaagttatgcaaaagctaatatttttccaccaccagacgccaatgggttcgagaggaggatttggctaaggcattgaaactccactcaaagcaattgcgccgtatcctccgattctttgaagaagagaaactagtgacacgagatcaccggaaggaggttagttttttattgcggctattattattgaagttccactatatctccattgtctttttcgttttctagggatggacatgttttaactgacatctcctgcgacccaatgaaaaatatttttgttgtggttcattttccttttctaattttaatttttttactttgttgctgcagtcagcaaaaggagcaaaaatatacagtgcagcagctgcagctgctggtgatggtcaatcaattaccaaggagggagaagagaaagtaaagatgcatacccactcgtactgttgcttggactatgcacaggtagttatccactggttttatctagatgtttttcatgataaataccattcagattgaaggcattccctccacaatatagggccagtaaattgttcttttccttttctagaatgttttaataaggacgagtttagtgtagatgccagggagtgggatactgttatttcaggatacccatgcaaagtgttgaaaagttagtgtggtttagcatattttacctatgggggttgaatactgtttaatgttcaatcacttattccgagtcaaggtgtgtgaacattgtggataataaattttctttagattttttacatttagatagattttttacatttagatattgcttgcatgtactagaaaatcagtgtttcatcatcagggttcatatgcaaatacagtttcttcgtgtgtaatctggctgtagtaactcctataaatgtcattctctcataatcatagattcatttattcgaatttttggtgtagttgctacaatttgaatccacgccattaggaacctaataagttgcataatactccctctgttccatcttgtaaggtgttttagttttctcctaagtcaaacttctctaactaacatttataataccaaataaacactatcaaggcatattttatggtggatgtagtgaaactaatatgatgttgtagatggtagtgcgtttttctataaacttggtcaaagctagagaagtttgacttaggacaaaacggcaatatggaatagacaatggagtactctaagaaacagtacaattgtagataaccaaggcctacttggttcatgtggtgattatattcatttctacttgtttctagagacacaaaaccaaacataagaaacatgtgctaacaaaaactatttttgtggattgtttagatcaattgtgcatcataaatttcggttgaatggcaatttatgaactagtttgtataaacaatataacataacataacatacaagttaaccttgtcatacatgtccattaaattgactttaccacacttttttgtgcatgctgctaatggcatttacaatattactaagtttgtagtttttgtttacttctatgttgcaagtatttgagttattttattgtttgaagtaatgaaggtctttgatctgttgaggactacaactacaaaacctaatcattctcattcatctttcatcttattctgtcatcatatttgaatcgtgtttgataagatgcattttttttgaaacacagatctgtgatgttgtaaggtatcggatacatcgcatgaagaaaaagttgaaagatgaattggacagcagaaatacaatccaacactatatatgccctaactgtaagaaaaggtactaggtacaattatagttcttttgatgctaggcacaaaatcaagttacttaaccttgttttacaatatgcaggtattcagccttcgatgcattacagcttataagctacaccgatgagtacttccattgcgaaaattgcaatggtgagctagttgcagagagtgacaagcttgcttctgaggaaatgggagatggtgatgataatgcaagaaaacgccggcgtgagaaactaaaggatatgcagcaaaggatcgatgtaattatatttttattttacaatgctaagaacattttcttgtgagcattcaattttaagcacttttaatgcaacttatatatataatggttcaactagtgcagaataagacaaaatgtttttgatttacaatctgcaatcatactgttggttaggccatgattccatgctttttttttggcacaacaggaaatatagtaagttatctgcttgtggtctttctggatgctgttgaaattattctttttgtttcttcattacgagtttttgcttggagaaaattacttgcatgcattagtatgctagatgttcatcagacatgaataggtgaccatgttagtaacacttatatgtacatcccattatgggacagtttacatcgtgagttctacttcagagttgttaatgctttgctataaactacagaaattaaatatacattagtttcaactttaacagataccatgatatatttccacagtaccatctaaacactgttgcttcactggtttgcttatacaacttatgattgtagatgtgtctacaatctgcttaaagttcaatataaaaatctcttgctgtttcagtctattcaacaaatactttaatgcggtagacaaccagttcttttggatgagaaatttagtattgtgatcttttggattaaaacgatgtgccctttttttagtgaagagtcttttcttttttgctgataatgagtagtagtctgtcaatattttcgtactaattgggaaatccatgtttgttagtcttgatctactggagtttggagttatttattttttttacaacttcgttatatttggttcaggaacaattgaagccattgcaagcacaacttaatagggtgaaggatcttcctgctcctgagtttgggtagcttacaatcatgggaaagagctaacattggtgcttttggaactgctgaccctagtgttgttcatgatctcgtgctaggaacccacaagggcagtatggtacaccaatgccatacctcgtaaagacaaaggtaagattatttttataatagtagtttttagtattgtttgattttttattagtacgcaatcaacatggcgcgtcttgaagcttcctgagattgtaggtgggtcaatcatgtcaggtgatggtggatctaacgggcaa

SEQ ID NO: 28732 - DNA, 14323 bp, Oryza sativa
  unsure (1)..(14323): unsure at all n locations
aagaactctgaatcaaatctaacatagtttcttctcgaattttagcaaggattgttgttttctttaagaaaagtattactgatcttctgtaaaataatgcgatgtgtttatttgttatccttactaatgcatgtgtgtttaatatgtgcttacacatgaacgtctcctgtcttgtatagatgatactcggtacattttcatacattttcaatcatgccttgatctaatcatgctttttacttatttttcttttcaggttgaagttgcattgtctggcaccggtgtaaaagatgaaggtgctgaatcangtacaaatggtaacgggctgaaagtcttgcttcatggatgatcaaacaaggtatgaatcttacaaaagaacanagaggagagaccagtaactcatcaaatctagatgaaaaacagaagtcaaggatgagaaaaaacaggactcaaaagaagatgagaagagtttacaggtcagtttgggaatgaacataaaatctgattttactttaagatttatttttctgttcagagatacttatgttattcttttattgggtaggatgaatacataaaggcttattatgaggccttaagaaaaagacaggacgaagaagaagcgaaaaggaagatacagcaggaaggggatacatttgcttctgcgtctcattctgaacggcaggtgggcatgaaatccaaacgagaggatgatgatgagggtgttgaatgggaagaagagcaacctgcaggtaaatttatgattgtaacaacagtaaattgatcttttaggcaatgtatcatatgcacacagtcatcttggtgtactcatgcactcaatccagaccctccaatctctatccaaaggataagaatgaagagtggtactttttcacaaaaccgcccacaccaccctagtaagtttgcatataacccctagttttattctctcctcttccgtctatgtccaggttcaggcttctcctttctatctttctttcttcccaaatctgtctttgaaacggtgaaacctcctccttcctcttcgcccctcttagtgcggcaccgacggcatctcaaatacagcccacgctctttgatccttctgtttccctttgtccatgttcttctctttctcgtcctaacattaagttaatcctaatcctacaaattaatttctatctctctcacagcagtggaatcagtcgcggcattgccattgcctcttagtttgtagctagctatatatggcacatacgagagaggccgatccgttgatgccacggtgccattcttcgactaatacttatagtcttccatatagcaaaaagcaagcccgtgattagcagcattgtctccctttcttttgggtttgagaggtgattgaagcatctttcctattaattgaatgcaacagctttagtttggcttggtcaagcgtgtacttgcttagaggatttgaatcgttgtggaagccacacgaagcgggaggagacaacgcagatagatctgggaagaagctttggacctggacatgaaaagagagaaaagaacaaaggggttatgtgcaaacttaccagagtggagcgtgcggttttgtgaaaaaacaccacttttcgttcttatccttaggattgaaattgaagggtccagattgagtgagtgcatgagtttactaggatgactgtgcacataggatacgttgccttggatcttaattctatgtttatcaaagctgcaacattgaactgacttaatatttctgactattcacttattcgctgatataatagattaatagccatatcatgactcatcttagtaagactgccataatttcttgcaatgttgatgtgttaacacaattttatatatgcatgtgttgggtgggtgggtttggggcatcctatccatatggcctttcatcttggcatatgcttttggaatatttcgatggaagttcatacgctacatatttcttatccttgatgtgtctgcttttgattatatgctttagacatttgaagatgtccttttatcaagtattatgtctaattttttgaactaatgcagggaatacagctgagacatacaaactggcagatttgaatgttgaagcccaagaatctggtgatgaagaagatgaaattgactgggaagagggttaaaaggcagtcacaaattcgttaaagtagttcaatttcattccaggaattggatgatgagcaatatcaccaactgaacaagaagccaagaaaaaggcatgaaaagcattgccaccaaagaattagtttgtatggtttgtttgaccaagggaacttttcggaagtgaagcgttttccttttaatagcgaaaacatttcccaaccccaggcggcattttctccccaagatccttaaaaagctaccatactgtaaagtattatgctattgacatcttcaagggccatgtgggtggaatttattgtcgcaaaatcagctctgttttcagtgaatgatcttttttttttttatgttgtgagactgtacgctatggccataaacatgccatttttcagatgttcttgccatgacctgtatattatgatggctatgcgctagattaaatttctgagattaatgaattgatttactccaagattaataatatcaatggtagtttgcctacttgtcagcatgcaggtaactcgatgaacgaatggatgtagctagtatgctgcaccgaaatctcgtgcccaaactgacgtttgttttgtaggattgacacgagagcagtcagtaattaagcacgtaaacgctaaaacgcattaataatattcatccgttccgttcagttgttagctgttatcgatcagctctcttttacctacttaagctagtttaattactgtagttaataacacccaggtacttgacaccatacatatatacattggatcaacacaccacacgatcgagcacaccaacggcggcggcagaacaccaccaccgccggcggccatgatctccggtagcatcgacgtcctcgccgtcgccttcgccgtggcagcggtgatcgtcgtcccggtgcccgtggcggcagcggcggcgccggcgagactggacacgtacctggtgcggatggtgaaccggatggagaggaagatggagttcgactgcgacgagtggcccgacgattttgagctgagggcgaatggcggcgacatgaacgtcacctacgagaccgccgaccgccccggctacgactacctcacccccagggtctcctgcatatggtcgtaagtagatgctctccatctgtcataaaataaaataatgtagttagattattgacagaaataatgtagttagattatttaaattcgtagtagtataatgtgtaactagatttgtttatttattttaaaatggagatagtattagatatagacacggctactccaacttacattaattacttgatcgatcattacaataaaatcttttgagggacgatccgtggttcttcgaaagtaattgatgttggtagagtgctatattattttatatctcttcatggttttcgggatgtcacttagtttggccaaaagttttatttatgttatgaaagtagtatttttaacttaaaatccaaattatggtttctaactataactccaaatctatttcagattcaaatctctaccaaacaatcttatttaagatttcgtttggcacaactctagatcttaaattcacactgaatttagaccttataagttaaattaaattgatttaaattttatattccttctgaagtaaaaacaaaatgattcattcaaatattatcaatatactcatatattcaaatcggtgaatttacgaagctaaaaatattactatatttatctacaaagttaatcaaaccttatttctatatttattttctatatttatgaacaaacttagtcgaaccaagaatagttggatctaaaacgacggagggagtatcatgtgactcgcagatacgaggggaactacatgagcagcgtgataatctgggacgaggagaaatggccggagaagaaggcgtgcctggtggggggcggcaggagatgcgagctggtgttcgagaacaaggaggaggtgctggtggtgacgacgtcttcgccggcggcgccggggacggggtcgtcgaggagggtgctgggcgacctggccgtgaaggactgcagcacgcactggtacggccacctccttccctggggcgccggctgcacctaccccagccacgaccacgcctacgccggcgccgtccacagcacctggaccgccgccgccatggccagcacgatcggccactgatccatcgcggcaaaaaaaaaaaaatgttgcaagaagatgatcgatcaccaggaggaaatatatgcagagctggattggtttgaggcctaaattacgcttaccaatatttggcaattttaatagtgtttagtgtctatttgttttgaagccaaattttggcatgcctaagaaaataggccatttcatagtgagcttagactattttggcttcaatccaaacacaattttgccttaccaaaattagtcataccaaaacttgccaaattttggtattgacaaaatttgataaggcctatttagaccacaaaccaaaccaacccgtaaatctctctagctatctctcacgcagatcacgaaatttcacggaacccccgatcgatagtagtaggtataataatggatcaagttgttgtgtaaaacataggggattttaatttggtacgtgacgtatgacgatctctattatactatggctttagaatttcacaagtttcgtccctgccggcagaaagaacaagtatctagtgtgttggtttttccttgctttctctggcacgttctgataaaaaaaaacatcatatcaaaacaaggaggataggcaagtaaaaggttttttgcgaatttatggtttactttgatcaggttcattactccaccccgagatcatcatagtagtcgccggcgccactgccaccaccaccaccagtccgccaaggtttacaaaacaatacggttatcatggttatcacgtgcggtaacattctcagtttttaaaaccacagtaaaccttgtagtaaccgtcttaccgtggatcggtaaccgcacccaaaaacggtttggtgaaccctagctgccgcctactcgctcccgtcccctccacctcagccaccggagaagatggggcgccggggggggggggagagatgaggatagggagtgggagtggagtgatgtgaggtggagcaaaggagaggagaagagaagttagaatctacaaagtgccaacattgttcaggaggctaaagtgctactgtctggagagcgagaagttagaatcaacagtctcccgtagtcaaaactgtgtaagccatttcttgacaaataagtctagagttgattcagtttatggtttttggatgggtgagagttgtaattttatctcgtaacttgtttgcgaggacgctagttttgagtaatatattttccccttccccgcaaaaaaaagggagaggagaagagaaaaaaaaaaggtgcatgtgagcggagaggaggagaacgagaaaaaggtgaaagaaaagtagtgtgtggccggtgcaggaacgcgtggggtccacttgctcttcacattgctccataagtggttcgctttgcaataatgcacgtattatcgttgacgggtctcttaatagatcatctgtgaaaatagttttttcatgtggtccttgagccatttccggggaacgatttttacatgcagaagtagttttggtccacctatgatttgcaatttgaaggatcttgtccggaaaaagacaattttgtagttgtgttagttcaatgggatcgagctaactttggagcatacaatttagatatacagttgccattagaggcgatttttagcgtactaattatggtagtagctaggtctcgatacaaaattgcaaacagcttcctggcatatcctcgggctcattttaagtatccgttaaattatccagtttaattcatagcactcaatattttactaataaaaactgcgtggaatcactcctatcttgttttaaatgtacgatgctaataacatttggacatgacgtttgaccattcgcattattctatttgtcctctattagtccctgagtcaacatacttaattaggacagataaattttgctataggacactacgatgacttcgtggttttagctctagaacacatcaaaagttaatctttaggggaagacgctctcaaaatgtgattatttgctgatggacaccgtagacattaaaatattaattttcggttgataggagagataaacatcgtgaaatgtaaaaaaaatgccccttgacccacttgtcatattctcacatttcactccctctcacactccggccacaatacctcctccgctcactgccgatgaccaccaaggccttccctcctcacctcctccgtctccgccatggcggtgcgagtcggctcccttatgcacgcggccgctggcatggcatgctccctcgcccgactccccggcgcgtgctaaggggcaagggcgaggcgctgagtgtcgtacacatgtcgtcggctccgggggcctctgcctcccgccatggcaccacaagtgatggagtcagaggtggttgcacgagcgctcgtgttgctagtggaggcgcacctgggcggccgcgctgctattcacctcgacagtcttgctgttgctgctcatctgctctgtcgccaagagccgtcggccctaataagctaccttcgagcagagaagatggaaacaaagaacggcgccaacgaggtggggaggagagcggctcctgctgggcgagggggagggagaacggcgtcgaccggtgggtgaggggagggagtagctggctaaggggatcatattgaataagagagatggaaaggggtaatttggtcactgcgtgtcaaaaatgtgagtttgctctcgtctagttagcactaaaacataaaataaatgggctcggtgttcactggcaaataatcaagattatagtggctttcctcaaaagtgacttcgtgtgttgtctcacagctaaaatcacaaagtcgtaatatcctatagcaaagtttaccattattagtaggcaaattttgatagaggacaatgtgacttcgtggtttttgctctaggacacgtcaaaagtcaatctttgggggaatgcactatcaaaatgtggttatttgctgatggttaccgcggaggactactgggcggagcatgcaattcataggccagagttagcagcgtcggctgatgcacccatgtttcgagttggtgcgtcgacggcgtggcaggaggcttcgcccgcggatctgccacccttgcgtcctccaggccgccacctcgatgctagctcctctgctgcgtcgatgctgggaagggaggaaggagaggaagagaaatgaggggcaatttggtcactcgcgtaaatgtttaggcccactttcgcctcgtcggcacaaatacactattttaatcggtgcagtgtccgttggcaaataactatgtttagagagtgcttttctccaaaagtgagtttgtgcggtgtactacagctaaaaccacgaagtcgcggatgtctttgtagcaaaatttgcctaggatttatcccctattagtaaaaaaagggacagatacgatcatgaaaaatatgtcgtcagcccatcaccaaaaacgtaatttaatagaggtatgaaagttatcatcgagatttattgtactacctccatctcataatacttgttgttctagattgtttagcatgtatcaaggttaggaaaaaagattatagtaccccttattaaataatgtatattgcatgttggatgatagttgaggtagaataggccttttttgacaaattggtccttgtagaaaacttattttgaaactagtccctaccaaaaactagagagtcggctcagcgccaacaatatagctgacctgatgtggattcgaaccttggtgctagggtacacaagcaaatgaacatacaattgcaccacaagtacattgcttattaatcgccgtgcatcagtctaattagcgtgtacaaggagtcagcgccaaatgcattggcgctgaggccctgccacgtcgtgcctcgcccaccacgctggcacgatgttagcaccaaccgctttggcgctgatagtttttggcagggactaattttgaaataagttttctataaggatcaatttgtcaaaaaaaagggtagtataggatgaaatttgaattggaagtgggttatgtgttactgttttgagataacttttggatgctaggaagatcggtattgtgggatgaagtagtactacataggtattgtgtagattgatggcaatatcataggagtatcatctagattatagtagtatatatatcataaaggttgaccagactgtcctatgatgatgccataaatatatcatcacattttatagtggttcaattgatgtatcatgatatctatcgagaaggtatataaaggttgaccaggattgtactatgatgatgccataaatatatcgtcacattttatagttgttctatgagtaaaatacatggccggtccttaaacttgtggggcggtgtcagggttatggataccacatacctaatagtagtcgactaaatctcggcagaacccaccatataccatgtcttatacgggaacaaccttcggatataggaggagttccgcataaggaaggatatgaatagagttctacatggaaacgacaaggactactcggattgtatccatattgatctccctagttctacttggacaagggaacacctataggtataaatacaaggccccctaggaggagaggtgacacggaacaatagatcaagacaaaagatcaacaaacaagccaacacgccctccaaatatcaatatcagagattagcttagacaaaccctatccggtacctacgggggccggcaagaggggtcaagcactatctctgatctcgacgagttcgtgttcgaggaagaagactaccctgtcgtcgactacgagttggttatctagccgtcaagtcgactgacagccagatatgttatcccacatgttgtatttgtgtgatccagatgaataaagagcaacaccagtttcggccaacaggatgtagggttattacctgataattcaagagcccgaacttgtataaaaatcctcgtctccgtcttttttactacagtctcgcatatatcctagtaccaacgatccccatactatgcaaataccggaatcgcgacatcaaacgttgacaggcggtatcacttaagttcataaatttagaatatgcatgtttaggtctacgatctcgttttaatgtaccatcccggtctaatccgcggttgaccgcgtcttaccgccagcgcagtacatttgcatctgcccccctccacaaaacgtaggcattaatatcatccctaaacaccatcatgtgataaaacgatccataacaaagtagtcttcaaatgtgaaatatgcagtaccattgtgtggaattacagatagcgcagtagcaacctcagaggcttgatttaaaatgcagcaaataatgttgatcgaagatagctcaagtgcctttgattaaaacaacaggacaaaccacattgttgatgcagtagttgctcacacttctgtagaacattctgtagaacaaaaccaactcggaatttgaatcagaaaccaaaaaaagatgatttatattgcagggtctgtgtcaggttccagaaatcatctctcttgattaggctaggaataagaatagtatcaaacagtgatgtgtgttgtcgaagcgacaactgcatacgtcgaaagacatggttactcaatagtagtcggaaaagaagtgaagtgtattaaattgagaatttttcttggggcccccctattacatggccctatgagactatttatagccccattacaggttcttactactagggttttggttatacaggggaatttacatggttacccttatgaaagggacatttacatgggtacataatgtaattgaggttcatgggcccttgatgggccgctaggcgatcgtcggcccaatagcccctaggcttgatgggcctgaatagcttcttcggtcctcgcgggggcgaacttgctatggcgaagtcgtctcccttcggcatatactcttcgccctacatcttttgcccaagaggcctctggcccggcaaggtacccgcgcgattccccgcctctcgccgtccttgttccatagccttcgccatgggggggagggggggcttcgccctgactaaccttgacgtctcgggcttgaatccccactggtcgcgtggtttcggcaggttttgtcgaagggcctgatgccataccgccaacaatgtgattacatgacttttcaagcctggcaagcacatttttgacagaaacaaacacagtccttggttcaaattcaacccacgatacacaggtgctggttctctatctgctctaaagttgaagtccatcaccgccgcgccgacgatgtagccgccacgcgctggccctcatggagcccagcgacgctgcctctccggagccctaccacgccgatgcccctcgcggagcccagcgcctcgctgcctctcccggagtcatcgagatcgccctactcgctgctctctcccttggaagtggagaagaatgcaatggatttaggtttgcaacagtgcctacgttttgtggaggggaaggatgcaaatatactgcctgcgtggcaggcggtcagaggtggtcaaccgcggattgtaccgggatggtacattaaaacgagatcgtgaatctaaatgtacattttctaagtttatggaccggtcatgtattttactcttgttcaattgatgtatcatgttatttatctacaaggtattgccaagattttgtgggcaatatcatgggcatatcatccaagtttattttttttcctaaagctattcttaattgccagtattttttttatagcaaatccctttttatatcatattattctgatgtatccttgattttaaaattttagatattttcatggcagtacacactctctaaacattgttcttgccggcaaaagaattgtttcaactttcaactttatatttgtaacggtggaatgctctgcgcattgctgaagacgttggaacgatcgatgagcgtcttggccccgacgagccgttcgaagttcgccggcgagaagtacgccgagccccacgtcgaccgtgctcggctcaccgacgacgacggcgaggacacgttcccggcgagagcattggtgccgaggtcgaggtccacgtagttgacatacgcggcgcgcgggttcttggacacgtgcggcgccatgtacgcgtacagcgcccgcagccacgccatgcgcgcctcgccgccgccgccgccgccgccgccgtcgtcgccggcctcccacgtcacgccgtactggacgctgtacaggttgccggcgcggtgcgggaacggcgtgtcgccgctcccctcacgcgccatggcgccgccgtaggggtcgaggatcacgtaccccgccggctcgccggcgaggtaccggaggatcgccgccacggcgcccctcgcgatgggcgaccgcacgtagtccgacttgctcttggcgtagtgcttcgtcctggaggcgcggctggtcagctcctccgtcgagctcagcccggcgaacctcgccgccgactccacccagctcatctccgacatctccggctcggcgaggcccagctccgggaacctctcgctcagcaccgacatggccagctccttggaaccaagaaccagccctgtgaaggacaccgtcacgtttccatctcgtgatggcgacgacgagctggcgccgccgatggtgaggaagacggagaggtaaaactcgtcgggcagagctgagccgacgtactgccaccgatgcactagcccggcgatggcgtccaccgaaccggtccttttcggcgtgaacgccgtcaaggtgttcggaacctggacgagccggagcttccaggcgtagaccacgccccagccgccgccgccgccgccgcggatcgcccagaacacgttctcgcccatggagctccggtccaggaccctgccgtccgcgtcgacgaggatcgcgtccagcacgttgtcggcggcgagcttgaatttgcgcgacagcagcccgaacccgccgccggagatatgcccgcctgctccgacggtcgagcacgacccagccgggaacgcaagggaggacgacgacgacgcgacggcgtagtagatctcgccgagcgtcgcgccggactcaacccacgcggtggccgacgcggcgtcgacacgcaccctgttcatcctcgtgaggtcgatcaccacgaagcggacgcggtcggcgtcgtcgccgccgtcgccgacggtgtacgagaggccctcgtagctgtgcgcgccgctgcgcacgcggatgcgcagcgaggcgtggcgcgcgcacagcaccgcgctcgtgagctcgctccggccgcgcgggagcacgacggccgccggcctgggcaccgcgccggcggccgggagcgcgaaccggaggttctggatggagaagttgagcagcgcgtcgtaggccggcgacccggcgagggagaagttgcggacgccggtggcgaggaggcacgacggcagcgagcccgccgctgctctgtcgtcgcaatgctggccggcggcacacgcctgtcaacggtggcggccatgtcgaggacgaggagagcaaggtgaggaggagggcaagaagcagaatggtggtgttgcgcatggctgatctcactgctgtgctgtgcttaagcaaagaggaagtctatatataggaccttttttttattaacgatatacccccttcaattttattttaattaacgttttagacaataacacggtctacaaaatatacctttgaccttatttctctattataatatatataactagtatggtggcccgcgcagattgcgcggctagcatcattatattttctctcatataatagcatatatgttttcttattatattattaaaatatattacaatgacaacataattttaaattttgcaataactttacgaaactactaatgtgtaatattcatattgtattttatataagtgttagttattaattatttttaatatcaaattttagttatttgtaaattatatatatttctatatgaactctagacttgtcttttaatatttcttttttttaattctgaatttttattatttataattgtatttctatgtagactctaaactcatctttcaatattctttaatttttaaattttaatttcaaatttcagttacttctaaattgtattcctatattgactttaaactcttcttctcatgtttttcttaatttcgaattttagttatttataaattgtatttttatacggactctaaacactactttttattttattatgtttattccgaattttagttagttttaaattcctatatggaatctatactctacttctaatattccttattttttaattccgaatttctatttttttctgaattgtatttctatatggactctatactctacttctaatatttcttatttttaattctgaatttttgttatttcctaattgtatttctatatggactctatactctaattctaatattccttatttttattccaaatttcagttatttcctaattgtatttctatatggactctagtatcctcttctaatattccttattttttaattccgaatttcaactatttctaaattgtatttctatatggactctagtctcctcttctaatattccttattttttgattccgaatttcagctatttctaaattgtatttctatataaactcatctttcaatattctttattttttaatttcaaatttcagttacttctaaattgtattcctatatggactctatactttacttctaatattccttatttttaatttcgaatttcagttatttcctattgtatttctatatggactcttgtcttctcttttaatattcctttttttttaattcctaatttaactatttctaaattgtatttctatacggaccctagtctcctcttgtaatattcccttcttttaattccgaattgcagctatttctctattgtat

SEQ ID NO: 28733 - DNA, 15857 bp, Oryza sativa
ccctgatgaaaatcactatgcatacgtggaggtcaaactacgtccttacatatatgactttgggagcttctcaacttttggaggattcactatgaacagcatgtgtaaagggtatgagagtggcttaatagtcactactggagaaatgatctttggtgggtcggacgatttccacaatagtcccagttccaaaaagaaccgggacaaaagaggtttattagtcccaatttattactccaacgggactaagagataccaaccgggagtaaagatcatctttagtcccggtttggcctctgatagggcatgtcaaacccctgttggggggctagggaactaaagatcgtctcatcaaccaagactaaagatattgcagatctttagtttcggttggtgttaccaacagggactaaagttgtacaactttatatactccttcttcctcctccagcctgagccattgctacaaaatgaagctttgagggagggaggtgctgccaaaatttttagcaattttttttggtgttaatatacaaatttgaggtctctaaaacattagcaacttcatcctcctctattttttgcttagcatttacatttagagctatttttttacacatttttccatctagaaaatgtgatggaagatgatgagagagaaagtatgtgtagggaatatagaatatagacaatttgtttatttcgaattttataaatactagtttgaataattacatataattattgtatgaatgtttaattttaaaactaagttaatttaaaattaaaataagtacaacatattaaatatttatttacaaatttaaatataattaaaacatgaataatatgtggtattattatataataatgattgtatgaagaattatattcaattattatatcattatttaatgagtttgtattccgtgaattttatatatttatgatttatatgcatttcatgtagatggatcggcaatggatgtacgtggaccagcggttgaaagagtttattggcggcgtgcattattttttgggtgtggccaatgataacaagcataatgttttataagctgtccatgcaacaagtgcaaaaaacaaaaggtgtattccactgcacgaagtattcattcccacctgtttcagtgggggttcatgcgtagctacaatttttggacctcgcacggagagttaggggttgcaatggaagaagatgaagtagaagatgagtaaattacggactaggctcaatacgggggatttgaagaaaacacaatgggcgaggccgaggtggatgttgaaggtaatgacggtgctgataaacttggtcaaatgttgcgggacgtacaggaggactgcgaaagtgaaaaggaggtgcagaaactggagcgcatgttagcgaaccacagaacatcgttgtacccaggttgtgagcggggccacaaaaagtgggtaccaccctggaattcttgcaatggaaggctaaaaacggtgtgagtgacaaggcattcgcgagttattgaaactcgtaaagaacattcttccagaggggaaaaaattgcccgaaacaatgtacgaagctaagaagacagtctgccctctaggtctggaagtacagaagatacacgcatgtccaaacgattgtatcctgtatcgcggtgaggagtacaagaacctggaagcatgccctatttgcaaagcactacgatacaagattagacgagatgatccaggtgaagttgatggacagccttcgaagaagagaattcctgctaaggtgatgtgatatttccttataataccaaggctgaagcggttcttcaggaacaaatcacatgctagaatgatgcggtggcacgcagaagaacgtaaacaagacgggatactgagacacccgccgacgggtcatagtggcgaaatatcgacagaacatttaaagacttcggcgaggatgcacgaaacgtgagattcggtttaagcacggatggaatgaatccgtttggagagatgagcagtggccatagcacttggccggtcaccatgtgcatctacaatctccccccttggctatgcatgaagcggaagtacatcatgatgccgattattatttaagacccgaagcaacctggtaacgacagtgaggtgtacctaagaccattcgttgaagatttgaaagtgctatggaggaaagagggtgtccccgtgtgggatgaggacaagcaggagtatattgaatcacttttttgttctaaattagatatgcatattaaatctctcgttgtttctccttcagtgtgcaaagcgggatcaggggactaacttgtgtggctactatgtatactagtatatgcactgcctagcacaccaaatcaggactggctaggacctagaagtacataaaattattcatccattaattattgctccattagcttattggtttcatatatataatcccatttttttcaaatgactgatgatttacatgatagagaacctcacccatgatgatttcataagggttgttcaacaacaaatgatgggattcatcaacaagcagattctcgctcccacaggagaattatataacgatggaaagcctattcatcaagccggtccttcttccgatctcacgaagtcgtagtatatgacaaaaacaaaaattacaaagtccgaaggaattgtcatacatgtatatatttatatatgcacacatgcatttacttttgtgtgtacttattttggtaatatatgtgtatatttacttaggtgcaaactcatattttgttaatatatgcatatggcctctacttacttaagtgcatatatgtgtatattatatgtatttctacatatgtatgcaaattgcatatatatgtgtaaaaacatatagtacacatatatgcacttaaataaatataggccatatttacttaagtgcatatacatatatgtgcatatacatatatatatgcatagatacatatagtgtacacatatatcactacaagaaatatgaccttctgtgacgaatttctcgtgacgtcggagctattcgtcattagcacatttcgttttatgacgattagtatgagatggggtggcttagtgacgaaaaaaagatgttcgttgttaataccaactagaaatcgtcataaagtattgggacatcatgaagaatattaatttgtcatatatttatataatgcattaaatatattaaaagttaaagcaatttaatcaagtgaattaatgaagaaactaaaattttcatataaaaatcatggccgaaaatatttttttaatatcctacgtgggctaaattatactctaaaattttccgtgaattttagaagctcaataactaattttaataccacaaagtttatttaacctattaaaataaatagaaaacaaattaaaatcactcacttggtccttgggcctttttcggcccaagtattactctctccctccctcaacccacagcctctctttccctcttgggccgacttccccttcccctcctcgctcttgggccgccagcccaaccccttttgcttctccctcaccgaaaagtctattttgcctctctcctttcaattcaaataatttttcgggtagtaaatgatttcagatgaaaacaatgtcaataacaaagttgtataacttatcaagatctataacttttgttttggtcattttgctatatgactttgttttaataatttgaatttgaatatcaaattatgacaacttcaaacaacattttcaagtactaaatgatttcaaatgaaaaatttattaacaacaaagttgtataactcattaatatctacaacattttatgtgtttgtgacgtaaatgaaacgtcacctatcataagatctcttgtagttatgtatatgtgtaatatatacatttttatattatgcatatatatgtatttaaacatatatatgcatatatgtataggcagcacacagcacaaccaaattaaaaaaaataaaaaaaatatctttagttccggttgataacaccaaccgggaagtggctgagccatctttagtcccggatggtgttactaatcgagactaaagatggagctttactcccgggtatttgaaccgagactaaagaccaccatctttagtcttggattctccctcctagttcgctacccgggagtaaagggggttgcgaaccgggagagatgaggagttctccagtagtgagtgttacactatgaacaacatgtgtaacttttggagcttctcaacttttttttggcttatgtgagatataggtatgactccactactaaatttaggatattaaatccaccgacttatgaatcatataagccaataagggccttatcggatggcatgaagctttggctgatcagctaaatctgccaaattcaattcagccaaagaaaaaccattgtttggcttattttgcttatatggctggtgaaggattttctatggctggtggtattgggatttttattttctgtgtatgttcactagagagtttccataattagccacgactgatgatccaactcccttgcgggtcccacttgtttggctgaaaagcctcagcccaagcctcagccaaacaagccatccgatgagaccctaagctaacttaaaacctaagctaataagtctaagcctaaataacgaggctttatatagttagcattgttacatttgtgattattgtacttgtgaaagtacatgagtattgattatatgtgtcgaggaatgatcctctctagcgggtgatcgtgagacaccccttttgtgagttcggccgggggaaagggcgcgttgataaggatcgtatgtccgcctagagtcttccgagaccgcgcgtgagagctgggattatacaggttcgggccgctacggagcgtaataccctactcctgtgtgtgggatttaggatggagtgttacaaaggttcctaaactccagggagaactctaactcttcttcccctggggctcaggctaactgagagtcgtcccctcctctcggtgaggaaggtcctccttttatagttcaaggggataccacatgcaccgcctctacctactccttcacgggagggggacccacaccgcctgggtcataccgccattcgtgccttcgcccggaagctaagcagccgtctgtccttgagtgggacccagcgtcgtcccccgcctgacacgagggacgcccttgtcattcccctttaaaagaatggagacttttggcggttcacctcacgtggagggagctcctgacggtacattgatgggatggagcataactgcccccactttgctgagcacagggtggaacgtgggggcaccgccgctcgtccgatcggatgtgaccggtcacagaccggtcacaatccggtcaatcgggcagtgctgcacgaccgccctcaccgcattaaatgtggcgagggacggttggggcaccgcgcattgatggcggtccagcttcgaccaccgccccactcactcccctgccacgtggcggccggatgagggcctcggggagaggcaacccgagggcccaaggggcgcgacgtggcatcccgaggccccctggctgcctcaacgtcgtccgaggtgcggggggagggcaaggctgcatggccgcgtggctggatgggaaggagacttccctacacttcgcatacccccgggaccatatcaccgacagtagcccctggaaccgcgtcggacagtggtcctctgagggcggtctagcgcggtgcctcatgacttcccgtgccatgactgtgggccccgcggggagtcaaaacggccgccgccggctggcccggctcgtgcatcagccatgatgacgacttgaccgctactaattgcgccactcacggtggtacttagggcgcgaaaatcgggggctctgccagaccacacccagaattatcactcgacgtcgcctcgactcccccgcttcttaggcaagcgatgggactaacggtgggcccgcctagccacaaccgtggtcatcgcacgccccgcgccgagtgcgccactggcaggcgcattaaatgcggggcgcgggattagtggggcggacgggacgagtgggcgcgagaaccgaggaggcaaccacagcggcgagaaacgaggaggcgggcgcgggcgaggcgtggataaaaaggaagagaggcagagagttcgtctccttcctttcgctgactccacactcgcatactcacaccttagcccccagcgcttctcttcctccatcgtgttccgtgcgccaaactcctcgccgattcccgccggctatcatggcccaagacgctggcaacgccgttctcccggcatcgcacattacggcggagaggcaccttagcctcatatgcaagatcatgccggaggatgccgccgtgagggcaggggagacgcggccgcggccgcggtacctggagcggtccgtgcacctcctgtcctttgccatggcggggttgatcccgccgctctctaggttcttctacgaggtcttggatttctacgagatccatgccttgcatctcgctcccaacgctgtgatgacgctggccatgttcgcgcacctgtgcgagatgttcgtcgaggtgcggccaacgttgtgactgttccagttcttcttcgtcccacagctgcagcaaggcgcggtggtgggaggatgctacttccagccccggccaggagtggcggggcagtacatcgagagtcacctccgcaagaagtgggaggactggaagaaggactagttctacaccgtgctgctggaccaccagcgcctccggccccccgctgatcctcccgaacgatctacaggctggctggcggtctcggagctgggcaaggagtacgacgcggtgcgggatcgcctcaggggcctgcgaagccggggcctaacgacggcgatggtgttcggcgactatttccgtcgtcgcatcacgcctctccaggagtggtcccgcggcacgtgggagtataccgggtacatcgaccccatgcgcacccaagtgggcgagcgctgggattggggcgaggaggacgcgaagacggtggttcggcgggtgctgggcctggacaccatcgaacaaatgctggttctggatgggatcctccctctctgcagtgaccccgaccgagggaatatcctggctgtgatgacggctgtcggcgctggtaggggtcggccccgccggggcgccgttggcggcggtggcagtgacggcgtaggtagcagcagtgtgaccgcgggtggcagtcggaccggcggctccggcaggggtggcagctccaggacgcctgatctgagccgtgggcccggggggactcggccgtcgacccgaaagggaagcggaagatgtctgagtctcagccgccctcccccccccacccccccgcacggagggggagccgagcaaacagtcgaccgatcaccaatgggccataaacgccccgccgcgcctgaggcagggcggaagaagaagcggctctagaagatagggcagacagagccgtgtcgggggagcttcgtcgagcctccgaagtggacgttcaaacgcccccttcgcaggtacggtcatcaatgcccggcccgatgctctccatccactttagcttcttgcttcttcctcttttttactttcttaacgcaactagggttctcctgtagcgagattccttcccaaggggcctcggcgttcgaacacccccaggggtcgaagcccgagcgaccgggacagccgggatctggctgatccggtgctgcggagcctttgcagccccccggcgtgcggcccgcgggccgcccgccgggtccagctccgagtccaccacggccgagaccgccccctcgagggaggagggggcgcaattcgccgtgggcgatagcggcaccgaagcacccatctggggcgatcccgagggtgcaacctacgaggagcgctgctcgggagcggagaccgaggcaggacgcggcccggaggtcgagacgggacgcgcaccgggggccgaggtggggcgtggcccggagaccgaggctgggcgcgggcctgagcctgaggccgaggctgaatcggctcgggggcccaaggcggagggcgacggcagcaaccgttctgctctgcacctggggcgccctccgggccggccacgcggaagggggactgtcgcgaccgggaaaattgccttttcccgaacgctagtgtattaatccccgtcccaggaaaagccggggtacaccatacaaacatgatataaaagacacatctttattatatcgataatatttacattattacaaaggcacttagggcctgacaatcaaaaataaacggcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgattctagagctacacagtgttattaaacaaggccgtgaaccctcacgaacctgccttaacccaaggcctacgatgatttggaccgaactggcaacccgacctgggttccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttacgactagactgagccacaaactaagccttacccattagacatgtggaagtacggtagtgctttgcaacagaggcccgagcttcatccttatagtggccggggtgctacttcccacaactggcatgcacccaaaccccaccgaaaacaggttttaggggttttgaaagaggaagagaggtgtatgtccaattccaccatcaaccaataattccatagtgtccaaatgatatgagacttcccaaagtctaaagttataaaaccacctaatgttgcctaattaaccagcgaagcatctacctaagttcatactagtggaaccataaatagagtactcactagttggggttttgtttaacctagggtgaacaaagtaataataacaataacaataataataaggtcataacaaaggtaaataggtatggctagataaaacagtgataacgcgggaatttaaataaagcggtaatgcaataatttaaatcaacataattttacaaactgggattcaatatgatcaaggatgatgtgacttgccttgctcactttcccaaacgccggcttcaacttccacgaagagcggatcttccgaagctgcagcgtctacacgaccaacggaaaagaaaaggcttttactctaataaactccatacaacaagcaggaacaaagcacaaaaatgggttctttacttcttaaggaaaaaattagagacttgaacggtccaattccgagttcaaatggccaagatatggccatttgaagtttatatgctctttaaatggatatttacgaatttcttcatttaattttcaattaaaaaatcctatttattgcgtcagccgagggagcgggcgcgcggaccgggtccacgggaagtggggcccacgcgtcagccccacggtccacggtggactgggcgcacgcggctggcggcggtcggcgccgtgggtcccgcgcgtcagccgcacccgcgggcgcgggcggctgacggccgggcccacttggcagccgcgagggcgcgcccgaaggcggcctcgccggcacggccgacgggagggggacgcgcccgcgccccgatggtcaccgccggcgaccaccggcgcggcggagcggcacccgagagagaggagggaagggggaaacgaacggagcggtccacggctcaccccgagacagcgaaggcggcggaaacgacggccggagcggaggaagacggcggcgcggttcgggatgacgagggcgacggtgctccggcggtcggcgggcgaaacgaaggggcggacggagtcggcgacgacgcggcgaagccgatggaggtggcgccgagtcgggaagaggtccggagcggcgacggcggcgaaccgaaggtcggcggcgacggcggagagagaggtgaacggcgcgagcacgaatccgacggcgagagcgagcggtgagcggcggaaacggaagagcggagcacgggcaacgtttttatagcgccgagagggggagagcgcggccggagaggaaggaaaccggcgcggagatctcggccgccattgaagacgccggcgacgattgcgggatgaatccggacgaatccgagggagagagagagaggggaaaacgggggaaacgggagagggaatcgcggggaataattccccccacttcaatgcgcgcggggacggcgggatgcggcggattcgcggcggcggcggcgctagggcacgggcgggcggcgggcgcggcgcgaggtcggggatgacaggtgggccccacccgtcagcgagggtggcgggcgggcccgcctgtcagcggcgcgcgcgcgggggaggagccgatgggccgcgggggaagagagagagagagggactgggccgagccggcccaagagggaagggggggggaaaggacttttagggattttctttttataaaacctttttaactttgtttatttcttctcaattattatttgtgctctgaaaattccactaaaatttgagggctccttttagaccaaggagaatttaacaaaaattctccgggccacattcgaatttttcttatacgtattttaatgtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttacgtcttgacaaacttccagcaaaacttcaccactcggaactgcttggcttgacctcctgttgcggatggaatcttctcttcacctgacttggaccagggtgcaccttttggctgactcagactaggttgcggtagtgcagtgatgcttccgttccagaacttcttatgattcatatcttcggagtcaacctcagacaagtcaccacttcatgtcatgcgtcaacactagcttgtcattactaggataccatgcttgtcatcataaggatatcaggcttggcgtttccttccagcttaccaccatacgctttagactatgatatcccgcttactacggatatcatgattgacaacttgccattaactgtctcatattggctttcctggtctccagtgctaggtacttctgctattcgatgccagggtcaaccattctaactataagttatgcttcccaagagaaccaatttatcccgcttgacatgctttgacgtcttcccgaatgactttgctgctggacttgttattgtctgatcgtggtcctgccagacctgaagcttcgttgttggaggtgattttaatctgacctctgtagactatcttcgatcatatcacttggttcataactgggaatagctcccacgaacaagcaacgcagattcactttctttatgttcagtttacttcccattattatcttcaggttgtcctcagttagcattcaacgtattcctttacacctttaaccttgatgtgttctttcccattggatcatctcccaagacatggcattacctggtaaccggtgcttgcacttttcactccgtgtagcatctgataccgagttgaagatttcactccttgccttcatagaaacatttttacctagatcatctcgcttacttaatgacaaggtgactgttgcggggcaattactatcaggggtcgtccttgagcgatgcagagcatgtttctgtttatcaatcacctttcggcctacttctttcatgctagagaacatctttgccaatctcttttatcaatcatctttcggcttatctctaacaggtggtattctttaatgtggattgcggacgcttctggggacgatgaggtcctttggcttgctgcctttcagtgaaaccttgatgtggtgcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccagataaactaattaccaaccatcgactattatgttctcaaatattgatgtctcctggatctccttaactgttggcaggtatatccgatcttatcaatgtagaggcatggcgggtacccttaggggtttcctccaacaatccttatcttgatctgtaaaaggcgtatccaaactcctatcctcaactactgtctcgttggctttttaacccaacacagtttaattgtttttcttttctatccacaggttggttattaactcgaggttagaatatagttcctctgacacgagaccctaggtctcctttgtcagtaaacaattatacacatgatcacatatccgcatctttcaaacgaatcctcagggaacttgtctgtattacacatttctcccttattacacgaatacaaggcactgccttaaacaaaaagggaaggtgcttatcatcggtacattgtatcctcaacatgaatcatctctaaacatagcaagctcactgtttacagacatgattatatttatgaattacatgattgctgcaaactttcgattacaccatgataagtagcgaactaaaaaccacaaacatggctgctcattttgattctggagagatatagctggcattgttctagtgactgcatccttgattggttctgtgatgatgtgacaggactgcataatgctatcattcacaggagaagcttccttctgattgctggttgaagcggatgacggtcttctgcttggtatcgccctccggaggttgattgcccttggctcggcctggagtaggtcggggagagacacaacttcttccatctacgacaattctttgctgaggctgtcggtgcagagaatggttgctatgatttattgtcgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggagtaatgcccttcttcactgcagttgtaacaaacaataactttcttacactcgggttcttcatcttgtacttgatttctcagctgctgtattggaacttctaaaggtacaacgcagatactggcctctgtcttgtcagctggtggctggggctgaaattgagcattgacaccttgtggtagtgcactcattggagttggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaactggaatcttggcgaggatttgtgtttccttgatgcttctctccgttggaactggcgggttggttggccatcttcttcgttagcagaaaactgaatcgacaatcttttggtacatgatcagttccttctcaaaggaaacaagtgatcctgctcgttggacacctgtcgggtggatggtcttcctcacaatgaacgcatgtagaggcacacgagctggcaacatgaccgatttctccacaacgagagcatgccttaagttctattttattctggttaaaaccttggggaggcttcgcaccttcatcatctgaggagacttgatctgaatcttcactatcagacactctacctccattagctaaaagatgctctgtcaactgttgtgcacctcggaaggaatttcttctctgatgttttgtcattcctggtggaggccattctgtgctggtaatgatcatcttacggacttcatcttcggttcgcattggtgcttttcttttctgctgaggacagttccttgcatagtgcccttgctcatcacacctaaaacagatgatacttgcttcttttgagtcaacatgtggcatggcatgaggggccttctgggatgttggcggtgcgctgacttgtggtgtgagtgcttggactgcctccaactgcacttgaggttgcatctgactcgggttcaaagttggcatccgatgctgctgtagtatttctataagcaatttgttctggttaatcaggtgttggaccactgccgcacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttctgcgacgggttctccaagatcttcactcctgcttcacagctggcttcactgcttcctccacttcactagcagatcctgcagtcttctggagcttcggcaaacaactgacgatgtcttcttcttcgcaaagctgaccatctagtactagttgaaaatccgaagaaagaaaagagtaaaccttttgcaaatagcattaggggaaggagaaaaagaggaactttcgcaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttagggcctgacaatcaaaa

SEQ ID NO: 28734 - DNA, 3455 bp, Oryza sativa
cccaagaggaagggggggggaaaggacttttagggattttctttttataaaacctttttaactttgtttatttcttctcaattattatttgtgctctgaaaattccactaaaatttgagggctccttttagaccaaggagaatttaacaaaaattctccgggccacattcgaatttttcttatacgtattttaatgtttgccaatttcttttcgaattttaattaattctattattccttttagaagatgatttttattttgggatgaatttatcaggacgtgacagggaccgagcgcagcccccagtcccgcagggggtccagccgcactccgtcgtcccgggggcggaccgtgaccttttcttccccgatccccgcgagtatggagccgctcctgcaggtgctcgcccccgccgactccaccgtccgggaggggctcaacgcccaagttcaagccctggcggacgagcgagcagccctggaggcagaatgggcgcagctcacggcggaccgtgcgcgggtggatgagggacgccgcgccgtggatggcctggtggagacggggcgcaaaatgtgccaagcccggctggcggagatccaggcgtgcgaggagacgctggactcggtcatgcgggagacggaggaggagcggtaggcggcgctcatcgcctcgagcgccttagaggaggcgctaggcaacatccgcctgtagtacgaagcctacgccaagcacctggcgaaaagggctgaggatgcccgcggggtcctcgacgctgccgcggcccaagagcggcgggcataggaggttgacacctcgctgcgggcccgggaggtggcgcttgaggccgagcgcacccgctccgcgcaggagttctgtcacgaccggaaataacccaacgggcgttccttacgtgcgtgcattattccttgtcccaggaggcaaggtacaccaaaagttgatacaattcagagtttaacaaacggaagcgtaaatagataatttattacatgggcagcgaaggcccagcacacacaaagacaaacgagaaacagcggaagactagggcgacgaccacaggcacttgacggcaggcacgagctagacaccaaagccttcatcttccagaggctcctcttctgggtttgggaaaaattgagcaagactgagtacaaccaccgtactcaacaagacacacccacaagtgcagaataaatgcaagggagtacaagggagttatactataaagggttagggttgcagtaaacagcatttaaagatatttagttgctcaaagctattttgtaaccacgattctagaactatacattattatttatcaaggccgtgaacccacacgaacctgccttaacccaaggcctacgatgattcagaccgaactggcaacccgaccctgggtcccagctcgtcccaagccaacccaggccaaccattccacattttagttgttaagcatgttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagttttcaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccctgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaatcaattagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataattttaaagcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaagtcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatttcttcatttaaattttaatttaaaatggatttattgcgtcagccgaggggagagggcgcgcagaccgggtccacgggagtggggcccacgcggcagcctcacggtccacggtggaccgggtgcacccggctcacaccggccggcgccgtgggtcccatgcgtcagccgcacccgagggcgcgggcggctgacggccgggccccacatggcagccgcgggacgcgcccgaaggcggccacgccggcacagccgacgggaggcggcgcgcccgcgcccctatggtcgccggcggcggccataggcacggcggagcggcggccgagagaggggagggaagggggaaacgaatcggcggtccacggctcaccccgggtcgacggcgacgacgggaacggcgaccggagcggaggaaggcggcggcgcggcacgggtcgacggggacggcggcgttccggcggtcggcgaccgaaacggagaggtggacgaggtcggcgaggttgcggcgaacccgaagaaggcgacgccgaagcgggagaaggtccggggcgacgacggcggcggaccggagctcggcggtgacggcggagagagagagcgacggcgcgagctcgattccggcggagagagagagcggcgagggtcggaaacggcggagggaggcacggggagtgtttatatagggttgggagggggagagagcggccggatgagggggaaacggctgcggaagatccggccgccattgatgcgccggcgagatttagggggaaagatcccgaacgaatccgagggagagagag

SEQ ID NO: 28735 - DNA, 21828 bp, Oryza sativa
gggggaggggggggagaaaagacttttttgggtttttctttttacaaaaccattttaactttgtttatttcttcttaattatcatttgtgctctgaaaattccactaaaatttatttacgcattttaggcttttaggaaatgtacaaaaatcctccaagccttatttgacttttaactttgcacattttaattgttggaggctttcacacggattttaattattctaggcataattacgaggatgtattttagagtcgttttgggacgcgacaagttcgaggccgcgatacgccggcggatcgaggtcctcaatcgcaaccaatgcgagcaggaggggtgcggtcgggcacaggcgcaacgggcccagaagctggaggagcgggctcgagcgctcgaggagcgggcgcgtgcgttggaccagcgcgagactaccttggccgcccacgaggcaacggcggccgagcggaatccaccctttgcctccgcgaggaggccttggccgaacgcaaccggaccaccctcgccgtcgaggctttagtggcccgtcgcgcggaggagttgcggctctgagaggaagcgtggcgggaacgagatgaaccgctggcgggatggcggcgcgccggctaggcgagcagctcaccaagtgtgaggaggccgttgctaggcgtgagacccgccatctggaaagcgcccgtactgaacgcgcggcgatggcggcgagggtgtccgagctgggggccagggagaaggaactggcagcgcgcgggcagcccggcgacgccgagttggtcagccaactcaccgcggcccaagatactcttgccaatctggggcgcctggtacaggaccaggctggggagatcgcggccctccgcctcaccaacgacaccgggcccggccaactctacgatgccatcgaatggctggagcacgcaggacgccgtgtgggcatctccatgcgccgggacaagaagctctcgcccaccaggccggcgctcgcacttcggctggacgagatggcggcggacctggagaggctggagaaggaggtcggcgatgctgtgaagtcgtcgtcggtttccttggcgcgggctgcggtggagcttgtcctcatgagtcatcaagctccttgtgacctcggtttccttccgtggtgcgcgctcgaggatttccccctggggactgaggcgaggacttgggagcaggttcgggatgcggccgacgcgatcatctcaagcttcgagaggacggcccctcggttcaacctcgcgcttccctcagacgaggagagcgggagcgacgacggcggtggcgatgacggcgacgaggattggggcaaggtggtcagcggcgccggactcggaggcgggggcactccatgactacccccgcctcttctcctttattttgttatgtgcttgtggcgaacgcttgaaactctaggccatcgtgccatcctggttgtaaataaagcttcccccttgcacctttacattcttgctttctcttctgaatgtctgtggcaaggaaaaaaccaaggcgaacgcatttagttgacttctttacgatcaggttgccgtttttactccctttgtccccccccctcgggctcgttctggtaaaaaggggggaattcgcacttggtctgcggcacctaggtggtgaggggcaaggccgtcgctccgggggagccacccagcaggactagccagaccaggactacgatgactgggggtcggggatggccatgtgtaggccctttgagcccctagggttcgccgcagcccgaggcgtggcccgcgttcaggctccccttcggtgattttcaggttacccgacaccacttagggtttggagcaagcacgaatcatccctaagccaggacgagccataggaaggagcaaaaaagggcgtgcaacagcttttgattaagcagaaagatttattgctgaggaaggaagtggatacaacatatttaacagtggtagccaccggccaagcccgcacaggtcgagggatgtgcgggggttgtcccgagccctaagaaagcaaaaaacgcgcgacattatgagtagaaacggcggagatgctcgatattccaggggttaggcaactttgtgccgtcctccgtggctagttgaactgagcccggctgggggacaccaatcactttgtatggcccttcccacagtggtgagagcttgctcagccctaagcgcgactgtatgcggcgtaggacgaggtcgccgacttgtagtgatcaggtccagacgtggtgccgatggtagggccgcaagctttgctggtagcgcgccactcgcagggccgcgcaccttctctgtccttccaaatagttgaggtcatcgcggcggaggtcatcctggttggcctcattgtacagcgcgacgcgaggcgaacgcagggaaagctccgagggtaggaccgcctcggcgccgtacaccaggaaaaaaggcatttcccccgtagcgcggctcggggtggtccgatttgcccacatcaccgcgggtagctcctcgagccaagaatccccgtgcttcttcaggatgttgtacgtcttggtcttgaggcctttgaggatttcaacattggcccgctcgacttggccgttgctcttggggtgggtgggcaaggcgaagcacagcttgatgcccatgtcgtcgcagtagtcgccaaacagctcattggtgaactgggtgtcgttgtttgtaatgatacggttgggtactccgaaccgggatgtgatgcccctgttgaacttgagggcggaatgcttgtcgatcttgacgaccgggtaagcctcgggccacttggtgaacttgtcgatggtgacgtataggtgctggtatccgccgtgggccgctttgaagggccctaggatatccagaccccagaccgcgaagggctaagagagcgggatgacctgcaaggcctgggatggctggtgggtttgtttggcgtcgaatttgcacaccttgcatcgccggacccattcttgggcgtcttgcaacgcggtcggccagtaaaagccttgtcggaaggctttaccaaccgacgtgagtgaagctgaatgagccctgcactcaaaatggtgggcatcggcaatgagctcgatgccttgctcccgagagatgcatttcaagaggatcccgttggtagcacgccggtagagggtcccttctacgagcacgtactgcttagagatgcgcacaagcttctcagcttctgcgcgatcctcaggaagagtgttatcgtcgaggtacgcccggatgtcagtcatccaaacgacctgacgaggggggtcggggtcgaccccctcgggccccgaggcctgtggctcgccaggcatcggggcgaggaccgtggcgccaggctccctcagggggtccaactgcgccgacgactgcaggagcctttcctcgaaggcccctgggggagtggggctcgtgccaacgcgatgcgcgacaaatcgtcggcaattgcgttgtcgtgccggggtacgtgcctgagctcgagtccatcaaagttggggcgaaaattcaggggccaccggacgttccagagacttgccacgaaggccctgcaaccggtccctccaggggtgaacgcggggggcgggccgcctcgtgtggaggagcgcgacactccggatgaggaggcgccctcccccatgcgggcagcactgcgctcgtccctgcgtcgctcgatgttgattcgagcattgctcggcgggcgggccgtcatgacgtgtggaggagcgcgacactccggatgaggaggcgccctcccccatgcgggcagcactgcgctcgtccctgcgtcgctcgatgttgattcgagcatcctgctcctcgtagaggccgtcatgacgcctccagcttctcgagacccttgacgacgtcggggccgtcgatcgccacaaagtctgggctgaccgacggtccctcctccttgctgatgaggaaagggcggtgggggtacgcgaggtaccagtggcggcgggccggccacccgcagccagctgttgctgggcagtggtgaccaggttggccacgtcgtccaaccatcgctggacaggagtctccggcgccgagtttacggggggttgctgtagaagggctcccgccgcttgaagtgcgcctcggggcgagccgccgtcaccgtacgtcaggcggcatcgtgccccgacgctgcgcggtttcccctcgcccggcggcggggagagggccgagccacccgaccaggtgggatcctccctccgtggggggtcgcggtggggaggagtcggagagttgtggcggcggtggcgggggccgcggctcccgctggcatcctcactcccggagggagtgggggtgtgcgccaccacttcttcctccaagacctcgaccatgatcgttgaggacaaagagaaacttggggtggaaggaaacaacttctttctcaaacgcgcgaattccccctacctggcgcgccagctgtcgaggaatgatcctctctagcgggtgatcgtgagaccccccttttgtgagttcggccgggggaaagggcgcgttgatcaagagtgtatgtccgcctagagtcttccgagaccgcgcgtgagagctgggattatacaggttcgggccgctacggagcgtaataccctactcctgtgcatgggatttaggatggagtgttacaaaggttcctaaactccagggagaactctaactcttcttggtggagctcaggctaactgagagtcgtcccctcctcttggtggggaaggtcctccttttatagttcaaggggataccacatgcaccgcctctacctactccttcacgggagggggacccacaccgcctgggtagtactgccattcgtgccttcgcctagaagctaagcaaccgtccgtccttgagtggggcccagcgccgtcccccgcctgacacgggggacgcccttgtcattcccctttaaaagaatggagacttttggcgattcacctcaaatagagggagctcctgacggtacattgatgggatgaagcatacctgcccccacttcgccgagcacagggcggaacgtgggggcaccgccgcccgtccgatcggatgtgaccggtcacaatccggtcatgcccgattgacgcaggtcaatcgggcagcgccgcacgtccgccctcaccgcattaaatgtggcgaggggcggttggggcaccgcgcattgatggcggtccagcttcgaccaccacctcactcactcccccaccacgtggcggccgggcgagggcctcagggcgaggcaacctgtcacacccagaaattctcgaaccagaatttctaagctgaatgtgcattaaatccctgtccaggaccagccaggatacacaaacgacaattgttgacatacagacccacatcttacaaaaatataaaagattacaaatgtagcgggaaagattaaagcgagctaaaccgggaagcttgacttcagcagcgggcgactccactccacaagcaaaccttgacggcagcaacgaaaccaacctctctgagacgactccaactgagaagaacttcatctctggtgtgggggaaaagagagcaagactgagtactacccactgtactcagcaagtcataccggaagaggaggtatgatgcaggatataaccaaaggaagctaggggttcttttgcataaagcaggcatttcaaaacagtagttgaaagcagtaaaacaactgtagaaattaagcaatattaaccaatcactatccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgccaagggggaaatcgtgacaagaccctccacataaccctcccctaaccatccacaccacgctaaggtttcacccccaccccttaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgctatgggtgcgaccagcaaaaccatgcacccatagcccaccattcagtgtattttaattaattaacacccttgcggtggcaccaatctaaagctatgccaatagacaaagtctatgtaataatgtgatccctttttgtgtactagtggagctaagcatggctaagcatttcctaaaccaacatctaatcattttgatacccaggttatcaatggcatatggtaaacaataaatggctgagtaataggacccatcccacatgacattgtaaaagaatgcaacatttaatagaaatgcagggtgtttgtaaattgggtacaatatgatcaaatgtaaagcatgacttgccttgctctcgcactgatgagaccacagcaacgtcttcgagaaaccgcggatcgacgaaacggccgaaatctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataatacccagggctgacgtcagcgaaggggggggcggcgccgacaggtgggccccgcttgtcagcgcacaaggggagggagagggggctcgggcaagtgggccccactggcagcggcacaaggtggccggtctaccatggaccgggaccacacgggtggtccaccgccggtccacgggactgacggtccggatcggcctcaaagacgatcggacggcgcggggaaggcggctaggcacggctcggctcggcttcaaagccgaccggcagccatggcggccggtggcgacacgcgcggtcaccggcggtgaccggcggcggcgcgcgagagccggcaatggcaggcgacggtgcgggaggcggcggcggacgacgcacaggccggcggcggcggacgaaggcgatggcgagcgcagggagcggtagcgcgtgcgggacagagggaaggagggaggagaggagctcctcaccgtgagcacggcggccggcgcgaagaatgaacacggcggcgatgaccggcgatgcggaggcacggacgggcggtggcgacaccctagagaagatggagaggcgttaggagaggggacgacgaccacggcggcttgaattgccggccggagatggaggggagggaaaaactcaccggctcgcgaggggagaggcgctccggtgggattccggcgacgcgaggcggcggccgggaaagctcttgcggcggcgaagctaacggcggcggcggtttggcgcggcggcgactctagcagtggcggcgcgcggccgaaggcggcgacaagcggcggagctcgggtgtcacggcgcgggcgcggtagggggcgtgggagacgacggcaaatggggaaaacgagggaggggactcgggggagggtttttataggtgcgggagggggcggacgtggccggagaggtggccgatttggccggcaacgtgggggtggagagagagagaatggagggattcaaattcgaatcccgccccttgcgagcgcgcgcgagggccgggagatgggggggagagggcggcgacgtggggaggacgcgggagcggcgcggcgtgggcgcgggaggagcggaggaggcagcggcgcggcggtttcggcggcagcggttggagcttcggctccagcggccggaggtgggagacgaccgacaggtggggcccacttgtcggcgtcccgagagaggagggaggggcggcttgggccggcccacaaggaggaggggccgcgggagagggatgggccgacggcccaacgaagaaaaaggagggaaaagaaaagaaaaagagaaaaaggattttcctgggatttaaaattgcactttggtgatttttaattggttaaaattatttccaaggctctgaaaattccactaaaaatcttgttaatgcattggagcacggggaactcaagaaaaattccaccacgctatttccgattattaattgcatttattaactagggatttagctctaggttaattaagataatttcttcgggcaatttatttaaccaatttttaaagcaagaaaagggggggaaacttcagggtgtgacacaacccgagggcacgaggggcgcgacgtggcaccccgagtccccctggctgcctcaacgttgtccgaggtgcggggggagggcaaggctgcatggccgcgtggatggacgggaaggagacttccctacacttcgtatacccccgggcccatatcactgacaatatgtgacagtaatgttattcttattttatctataatttactcttttatctatatttgatcatgtttctacaacagtgaaactggtgtgtcgaagatacaattttctctcctaaacttttctactttcttgcagtcttcaattgattctaagttctttaccctaatttgttgtttatagtgatatcactatgtcaaatgaatcgtgttaggatgcaatagatttatggaaaataagtagactattaatgtgttgtatgctgcaaacagactgccctcgctagtgcaaagtacctcatagggctgatgttattaagactgtgtaaaaggttgctgcagtttgtgatgacctccattgtaccacattgtctaagggatctgatgatagcagcaacatcaatgaagccgtggaaatgagcaatggcaggaccttttgttgtttttgctgttgctactactgctacaactaccctgccatggtgttaacgccaaaatttagtaagccccgaggtcatcatcggcttagcaaccatattggcttcagagtcctggaattggccaatgagaattgtcactcgtcggcagtcagattcttagtggattcggttaagaaaattaatcaattaaatgaagcttatccagaaaaagttgagttcaaggaggatgcgacatgacaatttatctattaattaggaagagttagttagtttccttttatttttacgaaagtgtgtttagtgtctttaggacttgtatcttttcttttctctttagaaaagtttatgtcttgtccaataaggactagtatctacccatgggtatagatatgtacacatggggtctttgtaatctatctccatagatcaatacaatatattttcggcacatcgccacccttttactttcaacgagttcttgtttcgagttgggttgcatcggttttgatctcagacaaggggtaaagcttgtcatggcggcttgtatcggcgggattagggcttacattattttgacactctaatctagctaatgcatctgcctatttatcatatgtcttagttaatccaaatcgatgatttaattacctgtatcgaccagatcttttctagggttttgctggtatcgacaaaattgtttcatcgatttagattaggtaaggtatccaccaccctgaaaatcagttaaaggcttgattgtttagactttatgcttcttttcacacttcctgcttgttaacagtgaaatttggtaagcctcgaagtcatcatcggcctagagtcaatatccgcttcagagtcctggaatcggcctatgggaattatcaagtcgccaatagttgaattcttagtagattcggttaaggaaattaatttattaaaggaagtttatctagaagtgaccgagttcaaggtggatacggcatgacagtttatctattaattaggaagagtttgctagtttccttttatctttagaaaagtatgtttagtgttcgataaggactttatgttttccttttatctttagaaaagtttctttcttgtccaataaggactagtatctacgcatgagtacaaatatgtacacctggggtcattgtaaactatctcatagatcaatactactcttggcgcatcgccaccctcttttctcgagttttttacttatcacaaccgaacttggcacctgacgcagggttgcatcggctttcaatctccggcgaagaggtaagtcctacgttccgccagcccaagcaattatacctaccggctacgttggtgttgttcaaggctgtattgcttcgatctcttggatcgctctagtttggttgatatatttgcctacctatttattatatatcttagttaatctagtttggtagctcaatttacttgtatcggctgggatctactttagggttttttgccagtattggctaaatcgctttactagattagattaattaatgtatccataaccctgaaaattagtcaaaggcttgattgtttagactgtatgtttctttgcatactttgcgatgcatcatccctagttgtgcttagaaccataaaagctaacctgtctttgattataataagggtttcatcggcgtttcagccgatgagttatctggacgttgcatcggcttacaaggattacatacaagttggaattagccgattacaacaaagatttcactgtgtatctaatcatttggatttaatgctatcggacttccagcctctcagggttatggataccacatacataatagtagttgactaaatctcggcaggacccaccacataccatgttttatacggaaactgacttcggatatggagggagttccggataaggaaagacaaccagagttctatatggaaacgacaaggactactcagattgtatccatattggtttccctagttcaacttggataatgggacacctatgggtataaatacaaaacccctaggaggagagaggagacgatcaacacccaccacaatagacggaacaacagaagccacaacacacaagccaacatatgccaagacaagacgccggatatcgacttcagggataagtacggctagtcccatacggtgtctccggatactgtcaggggagacgaaagcgctatctctgatcttgtcgggcacggattcgaggaggaagactaccctgttgtcgactacgagtcagaccttcagactgccatgtcgacaacagttagataggctaccccaaatattgtactggtgtgattatggtgaataagagcaacaaccggcttcggccaacaggatgtagggttattacctgacaactcaggggcccgaacctgtataaaaatcctcgtccccgtctcttttacctcagtctcgcgtatatcctagcaccgacgatccccatactatacaaataccggaatcgcaacatcaaacgtcgacacagccgatgtatgatttaaccatcggatcacatattctatgatattattgtcagccgattgatttacattggattatattgttattttattatcatcagccgattgtctatatatcgatatttactcaagtatcagactctgcattgaacatatagccgattattcaaaaccctatcgacatcagctagtatcggcatcggctggaattactctatcggcttgttagccgatcgactttttgatctattgtctacatatcttgtcagttgcaggattaaactaactggcacgctcgcatcccatcaagatttaggacctgcattggagctaagcagacatcccagtccttcgtgttgttttccacgtcaacacatggtacttcaaagtaaaaaaaaatgaagtgtttgaacctgttaagaatgtcaccaatacactcgtcaagctgtttgaaagcaaaacatcaaatttcatatgttcaagccagagaactacaccacataccacagtatcctatatagcatttaacatttccgtttcactcctagttaaagaaatggtgaaaagggctttgaccacttatattctactatatttcttttattatagttgattaacttattctactatatttttattcatttcactccaagtaaaataaatggttaaaggggctttgaccacttaaataaattcgtcgtaacctgtgtttttatcacaaaacatgtcagtgttttatcaaatacaaacaaaaccatgtatacacgagagaatttgttcatctggtagtgtttacacaacacatacacatatactacctctttacttgacattttaaaaattgacatactctccaatagatacgttccatcattagtttttctattaaaaaaatggctgtgaaagtaattttcatgacaaatctgtaaatgtcatcttcacatattaagaacataagcagtattacactatgaactctttggtgatcaataaattcatgtttccttaccagaaaaaaaatcatacaccataatgaatatcttttgtttacttcccaacatgccaaacaacgtatgtgagattttcttccagttgtttttacctttctattgatgcttatacatgcattgtctatttatagtgattctattttactctttagatacaatagtaactatcaaccaaattctctcttcacctcccttatttcactatccctggaggtgcaacaatttttttcttgttggcatcaaaacagtttatactagatgatgccccgcgcgttgctgcggaacttcgtatttagaaatggaggactacatggggaggtcacagatagatgtaatagatagcaatccctttaccataaaataatttatttatcttgtaacaaaatatagttgccatgtctaaataaaccataagagattccttatctcgtaatgggggtttatttatctacaaaaatatagttgccatgtctaaataaaccataagaaaattccctatctcgtaataacattctctttcttgagaatactaaccacttgttagagtggaaatattgtgacgatggaaacaaaataacttgtagaattctggactgaaagaattcatagaactgaagataaatagttgcactaacctgatgaatctcccaatgtttgagagaatgtttaattatgctgtgacaaagaacatcctttatactctagtcataaaaaaaattaaagaattaaattacgtcaaccacaaaattgtatcttataaacctgaatgtcaagtaggaacatcatatagcaaagaacgattagcatggacagatccagggaacaatatgtacctgaattaggttcactgctgaaataatcacggtattgacctttcaatcaatcatagtcaattagtgaaaatctgatagttttgttatggaagaaattacttagcacctcttacaaagcaggtatatatcctaggataggcatataataatatctggaaaagccagtgaccattaaccaatgtgaggcaattacgcattaccgaatatattgttgatattttcttgactgaggagtcatattggtggaagtacatgttgtagttgctgatttgggtgggaatgccctggggattgacctcagccgtagcccatagctgctgctacaatgataataggcaatctactaatagcaatgatctgcaagcggaattcagaaataaaacaaattataggtgcagcaatgatagaaaattggtatgcatacctgtgatcttagcgtcctggtaccatattggctcatctaacaaaatgtaacgatcgaataaatttcaatccgtttgaacagggacggtagatacctaaagaagagcccaaatcaaatcgcttcgataatcttagggacaacaggaacaggtcaatttatcatcaatctagcatgactaacgaaacatagaggtcctctcaaaaaaaaaagaaatatagaggtcaatagattgaatgaacatatgtggttcagaagagtaagaagcatacctaggaatatatacacatgcgatttgttgaatgtgaggaggcgggtgaaggtttgaggggagggagaggcagggagaacaaatcgaacgacagtttccagtgatcgagacatggtaataagaagcaaatagaagaaggcaagtggtttggcggagcttgatgcggatttgccgacaaagaagctgaggagagttgtctccattattgtcttcatgtcagccatcaaggctgctcgttggtggacaccggcgttttccatttcctgtccctgagaagatgagcagcctggggggtggtgcctagccaaggagagggagcggagcagtcgggcgaggaatcgccggggaggaggttggggaaaacgatctattgggcttttgacacatggatatgggcctctcctggatggctcatggctctatcgtttcgcttcgggtcgcttcagcgttggtacgataggcaacatgggtgaccatccagatctgatcaaacggctgtagatcaagtagatgacgtggcttaaccacaactcagaaaattgataataactacactaagtagggatcacttgtatggtattataggatgcatagcctccacgaagctacgatggcaaacactaatacaagaggaaacaaatcgctttagagtatattgatcatcttcaccaactgttacaacacatattatacaagtaactaaaagtcaaaaagataatttaaatatgagtaatgcttacatttaatccatgtcatttgtgaactatgtatcatttacgagagaaacaaattgttgtttcattaaagtagaataccttcaatattttccaagcacttttataaaattatatgctcctcttacatttataatttctggttgaaccttacattctacaagtacaccatagttcaagcaatggttgttatgcattaattctctactagtactaataacttattgttgtaaaaaaagcataatatgtgatgcaagtaggacgacatgcatatttgtatactccctccgttacataaaaaacgaatctaaaaccatatgtgacatattctaatactataaatctggatatatgtatgtccagatttgtagtcctacgatgtgttacatccggtactaggttggtttctttggatgaagggagtatgtgagtatttttcataacaaatttataaatatcattttttacatactaaatattaatgttttattcttttcatgtattaatgatgcatgccatttgtttgcggaaggaaatggtattatacttgatggtttgcaacttcatatgtttccttcaccagacaactctttgcatacatatatagtataccataaggaacatttatgtttattttaccaacatgtcaagtaaagtaggtgataatatcttcgagctgttttctaacatctcttttcttacctatttattcactgtctatttctactgattatgttttagtttctataatgggaactaatggccaaattctctcatcacttcctacatttttttcttcgtgtgccttatttcactaaacaactgcaaaatttctttcctagttagcctccaacaaactgcaatggcaaacactaccacgagaaaaaacacattgctcgaggacatattggtcatcctcgaccaacggtaacatcacatattatattactaaaagtcaaaagattatattgcaaacatctctacaagtaacgcttgcattaaattgtatgggtttaaagcaatgcttcctttgcaagagaaacatatggctatttcggcataaaaaagaatttcatcatctattttccaaacaagtaagaaaataaaattttggtcctcctaactattgcgattagttttagtccaacccaggattatttcactaccactattcaccattgtaaaaatcctatcatatactcatccgttccgaaatataaagtgtttcctgtaaaaaaatataagtatttctagatagattctctacccgacatctattagctttgaaatcattaaaatgatgaaaactatgaaacccaaaaatccttatattttgaataaaaaggtaaaaattacaataatatgccattttttcaaaaaaaaagttaatgcaaaatgtcgaaaaataaccaatgcagaaaacctataaattctatgacgtgtagggtgaaaaggaaaaaaagaagggaaaaactgaatccctctgtccctcccgtctccttgccttggctataaacccccggaaaccacaaggcagagagaaggtccttcccttcccacataggggaaaaaaggggaaaaaaaaaagaaaagagaagaagaaatcctccgaaatggcggcgtccggcgagggggcgtcgctggcgtggcggcgggaggggaggacgggcggcggcggcgggtgagctacttctacgagccgtcgatcggggactactactacgggcaggggcacccgatgaagccccatcgcatccgcatggcgcactcgctggtggtccactacggcctccaccgcctcctcgagctctcccgcccctacccggcctccgacgccgacatccgccgcttccactccgacgactacgtcgccttcctcgcctccgccaccgggaaccccgccctgctcgacgcccgcgccgtcaagcgcttcaacgtcggcgaggactgcccggtcttcgacggcctcttccccttctgccaggcctccgcggggggcagcatcggcgccgccgtcaagctcaaccgcggcgacgccgacatcaccgtcaactgggcggggggcctccaccacgccaagaagggcgaggcctccggcttctgctacgtcaacgacatcgtcctcgccatcctcgagctcctcaagttccacagggtatgcctttgttttgttgggatgcttgccttggttgtgttgtgtacctgtcctgtgatcggaggaggaggaggggcattacgatttggaggtcgttgtctaaatttagatgcgaattggaatggttcccgctgatggacgcgaatatttgagtgcattgggtttgtgtttcggtttagtttttattttttagtgcgtggtgaagaagatgctaagacttggggagggatttggtggtttgacttccaacactgcgaggagaaattactattgttcggatgcctgattaggtgattgtagaaatttaaagggctctatctctttctgtgagtgcatgcacgcgttcatgctcgtgtgtttgtttaatcttgcaataggattccatatttgctttcagtgttaattgtttgttttcattggatttagatatatgaatgatttctatgtttttacctggcccgacatatttgaggaagtttgaaacaaatggtgcattttggggattttgctgagtttttatgagcggaggttgcttatgttactagtgacattatgggcatggttattgtcttaatgttgtccaacattttatttgtgaatgcttagatagttagattgatcaacattaaatacagctggttgagttgtctataaaaatttaaaaatgctttcagaatattataacttggttgggatgtacaaaatatgttcgaacacaaatcagctcaaggctgcatgttagaagccttaacaacacccaaaaaaactgtgtgaccgaataaagtagttatcatcttttcttttataaatcagctttgcagccacattcctagtgattttgcagctaaattttaactagtttgtatatttattgagtgtgtgatattactgttcatatggttactttttctgtcagtaagttgtttatctgatttgattattaggtattggcattagttttaactgaaaagaaggtgacatagatgtgatgtgaaatggttaatatggccaatcttactgggatgtatctttaatggtccattcatccattgttagcaagaatattttttttctgtgatgtgaactaacatgtatatcctaaatggaatttttatatgcatggattgttttggaatatgtggtattgctggtgatatagttgtgttggttactttactgctagacaacattttctttttgatatgcatgcagcattaatctttgtgatttggactttttggaaccatctgttgattgttttctgaccatttatcagtaactcagtccagtattacttcacagatacttcatccagtttgttgctcatatgactggctttaatgtaattattcgcatctatttacaataaatgttgctgctgaaatatcatgatctatatgtgtacctttcacttgtaattcatttagtactactccctccatttaaggttatatgatgttttgactttggtcaaagtcaaactgttttaagtttgactaagtgtatagaaaaatatagtaatatttataatactaaattagtttcatcaaatcaataattgaatatattttcataacaagtttgtcctgggttgaaaatgttactacttttttctacaaacttggtcaaacttaaagcagtttgactttgacaaagtcaaaacgtcttataacctgaaacggagggagtaattatttaccattcctggagaactgttttagataccgtactttccaatataataagtcctgaacatatcttttaaattttttaatcaccaggcttaataaaatttggaaggcatgtgttgcaaacttattcagcatcgtgatccatgtttcatcaagctttagtgtgttgattgtggaatacatcaagaatttcatcttggctttctaaaccacaactgcacttctctgatgctattgaatattgctgctgctacaacagtcctatggctacctaatttttctgatagttatcattcttcttttgttgtagcgtgtgctatatgtagacattgatgtccaccatggagatggcgtggaggaagctttcttcactacgaatcgagtcatgacttgttcctttcacaagtatggggactttttccctggtactgggcatatcactgatgttggagcaggcgaaggaaaacattatgctttaaatgtgcccctgagtgatggcattgatgatgatacctttcgtgatctgttccagtgcatcatcaaaaaggtaatggaggtttatcagccagatgtagttgttctccagtgtggagccgactctttggctggagacaggttaggttgcttcaacctgtctgtgaaaggtcatgcagactgcctccgttaccttaggtcattcaatattcctatgatggttttgggaggtgggggttacaccatcagaaatgttgctcgctgctggtgctatgaggtcttacttttatctcttatttcatgtacaactgattgaagttgttggtttcatgctgaacagttctgatggaatatggttgttgcaatagactgcagttgctgttggagttgaacctgataacaagttaccttataatgactactatgagtactttggtcctgattataatctccatattcaacccagaagtgtggagaacctgaattcgactaaagacctggagaacataaagtaagtggactgtttctatcaatatgctgaatcatcttttttttttctcccataagttggcccatcagcttctgtgtagggtgcctcaagcgatgttttttagtagttttctcagcatgtcatttataatggtgtttccatattcactatctatactgttcagcatatcaccattgctataaaatgttggaatgtctctgaaacttcacaccttcaattaatgtttcattttttaccctgtatgaatttgtgactgtatctttttgaagtgtgttcccatattctgtaattttcaaatgtagatcatgtgaaaaccactttcatcgctccttgcactttgttgctagggtccattttctcactgcttcttgtgttcatttcctttctgtagtggttaatgtatttttgtcatttgactgatctgcaggagcatgatattggatcatctctcaaaaattgagcatgttccgagcactcagttccatgacagaccatcagatcctgaagctccagagcaggttactctcttggcataattttgtattattctgttaattcgttttcttgctttgttgtgcaaatttgagaatgtgctcttgtaggaagaggaggacatggacaagagaccacctcagcgcagtaggttatggagtggaggagcttatgaatctgatacagaggatcctgacaacatgaaaactgagaccaatgacttatctgccagctctgtcatgaaggtttgaacttatgcttatgagaatctttcttccatcctatagtgtactttgttcttgagaatttctagttgatgccgtaatagtgatgaatattctctgttattgacgttaaattttaaccatctaactaatgaattaagtttagattgacaaagtgagcactcaagcatatactctccattccaaaatataaggcactatcatccttaacccaaagaccaagaaacaattattttcatctcttcgtttggatcactctaataaatacaattcatgcacctaataagattagagatcttgaggataaaggatttaaaaaacaataatttagttgagaagaggtgctagttaattatttgcatgcatgcacgccttgtattatgaaatatctgaaaaaaaaatggttgtgcctaatattttggaatagagggagtatatagcaataacaaataaaatagcttgcagcttgttatggcaaaactccgtatgttgctagcgctatttttggaagatcatagtgcctaaagttcagtgttattcgtgcaggatgaatcgaatgatgattcctagaagagatcctgcgattctggttctcagcactcctgatttgtacgtgcatgctgaagaacaaggaaagtatctgaagatgtctgatatctgcgcctgaccattttgcaaaacaatgaatgcttttttgggtgcttctaactttcaagcatgtcggtaattctggttagtcggcggcacatcctcaaatggtttgtgccagaggagtgtatgctagaatgattcttgcgctgatatggatttatagttcttttatgttcatacttctccgatgtgttgaactcataccgcagatccgcaatcagttccccctagcctgtccaaacttattttttgtggcatttgaaatccatctgaaccgcattgtcattcatattttgattaaagaatgcctgaagggaaaattagttcaagtgaattcccagcatagctgctgcggctgcttctttttttttctttattttttgaaatgaaactgctattatagttgtcgttggaaggcgtgttgaactgttgattgtccattgttggtcgttggaaggcgttgtccgttgtcgttgaaaggcgtggtcattcggatcaggtgtagttgggggcaacttcatgcattccactgcccgctgtgagatcgaatctaaggacattattcattcgatactataacagctactgtaggtcactgtagaagcgttgctgtagctataatctggtccgttcatcaagaaagctgatggataataattcatgttgtagcttaacttgcagtggcctgtgttgacgcaaaacgtgtcctctgctaacacacactg

SEQ ID NO: 28736 - DNA, 9586 bp, Oryza sativa
agaattttggagaacaatattgtagagaatgtaacttagtgcgtagtacagaaatgcgaggttaacgtagttattgttttcatcaggcacaatgtcaaataaggtcacattccagatagttcacggtgaaggaaatattagatttggtctagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaacaaaaggttatttttgggaactaatgccgatggacagcactgctgcttggagacggtatgtggaaatggcttttgaacggtcatggcccctcattatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgaggggagagagtcggtataattgttaatgaaatggagagggaagattcggataatgagcaagcggaggacgacgcatcatttgatgaggaaggtgatgtaatggccactgattgggcaaatgaggacttctctggacttgctatatcagagggtgatcatgtaccctgggagtataaggagaacgaggtaattgagggtgctaggtatgctcataaggatgagatgaaggaggcagtgaagcattgggtagtttccttgcagagagagtttagggtggtcaagtcaacaaattatgtgtatgaagtgaggtgcatgaaggaagactgtctgtggcgtgtccatgcatataagggtaaatggaatgattattggaaagttagcattgtgaccgagcaccagtgctacttacaaggggtggagaagtatcaccgaaacatcacttcaacttttgtggcaagtgagatgtatagcagtgttgttggtaacattggctttgaaccaaaatcaattattagccacatcgagaacaaattcaagtacaccataagctatgcaaaggcctggagagccaaacaaaagattattgagataaggtatggcacatttgaagcttcttatgataatttgcctcgtctgttagccaccattgcccagaggaataataatacttactatgacctacatacatttacatcggctgatgattgaacaaagagtgtgctgcaaagagcctttttctcattgggtgcttgcatcaatgcttttgtgcattgtcgacctgttctatgcatagatggaacatttttgacaggtaaataccactggcagtggtacctgctcgggctaccactggcaggagccccagttggtcccgtggacggtgtttttggctggaaggaggatatcaccgtgcgcttcgagcacgtgatgcgccttccacacctaggaccgcccaacacccttcccccgtactctaccgtcgggcctagcaaggcttggttgctttagttcactgtaagtaaataacttgttattatcatacatgcttattttgcgatcaacagattgttttgtactaacatttcattcttaattgtaggcggatcttctccaccctgacgctgatgattactcggtctgacgctcccttgaggcgtacctgttgtggttgttcgggtgggtgatgttcactagcacccacgggcacgctgtggactgccggctggtccactacgcacggtccatcgcggatgctcagccacaggacatgccgcagtggagctggggttctgccatgctagcagccacgtaccgtgccctctgtgaggcgtgcacgaagaccgacgcgggagcgatcttcgctggttgccctatgttgcttcagctttgggcagccgagaggtttgccataggtcgaccagtggtggacagcgaaccctacggggttggtcgcaacgcgcagtggccagaggacggtcccacgatggggacttactggtgtcgacgtggggttagtgcaactttgctgcgtcataagtttatcagtcgtcttctttttttatcatcacataacatgtctaattccgatcatgtttattgcagcgtcgttacactcacgtccaggtgagacgaggttaccaggacttcgtgtttgagtttgactgtctccagccgagcgacgtcatctgggagccgtacacagaagaggccgtcgctgcgagagcaccgctaggactttcgtccttgtgcacacgtgaccaggcttactagctcaccatcctgccgatggtgttcgacattttcgtcgagcctcactgcccgcagcgtgtgatgagacagttcggactgaggcaggtgtttccgggcaacgtggagccgaccgtcctccctgccgacatctcgtgagttcggattgttcatttcaaaatttttatgctaattacttcatcgagccatataatttacctctcttcataggttgactcgacggggacagctagcaggcgcactttgggctccacgtgtacagcagtacgttgacgactgggtgttagctacagaggaggtgatcaatgagctcttcccacacacggaggagaactaccgtgactacctccgttggtaccttcctcgcactcgtgcgcgtgtgaccttcactccagacaccccagagccgcatgttgccgctgtcacggacgcgtatcccacgcaccgtgaccgagactacttcgtgggggtacgtcgaatttgtattagttcttacaattatttcatttatcttgtataatataggacaattactgaattttttatttccatcttgcataggccgatgcttcacgggatatcagtgccgatatcaccgctgtccaagtgaggttgaacagaggtttgcacttgactgacgttgagcagagggtgaccttcgaccggatgcaggagaagatgcgtgcggtcatgcgcgtcttctcctgttgcagcgctgtggacgtcgtacctccagctggtccggtacaaccacggcctcgcgcgcctaccgtcggagcaggacctcgacctacggcaccggtttcgcacggtacttctcagcccagaggtttcttaagttttgtttctgtttttgtatgaaaacatcaccccgtcgtaacttgatgttccatcctcgcaggacctcgtttgccttcgagcgcccctagcgtcggagcagtgcgtcctacagcaccggtttcgcacggtagtgctcagcccagaggttagttcatttttgtttcagcttttgcacgaatacgtcaccacttcttaactgcacgtttcatcatcgcaggacctcgtctgccttcgagcgcgttcgcaggcacgaccggcgcttccgcgagctccgcaggggcattcgccagcgcttccggcgcgttcgccacctcttcgggtgcgttcgccagctcttcctctcacggagcgtcgatccctcgcccacacggtactttaatttttattaatactattaaatacctgtatgaaactgatggtccttgtccagtaggatttccagccgggattttcggtactggtgcctcttcgtctcacgccggtaggtctggtcctactagccagttctacgatgatgacttgcacggtgcgcacgaccacgacatactaggctcctctcagcttggaggagctccagaggcgcacactcatgagcagccagaggtcacacctgtacaggtaggacgggttggtcgtgccataccaccggatcgactcacatactcccaggggcacgttagggcgcagggtaggagggacaggggtaagaggcctcgtcagtagtgttctacctcttcagtgcttatgtgaccgtttcttttgtcttacaaacttgtaaagcagtactacttttgcttttactactgcagtactacttgtgtttctctcgcctatatagttattttcattcatatggtgctagaacaacttatgctcacaacaacacactttcggcgcttcacggtagtgtcagatccactagcgcgcacagtccaccacagcacacatgaaaagcgccagctcgagtagttactatcaactttcggcgctgcctgctgacataaagtgaatcacacccgcgcgtgctcgtcttgtcacatctaatgaataatgtatctcattgagtgcacatatattgcactgaaaacgacgctatataattgacaagctgaaggcaacctcttcatatcttatttccaactagcacacaactaacgagaatggaagcgccattccttgagcgtctcaactggcgaagagcgatcctttcgctggttggtttccaccatggtgtgaccgtcctttgtgcgattgtggggatggatgcatactcaagtcttcccccatgatacaaactcggggcaggagattcttccaatgcacgaactttgatcaggtatgattcatctattcgaagttcaaatggataaaaaactaacttcttcgtacacaattgtaacatcttacgcagacatatcttccaatgtgcaacttcatcgagtgggtagacatggagaacccacaaaacgacggaacacgtgcatacccacgtagtgaaacaagatcggactacctaaggcggaaggatgagcatgaacgtcgaattgctgctgaggctttagaatggcaggtaaatcccctaggactctccacgtgccgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatccccacaatggatgtacataggaggatgcaaggaaatgtcaatttgtacaatggattgacacagtcagagttacttccagtggcgggccgataacgcaacctgaaccgaccatatagttcattcatgctttgatggagtacgaacgttgggtggaaattgcaagcttagactggaggaacaatccattagggttacctaaatggtccgagcgttcaaagtgtgggtgcagagatcgctgctaggtggctacctcctttgcagaacaaacatttggaaggagatattttgtctgccccaatgtagacaacgatttcattgtatgtctaaccgtttccaaaatccgctatgatttgcacaaaatttctacccaaactgaataacattagtattttttcagggcaatccaacgatgtgtggatttactcgatggatcgacaatgtcactccatcatatcatggccaaaagataacagagtcagaaacacaagtagagtatcaacgattgaaggaccacgagaatgcaatgcatattgactgacctagaaggggccgataggttaccgcaggctagattcgtcgggatcgataaatttgtaccgtgtatcgatggcacttcttatctatcttatcattaaaatatttaattatggtggtgaatttttgtatgcgtaagactaaaaaaataataaaattgtatttcaccaatcttggagattttaatcttgtatagttttcaatacaaaagatttgataacaattttctatttataaaaatatctatttctcaaataaagcacaatgtaaaatcgccctcacccagggcggcaagggggccgcctgcaaaattccaggccccccgccgcctatttgcaggtggccccccgcacagtgtaaaatcgccctcccccagggcggcaagggggccgcctgcaaatttccatgcccttctcgccgcccatttgtaggcggccccccgcacagtgtaaaatcgccctagcggagggcagcaagggggccgcctgcaaatttccttgacggccgtcgcccgagagcgaacggccgtctgccacgtcacattcgccgccctctgggaaggcacccaaagggcggcgggcgagtacttctgtcaatttttgaaatagaaaattatttttgtaaaacttttaataaaaaaattaaaaataaaaaaaattatgtgttttgccggcgcgcactcttccgacaggcccacgtgactacgtaaagcccatgcaacaggcccacgtgacttcgtaaggcccatgcaactagcaggacgtgttttgattttctttttccatggatttctcaatcacacgcatgatttttttttcacaatttttttctcagcgtgaatttttttaatcacgtgcacacgaacgcatagtaaccaatccgtcaagataatgatgataattaagataagatttgtttttttaaagatttttttaagtaatagattgaagagaaatttatacgtgaagtcaaattctgaaaaatttcaatctagatttgaaaactttcaactcgaaatttgaatttttgaagtcaaaatttgaaaactttcaacttatcatctcggacttgaaaattttcaactcagatttgaaaattctcaactcgagatttgaaaactttcaactcggatttgaaaactttcaactagagatttgaaaactttcaactcgtatttgaaaactttcaactcgattttgaaaattttctactcgattttgaaaactttctactcgattttgaaaaactttcaactcacaattcaaaattttcatatcaaaactgaaaactttcatatcaaaattcaaaacttaaaattgaaaattttcatctcaaattggaaattttcatatcaaaattcaaaaatttcaacttgaattttgaattggaaactttttactcaaatttcgaaatctttccactacaatttagaactttcaactattttaaaagctgtaactaaattatgtatatatggtttttctttaaaataatgctaatgatgacaattaacgctaattacttaattagtgggtgagccttgcgtcgacacggaaaaagtgtgcgctacttctcctgctcgcgcgtctgtgcgaagtagacgcccccgtaatcatacagtggtttgaacatgatctcactggtctttgcgagaagactatgatcctttctaaattgctttaaatttgttttatgttgagacttctccatagccttgtttgataaagcttctaactcttagaatctcaattttttcaatagcggaacaagtggattttttttccagaaaaacacatgggaaggtagagttaccatttcctaacctccacaaccctaatacattttagagttggagctatttcatgtcctaaaattttaaatttgtataagaatgaaacatgttaatatataagatggatatcactctcttttcctaacctcataactccggattcgttccatatttgaagctctattaaacatccatggacatttcatccattgaacatgagaaaaatggtgatatatattatatcggtgcccatcattgctaaaaatgttattatatatataatgatgatgctctctctcgtggcccgatcttctgctaagggggataactctcgctttgatcgagtgcgatgtttgcgacgtggctaccaaccagaacaagtctaggacgctatacaatcgctacaccacgaacgatgtcgtaccaaccatgacgcgcggttgatgatccctgcaatgcaaacgagagaatactgcaagaacaagataagatgcaatctaaatattgcgaataggtgattaagcacaaaaaaaatagttgtgattgaagtggtagatttaatcgacccggcaaatcaacacaccaactattgggggctctgaatctatggtcgccgactaatcgagcgaggactagagagaaggtgaatagcacttggcaaaattcaactaaacaaagcccaattgtttttgaggatgtacaaagatatttatagagaaaaataaagctagggttaagtgctaattcgtggaggtggatggagacatttccgagatgggcctagtctattacaaggcccaaggcccaagttcggtttcagcaacaacactgtcttattttgacgattcccgttgactcagaatgaatttggatatgagtctggatgcgtttgaaaggtagaaagataagctttccatcaagtctaagatcacccaaatcggagttggtatgaaggcgctaggtccgtttgaagtcagtgctgtctccggaggccgaactggattccaaaactcattggactttaatatcttgtagatcctccattcatccgatgtattctttagcaatggtttatatttctcatgcttggttgtatacatatacttgatggtcacatcatataagccagatagattagtttggaacatgtgtgtagtttggcatgaaatgccaatattacacctcgagcttccttaaactcctccaaatggtgttttcgtaataccgtggaacctgaaactaattttctgataggcgacaaataaaatgatttttaaaattgtacatgtcaaaactttgaagatgttgataaatcatcgtctatttgtacaaagttgatatagaatcaaagcgaacaccctgtcgcccatggtggtggaagaattataaagggatcgactttcttatatcgaaagtctggcggtatacatgaagaagaatatgaaatttgaactaaaatcacaggatttaatttttaacagagaaccatattccaaacttcttatttttaaggaaaacccagacaattctttcgtgcaaaagcagcatccaataggggtatcccagcgatcaccccgcgctctcctccccctatagtccctcttctcccctttcctcctccccttcttctctttctacaccacaaaatttttaaaaaaacaaaaagttagaaaaatttatgtatagaaatactatatataaaaaaattgaattcaaattcaattttgaatcgggtatgtaaatttttgacttataaactttgggtctataaactttaggtgtataaactttatagaaatactacatatagataatatttgaattcaaattcaaatttgaatcagatataattcaaatttaaatttgaatcaggtatgtaaacttttgacttataaactttggatctataaactttaggtgtataaattttagatgtatagaaatactatatatagaaaatatttgaattcaaattcaaatttgaaacggatatataaactttaggtgtataaactttagatgtatagaaatactatatataaaaaaatatttgaattcaaattcaaatttgaatcggatatataaacttttgacttataaacttttggtctctaaactttagatgtgtaaacttgaggtgtataaactttaggtgcataaatttactaaaataggaaagtaatgcggtgccaaaaaaaggaaaccaggtggagggaggaagggggaggggatcgatcgctggcccccatctccagcgatcgatcgcccattaggatcgccgcactgtacacacctctccttccttccttcctcctcctcttcttctctt

SEQ ID NO: 28737 - DNA, 1567 bp, Oryza sativa
aagtaggttgatgctgattgagtagaacagtttgcaaaacaacgctgttctattaggcactacactacatcaaaataaaaaataataagactgaattgtatcagtgacttgatgatttgatctttacatagttcatttttcagtaactagaatcttcctatgagctaattatgataagttcaactgggaaaatgcaaatgtatctgttacagagtaaagactgctcgcgagtgctaacttgctaactgctcacatgaactgtctgaagagataaggaaggcatgcaaagatgacaagaatggaatatttttgtttataagaatcatgcattaaatccctttgaatttgatttattcaaattacacgcaatagctcatgcgaagagttagcaagtaataacccaaagatgtgtgaactatgtattccatgttttatcagttgtaaattactaacttcacctttttgccatagattcaataatccaaatgtcacatagatacaatattattgtgttaaaaacataaacatatatatgccaaatacatcaaacaccttacttatgtcaatgtacactatgtgattggccaagaaaaaaaagagcgagaaatgagacataatagcagagaaacacataagcccaaaatgtttggcataattgctcctttacagttcattttattaagcttggattcaaatgatagtacttgttacataccagttgaaggaagcctcagtaagagatgccaatgctacaccaccaacaatcggaagaagtgaaagtatcacccaaactgtaggcaactgccatgccattcaattattgaaagaaaacccaggtagttctctcagatatacataatatattgcagcaatcaacattatataggacactacaagttacctcgccaaggaaaattgcagagaggagaacagaaaagaaaggttccatagctttgatggtatgtgtgaatgacacagcaaccttccccaggctcatgttagtgaaaagattgcccatagtatggaccacagctagaggaaggatggcaaagagctgaaaaggaaaacacaagagcaacagatactccttgttaatacaacccatttaaacaatgaaagtgtgtcaaacaatatcaaagatctacctgtgcaccagaaatctttggtctcctaaggataccagtgatccacatgaacaaagcaacgacagtaccaacagcaaattgaactgttgtaatgtttattggatatgggaaaaccttcaggacctgtcaaacattataacagaaaacaagagttaatagtttatctgcgaaaataatcaatataacaatatagcatatcctgcaggaagaacaacacaatcaaaatacaaaatgcttttagaaaagaaaggctgtatgatgataatcaagaaaacccatgcataccaaatcagatttgtatgatgaacagaaatgcatctagggaagtttagtaggaagattatataatctctagtaactggaggtactgactgcaaggcagaataagatagaagaatgaatgtataatcaaaggagataaa

SEQ ID NO: 28738 - DNA, 4979 bp, Oryza sativa
cgctaccttgcaccaaaacagacagaccattcataccgtaccataattagttgcagctttgcaggggccatcatcacacaaaagctttaataaaggtactcaaatacaaatcaactataagtctataacttttcctgggtcctttggcctaaagtcaagaatgaaggcccaaaagagcaaaacaacatcacaatgtatttcaacacattgacaaactaaatgtccactagcataaacacaatcaattcaacccacaaaaagataaccaaaacctgcactcgaaaaatatcatattaatcatcttattgagcagtgatcacccagtacaagatagttgtcttttctaaaaagaaagatagcgagaatgaatcgcagcctcacatagagacagatatactgcagttacaattttcccatttcaagcagcaggatcgcaggcagaacacaataaataacccatgcaaaacacaagagtttcatgctgtgaaataaactctgatccgaatctacacaattacaaagcattccagcatttttaattcacaattactcaagagccagatcataagctcacttgctcacctgcttgttgtagatgttgaagtagatgttgaagaggtaccacagcccgaacagcgcgccgagctgcagcgtcttggcgaggccgctttcctcctcctccgccttggcgtccccggccgccgcgccgcacgccacgtggcgcgccctccccctccccgcccggtccggcgagatcggcggcggcggcggcagcagcagcagccgcccaagcgaccgcgccgccacggcggcgggccctcgcgaagaggaggcgatgccggcggcgaggggccgggcatggagcaggatgggacgacagctactgctgccggggcccagctggagcggcggccgcgcggggcacggccggacgaggccgaacgccgccgcggcgctctgcatggcggcgggaggcgagaaggttcccccgggggaaggggaggccggaggttctagaagcttccggagtgcgtggggtggagagcttggaggaggaggaggtggtggcgcggcggggaggtcgagggggaggagaggtgagtgagtggaggggtttggtgggatttagcagggggcgaggtggaaggctgagccgacacttgggcccgcatggcagtgagtgggcggatctaccaaaatatccaagctggctgcggttggtgtctctggcggcttgcagttgcaggaagggggttatggagagagccgattatggagttggtggagggagtttcacttgtactcaaggttccgattcgtatccattattttaccatgtttcgatcctaccaaattaaaacgatatcgatccacttagtattctaatttttaatagtatctcgatccaactattcattactacacgatcctacgaaatcttaggtggtatcccgattctacgatccctacgatactataaaatattatttgaaatagcatgatttgaaaataatgtaaataaatatgcccaagtttatataaaaatcagttaaatatatcaaaaccaatgtggtttctcttgataaatgtctcgatttgtatgacattgtcggagggtgtactcctccaccagggaaccgaaaggcctatcttttttagttcggccggggacggtgattgtagattgagaggttcgctgtcaagtgtgaagaagagggggtgcgacccctcgggggaaaggcaaccgtggtttatacaagttcgggccgctgagaagcgtaataccctactcatgtgctatgcttattgagagggagagattacaagatctccttgttggagtagaaggtgttgatgatgaggggcaagagactgtgctagtcaaaatggatcatccctccctcagtaggccaggacctccttttatactccatttgtccctaaatatttgacgccgttaacttttctaaacatgtttgaccgttcgtcttattcaaaaacttttttgaaatatgtaaaactatatgtatatataaaagtatatttaacaatgaatcaaatgataggaaaagaattcataatttcttaaattttttgaataaaacgaacgctcaaacattttaaaaaaagtcaatggcgtcaaatatttagagacggaggggttaccacaggggtccaccgagcctaactagggaggataatcatactaagctcgcgtctcgttgcttgacttggaaggcacttgcatgccttgctatagcgtggggcccatcaaatccatccgcctaacacgggggatgcgcccgtcacttggcatttaatgaatgaggaggtcctcattcgtaccgggaagtgggaaccctgccctaaacgggttaggcaaaccgtatccggccctgacatggcaggcgcactactctagccacgtcaatcatcggtcacagaccggtctgacgaaccacgccgcattaaatgttgcgcgcggagcgctcgctcagaccgtcttaaatgttgttaggtgggtgctaggagcgcccgtctggcgcggcacacttggcgccacgcggagggggtgacccgaccccgggacgtgtggggaacggccgccgtcctgcctcgggccgaacccccttgggggaaggccacgcggctaccgggggcaggcccttcctcacagcctgggtaacccccgggcccatatcactagcagacatatattattaccacatttttatatagaatggctatacgtaattaacataaatattaactaaacttgaaaaaaaaaaagaaaatctcatagtatcccgatactacgatacgatactactttgagcaaaacgatactacataggataccgatcttgacaatcttgcttaaactttctccgtcccacaatataggagattattcccattttagcagaaattaaggtgatgaccaaaagactcatataaccctgaaaaaggtactaatgcagtgaaaaacagactaatagaatgtattcttgcagtaatcaaagcactgcaaaagatacatattgagaataaacttatacttcaattaatgagaatgccagacacatctctagcaatgtcagacttatctcaagcgtgagatttaattgcctccactattaggcaatttttgccgcaatttacacaaaccctgatttaaacatacaaatttgaatcaaaaggttataaatactcccttgcctctttgctctaaactttccctcccagcctcttattcccattctcacaatattgccagcaacccaattgaatctcatcatgcacatccaccaatccatgccaatcgatcttaattcatctccaatagaagtggaggaagatgaacttccttacttcaatcaagaatttaccatacaagttgtaggagatgtagaagtccctgttgtgcatcaagacgatgttgctatagaactccgagctgtgcaacgagaagatatttgtcgaaacaagatttcggcaatacaaaaaggggtggctatcaaaaaggaaaagtggatgggtttgaagacaatgaattttatataggtttaggcctcctcgatgagaagtaataccctacttctgtccgggattgatctgccgagtgtgttattgataatatgatctgggataaaagttatgccccaagaggcaaccggacccctccttatatagtggaaggagtccgtattacaaaatacatcccatattcctaacagaataggtgagtaaagataaaatacaatcgtagccgactaggaccctgggtatttccttgatacacaagttagaaatttaactcgagtcccttaaagatatttcatctacatatggtaccccaatacccagtcagatatacatgccgtgtgggtatggggtatccataatctccacaatattgttatagaagcccctgttgtgggtcaagaagatgttgctgtccaggaggaggtcgaccactacccttttgacctgaacatggacacaggtatgtcagtttgcatacattacatgtgaagtttcagccactttgacctactcttcatctccctgctcccattcacattagcaccaatacaattgcatctgctactacagcacacccactaatccatgtcatcctatttcagtgccaacagaggaagatgaagaaattcctgacctcaaccaacctgttgccattgaagaagaccaagtccattgtgtgcatcaagatgatgttgtccaagaagaggaaaatcaaggcgatttccttctcaacttgatggcaggcatgtcatcttcttatttcaaaagttatatactccctattggagtttatagcaacataaaacagtcaaatgaatgacataggaagaaaaatagaatatggttaaggaaatgtactcactgcactgatgtgaagatagatggttattctatacttgcaatgcaagagttgtcctgaactcaaagtgagctgcaatgagtttaaaacgagctgcaaatatatctggccaggattgattcccatttgtcagtgtgttgatcctacacagaagaaaaataatattaggattgcgattagtactagcaagttcaagctgttcatcattagtgtattactgtactacacattaccctcaatatgacagtaggaaacatatacatgtatccataaattagaaattaaaaatttcattgaagtgttaccttgctagcttgatgttcaaaatccatcatttaatctactcataccttcaataatgtcattaagtaggagtagcaaatttacatatatatatatatatatatatatatatcgtcaattataaaactaatttcactagactttttggcacagaacactacagttggagtaacacactgcaaaaaaaaaaagctcataagtcaaattaattatgaagggattgctaattatactactacctccatttcaggttataagactttctagcatt

SEQ ID NO: 28739 - DNA, 3816 bp, Oryza sativa
  unsure (1)..(3816): unsure at all n locations
aatgctagaaagtcttataatatgaaacggaggaagtacaaatttagttatgcttaatgtttctatatacgttatctctaacctttatccctccatgcagatgaggataatgatgtatatgctgaccatgtggacattctcttcgttcaggatgaggtacatgtatgaaccgatgaaacaggtattcctatgagagcaactatactttacgaaatgacataaatccaaacaacacgttttaatttaaattttgcatattatgaaccgttgacatggcacaccaccaagatgcacatgaaaaatattaggagaagaaaatatttatcagatgaacagcgacaagatatttatgaagctttacttgcaaaaagtatcaatggcaaaatagaaaggaacgcgacaaccatcgttgcaaatttgttcaatgttagaagaagggttgtccaggatttgtggacaaaagtgaagaaatgccaagcagcaggtatcaaagttgacattacatcaaaaaagtccaagaaatgtggctggaaaagggttgatagagattggtcacaggctgcaacaattccattgaaccagcggacaactattagagatcttgcctcagctttgaatgttccaaaatccacagtgcatagagctttcaaagaaggcatccttcttcgtcactcaaacacactgaagccttttctcaaagatgcaaataagaagctttgcctgcaattttgtgtgtccatgctggacatgcaaacagtacatactcaacccacttttgatgacatgcgcaacgttgtgcacatagatgagaagtggttcaacaacactaaaattgctagggaggttttacttgtatggtggagaggatgaaccggtgaggttagttcaaaataaacaagcaatagacaaagtcatgtttttagcagcacttgcaaggcctagatatcatgcgaatagaaattgctactttgatggcaatctaggtatatggcccttcgttaagaaggtgagggaatctatttgctctatttgtgttggtttgaaatcattttgaaactaactttccatttcatcaatgtcgtaggagccatcacagaggagtagctagaacagaccgagggttactttgatcacaaaatctttgacaatttccagggatacaagtagagctttcttgattacgaaagtgattccagctattgtctcatgttggcctcaagaagatattgggcagaccatatggatataacaggacaatgcacgaacacatattgcagtagacgaccctgcatttgcccttgcggttgcccaaacatgactagacatatgaataaaaaattagcccctaaaatcccctgatatgaatgtgcttgacctcggatttttattttctcttcaatgcaaaacattcctaaagaattctaaatccatggaagagattatagaaaacgtgcaaaaggagtacagtgagtatgacgaagatttggttaatcgggttttcttaaccctacaatcttgcttcatagaagtcatcaaagttgatggaggcaacgggtacaagatacaccatatgaacaaggatcgcttacaaaggcttggcatgctccctactagtcttacttgtgaacttgaactttatcaaagtgctatgcagtctttaagttaagcgaatagtagttggaacaatggttgtttagaaaggctattttattttattgtgatgcagcctttttgtacatagagttgtattatattttgcaagtactgtatgcaaaatataagaaaatacatgcttaccctaccaaccggcaactctctctctctcgtcgctgcatcccgtcgctttctctcttcctctcatgcctgtcgagttctctcccaccaccatcgccgctgctatgcgttttctcctcaccgcctcgatcgtgaggctccatgccgacctaagacggacacagtgtcacccacacgaaggcgtttaccacccgattctggtgctcgatattaattccagtgtactttttatgtgtcatttgtttatcctctctgatgcaccagacccaacatcaattattgttgttacaaaatcttgcaaactagttacctctacatatcaattattattgttacaaaatcttgcaaaccagttacctctatgtagtataaaataattgctcggtgtataaatgattgcttacagtgtgactaaaatttacaacatatcctaatacctcttgtattttgaaacctcctgcaagggcatactaatgaagcataaatactaccagctttgttttttctagctcattaagttggttcataactataataattggtcatatgcatcatatgcatattgatgtgttgtacatatcattgcatggctaagaccctgtttagatggagctaaaattttttagtccctgttacatcggatatttggatgataatttggagtattgaacatagactaattacaaaacacattccataaccttagactaattcatgaaacaaatctattgagcctaattaattcatgattagcctatgtgatgctacagcaaacatttgctaattatagattaattaggcttaaaaaattcgtctcgtgaattagttctcatttatacacttagttttattattagtctatatttaatactccaaattagtgtccaaacatccgatatgatagggactaaagtttagcccctggatccaaacaccacctaagcttatcatactactctaggcattaagtttggttatctagaattcaacattgaactctctctctctatctttagtaatgtaaaataaaaaaaacagaatgagtatatgcatgtcctaccaccaatcctgacactatttaaggaattatttagctccattattctctcttttagttttcatgacacatgagtcataatattggtcacaagtgacatgtatgactttacgttgtaacgctaatacacagctgtcaacttcatatactcctataaacgaaacggtgtgaaagcgtgtcaactagtcatctccatccagacatcattagtaagaagctaaatattctcgtgcaaaaattcgaatacatatttatcacatttaatcttatatagtataatggtttgcttcttatttcctcaatacgctaaaattatatttgtgtaataaaagttcattgaaaaatatattaactatttttttataaaaaaagtatttgctaacanccaaaactattgagttttgacacatccattctcataaaacgagctaaaaaaatattaagttaaaatcatagcataatactaacaaggcaacaccaatatttattgattgagcataaggtgagatgctgtttttttttctttttttaacaaaaaaacgagtaaggttcactataaccaacctaacacgacaagaaaaacaagataaaaaactttaaaaaataaaaatgctgcaaggagcatacatagcaattagtacatgttgatgcattgaaggcacttcgtgcgatcagatattaagcataacgagcaaaacataatatagtatcacaccacaaggtaatcttaaagctatagttaatttgttttgttgtagtagcaccaaaatatgattatactagtttcatactacaatatcaagttgacaactagtagtaaccgattctatacaacaaactctatttcaatacacaattaagcatggatatgccaatttagggagaagaagagaggaattacggattcgacaatgcgttggattgaggcccttagggctaatatgtagtaattacgagaatatcat

SEQ ID NO: 28740 - DNA, 845 bp, Oryza sativa
tactaccacggggtttcatgctagcaaacaatcatccgggaggaatcttgtcaagagacgataagcaattataggattggagggtgaacatacagaggataaaagaagaaagatagaagtagggtaagaagatatatacatgtaggcatagtatattggttttggtaatggattgtttgttgttttatttggttgtttgttgttttatttggccttcggctgtttatatttatcagagagatcatcttgcatgaacaaagctcctcaaaatatcttattaggcttagagatgtattaggactctacaaaccctaaccctaagcaaggaaacataaaaaacgtaagtaaatttgactttgacttaggattatcgtttagatcgatcggtcatgacctccagtagagtctccgatcagaataaccagggttttattagaccgacaagaggcctaatcatacgcgtttgctaattggcatgtatgtgttgaattttttttatttttaattcttctattaaaagttttacaaaaataattttctatttcgaaaattgacagaagtagtcacccgccgtctcccaaagggcggcgaatgtgacgtggcagacggccgttcgctctcgggtgacggccgtcaatgaaatttgcaggcggcccccttgccgccctccgctagggcgattttacactgtgcggggggccgcctacaaatgggcgtttagggggggcatggaaatttgcaggcggcccccttgccgccctgggggagggcgatttttgcctcccccctatataaccctgtcccctctctctgaaatttcattataatctctaaaaatccaaaaa

SEQ ID NO: 28741 - DNA, 863 bp, Oryza sativa
aaaaaatttatatatagaaatactatatataaaaaaatatttgaattcaaattcaaatttgaatcaggtatgtaaacttttggcttataaactttgggtctataaacttaggtgtataaacattagatgtatagacatactatatatagaaaatatttgaattcaaattcaaatttgaatcagatataattcaaattcaaatttaaaccgggtatgtaaacttttgacttataaactttaggtctataaactttaggtgtataaactttagatgcataaaaatactatatatagaaaatatttgaattcaaattcaaatttgaaacgggtatgtaaacttttgacttataaactttgggtctataaactttaggtgtataaactttagttgtatagaaataatatatagaaaaaatttgaattcaaattcaaatttgaatcggatatataaactttgggcctttaaactttatatgcgtaaacttgagatgtataaactttaggtgcataaatttactaaaatataaaagaaatatggtgcaaaaaaaaaaaccaggtaaagggaggtaaagggagggggagacccgatccgatcgcccccggcggcccccggcgatcaatcgcccaataggagtttcgatccaatacccccctcttgttgctgacgtgtcacggcgcaatggtcaatgggtttggaggtcaataggggacagagctcgctatccatcccgaatcccaattccctactcccaaatcccaacctcccattcatcgggtcgtgtcgccgccgacgaacaacacggcgagcggcgccggtggcgagctacctaccctccatctctccagatcccttccaggtgaga

SEQ ID NO: 28742 - DNA, 12218 bp, Oryza sativa
atttccaggtttggatcaatgatgattggggaactggtgattggcatttcagtgtgaaaaaaaatgatgtagaattttgagttcattcgtttggtattcgtgattggtcatggtggactagatatttttgagatttatgcttgttagacatggtgcatgacataaagtagttaaaataactaaaatgtcctgttgccatcaccgagtattgccattaggattgaaatagtctgtagaagaagaaacaaggaaaggaaaattttgttccatttgttggatgttctatggtgttacagacttggcatttcaaagcctcctctcactctccctctgggacatgtggttctctagtccttggaccaaggttaagtagtgctgttcaacctcttttctatgggctggagagaccctgcctgagtggctgctgttggggttttgagtgggttggctaaccggagatccctagttataacccctcgtgagaatactctcacctaatcgtagctaggattggattttttttgggacggagggggtatgttgcttcacttgtcaatagaatcttgctcagtagtcaggaccaatgacattttttcctagatttagtctggttgcagcagagtgttaacttcaagaagcttcagcccttctattgcctgcttcttgttgagcacctccaatgttgcattagtggtaggatgttacacatctaccatgagaacaataataaaaatactgatactgagatcctagatgcctggtagatgaacagcctgcagaatgcactagccccacttgttgactacttgcaaaaccagtctcaggattgatatttctcctttgcctttgtttttcttataaaatctcattttgtatgcctggtttctgatgtacttatgtcttgtggcagttccacatttaactatccaattaatttaagctgttttggaccaaaatatttgttgcggtgcttcttttggagtaattaattttatgtacacaactgcctatgaggattactcaaatcattatgcctatgaatagctcaagatggaatatggatttagctatctacacaatattttcaaccatctacaaattggagctgcttatgttcaatatgcttagtagttgttgaatatcatgtttttatggggtatatacacatgttgtgtgttgtgtcagtactgtcatacatgagttggatactttgatttattcatagctccatgtaatatgatggcatctgatttcttgtatttctctgtggttgtttgtcttttcgaaattcagctagttttttttaatcacatttgagatatcttgcagatgagaatgctgattgtacttttgtgcttgcagggacagtacaagacaagtcgcacaaaacagaaaatcttgtgatagtttaaatggcttcaaagcttcaagccttttggaaccatcctgctggccccaaaaccagtttgttatctctttgtgctactgtaacaatttgttggcaccactgtttatcttaggtctatgattattgtttctgatccgaaaataattattaccctgaaagcttgctacttcctgtagtcatgaaaacatgttcttttggacatgtctcagattctcaactcaaactttcaagactttaaacatcattatcttttcaaatattttgatcggatgcatgaaaatagtatttgtctagaaaagtacttacacaataccataagtttattgggttttaaaaatatattgcaatagaaatgagtggtgaaagttgaattatgtgactccttggataaccaaaaacacatgtcatcatgactggagggggagtacttcgcactgaagcatgggccagctcaagtggctcaatactttttttttttgcatttcaattttgtgtgatggttatctaccagatggtgcatttaacctgttatttgttgaccttcgttgtcgcagttcatttctgggctccgacatttaaatggggtattagtattgccaatgttgcagactttgctaagccacctgaaaagatatcctatccacagcaagttggtatgtttaggttacccaaatcactgtccttcagatatcagagccatactagtttgttatgcattattagtatatgtttatactgttgttgtggcatgcagctgttgcttgcactggagtcatttggtcacgctacagtatggttataacaccagtaagccctttgtacttatctatcaagagcaggtttaaactttgcattgtactgattctttggctacctcctttgcaaaatacccttaatttcaaatatgcagttgtatattcattcaaatagtcaggatatcaattcaggtccatctcattgctttgtattgctataatgttgcagaaaaactggaatctattcagtgttaacgttgcaatggccggcacaggcttgtatcagctttcccgtaaaataaggtatgtcaatatctaagccatttccccatttcattatttgacgacttctaagagcaagataatatggtttttgttgatctcctttgcaggaaagattacttttctgatcagaaggatgatgttgcatcattggaaggataatgatgactgacatgatgaaaacccggcccacaacctttgagcgatactcaactcactctgaattgcagagacgcgtcgttttctccaagacaggaacctgtcgtttgtttctatgtttctcttgcaccaatttatggatcgatctggaatgttacatcccaaaaaaaaaaatcaaataatctttttgacaatctctgcgaataaatgtgcaaatacatcaagtagtctctcctttatgtttctccgttgtttattcacatgttttgctaagaagctgttacagcgaacaatctttctgtttgctatctgaagttactacattgtaacctggctttcagctttcagattaccgtaccctgtctggtaatcgaatgattaaagtttgctgtgattttctgatgtgttgcactagcagcaagcctgaaaggcgtgtggaggttgaggctttaaatctttatagaaaaatatgaggtctctaggcatgagaccgtgcgcatttctaataaaataatggtgtaaatacgtcaattcatgtcagagtgttgctactattttttttcttctcgtaaaaacgaaagtgcatttcatcatgcgaagatgcaatacttttctagatagtttgaactgcccgtgcaaaactaggtgaaatccataaccaatacctgagaatttcaaagctccaaaagttgcagtataacacagtattaacggatcgtagtttccattttaactaattcaaactcaaaccaatgtatcaaccgaaatattcaaaccaaaaacatagcagacaaagaaaaccaaaattgttttttttcctagaacacgtaggagatctgtgtaccaaaatcgttttttttcctagaacacgtaggagatctgcgtatcattttattaagatagagaagaaaatgcgtacactgttagagaaagactctgacacccgcccactaaggatacaacagaataccacacacccaaaggaagaaaaaacacacaaactagtgcattaacagcccagccctaaagagatcacggagcctagcagctcctgctaggcaccaaatagcgccctcattagcgatggctcagaggacatcggccaagcatggggtagtgccattaaacacacagttgttcatgtgcttccaaatttaccaagctaccaaaatgattaaagagtttagccatttcttctcattagtaggtaaaccccttaccgttattgaccaccaattagtactcctagcagtaacctgggttggaaagctagagtaaccaagccgtttcaggaccaaacaccatacttgtcgagaaaacacaaaagtgattaggatgtgattaatagtttcctgagctatcacataatggacatgtaggcgggtgttgaagtcctcacttgtccaaccggtccgctgtccaacaactattattaattgccaaccatataaacaatttgaattccaaaggcgcccaactcttccaaattcttctccaaggtgcaaaccttaccgtcccaacaaagatggcctcatatgcagatttagaagtataaattcatgagtttgagagcttccaaacatgttgatctgggactcgaacttgtaagatcacccctttgaccaagtcccagatctaaagaaactccacaagaacctgaaccatcaatggtccgttaatatctgttacccattttttgttgtccaaggcttgtaccaccgtacaccgcctaacagtatttttggctatcaacttagtcaaattaggagctatctcactaacagttttcccttccagccatctatccatccaacacaaggtggattgtccatctcctatgcaagtctttaccgccatgctaaataactcacaagaaacacgaggcacctggactggtagaccgtgaagaaaaaaaatcgttcacccaaaaagaaattacaccccccgggtcgcccttacctttttttgcagattacaactaccccgcggtaaccgccaaaaccgcgtaaaattcacctccaaaaatttgaattcaaaaatcggcggttccgcggttctggcacggctaccgcgctgtttctggcgataaccacgatatttgcttgattatcgccggttgtgtagcagaacacatgaaattgaaaagacactggaaaatatttgaaaatacacttaaaatgtgtgtagaaattggagataattggaagaatatataggatacttacaaatctagcttttgtatgtgaaataaaaaaaattcggtatgacctttttctattttatggatttcgaagcaattcaacatttcgtagcataataattacaaattagcattacttgcacattactaccatattttacaggaacaacaaatgacccattatcattacaataaatgtatatcactaaacacgagcatatctactcacccaacaaataacatatcaactttacaaaaacattttctgcatcactagcaaaccatatttcacctattcaacaatctttacatctcaacaaacatcaatctttcacaatgtatttgacctaaacccgatatattttttctttttccaatttctaaactattttcagtttgccctcagatttgaatttttcttaccctattttttaaaaaattcttcactatctgccactacaaatcaagaactacatctatgatttttttcaattttttttagaattttcaatttgctcaaatttcatccaaaccatggcgcggaaaaacgttaccgcgccctagcaataagcgcggtaagcacacaataaggtacaaaacctccccaccgccggtgaagcaattgccaatctcctctctctccattcccctctccagactgatgactatgtggctatgtggagcatccgaggctaagctttgttgcgcttcctccaggttatggaacaggtataccatcaaataacttcgagaaacgtcggttggtggcattttgcaacggcaaaattcgatatccggagattgcttgtcagcttgaaggcgaagatcatctgcctatgctgctcagaatgtggacattcacctatacagaggagaatgaccattggtttgttgagttatgtgtcaatctgcatgagttgtgcaataatgggtgttcttcatgtggatttactcagcagatagtccccaaactaggaattatctatccttagaacccgacaattgtctatctattttgagcagacgatttgatgtgttcaccgcaatgctagtaggatgtgtgcattatctgaccgatgacaatgcacactacttttgcttatcttgcttcgtacaggcttggtcagcacttcctaaaggtatgtcaaaccacctagttatatctatacctatataaattaggcactcactcttgcttatcttgcttcgtacaggcttggtcaccacttcctaaaggtatgtcaaaccacctaattatatctatacctatataaattaggcactcatttcgagctcctacgttaagcaactagaaaattctagacattgatatgatcgatcgtattgttgtgaccatagatcatattaagagtccttgttaaataaatcatgcaattagaaatatccaaccgttgatttgttgattgtattatcatgtattcatgtatattatgtttagagttgttaaataattattgtaatttgaaatatccagctgttgatttgttgattgtattgtcatgtatatcgcttgtttctatttgttacattcttagtatcctttatccagttttatttatatattcatatgattgattcatcagcccattatatggtatgaagctgaaccacataaatttttaggatagccaggtatgaagctgaaccacataaattttcaggatgtcattggctatgtaaagtattcatcattcggatagtttcaacaattacttcatcggtttatgatttatgctaaaggttttgttgtcaaaagacaactgcgtcacgtcgaaagacgtggttcactcggtgagttgttggaatagtaaagcaatatattaattggtaaaaaattttgggattcccccattacatggccctagggggctatttatagtcttagtacatgctaatacccactagggtttagttaatacaggggaatttacatggttacccttatgatagggacattagcgtgggtattgttgacggtcgttacagacaaatttcgaccgtcaatataactaaaataatggagaattacctattcttacaatgcatatttgttttcaaataatacagttccacttgtacttggaaaataacatgttgcaggaatttatcaaataaaataaagagaaagtggagaaaacctcactcctaagcaagcaaatggataaggagggcccacatgacaggtgtaaccaccgaaaaccaccttaactgccacaaccgtcattgggacccacctgtcagccaccctgccaaacttaggggcctgctaggctggcccaggttcgatcgaacctagggttcagccgaaccctggcagctgcggctccggctagccttacacgtggataggacagtcaacgagccgatctcgagcgagctcgtctgcccaagcttgagccatgctcgagccaagcctattgcaccttcaagcttttaggcaagctcggttcgagctcggctaccaagctcggtcataagtagtataagatattttttagtgataatcccttgataagtataattattttctagttaatcacactaataaaagagtaaaaaatgattaaaataaatatattgtgctaacacatgctaatttattatgtaaatagatactaatatatatatatatatatatattagttaattaaatcaataaggtaaacaaacaatataaactatgcatagttaagctcggtagaagctcgagctcggctcggtaaagctcacgagcttttgctcaagctcgggtttggctcgtttggagctcgagccgagctcgaatcgagcctagaacgagccaagctcgagctacttgcgagcttcgagcttttttgacagccttacatgtggatgtccaggatcgcttgctaatgacggttacatgggtaaaatagaaatttcgcatgttagtaaccgtcgtagcgagcctataaaaggaggagctcattcactctctcaacacactcaagcaagctcaaattcctcttcatactttagtattattatcttagtgctaagtggagtagaatagaatagtattcggagtcttcggaagagttttggtatggctctagtagctcttgtattcttttctataatactttcgatattaatgaaatactcttctttatatacttttggtactttatatagtatgagtattgttcttattttatatctatgtcataccgactgtgtgggtagcctatcagagaggtgcaatggtccgggtttaatgtctgatttattagttgctctatgtcatgtgcacgggtgtagactgtagagtagtatttagtaatataagcatggtgcttagattattaaatatcattaattggacatatatgttgtgggacagtagaggtgggtcgctaatggtgacagttcagtataggtattcctccatgttagtatatattcctaagacaaattcctggggagggtactcctccgatttagcctcggttggacggccatgataggttgtcgtaaagaactcggcaaaccaaggtggtctctcgaagtaccatgagggcactgttaggggtattggccaaacaattgtatactagcatatataaattaggatttgagtgtatactagaagtataggaattgaatgcttcctaattcttcttccacttagttagaattactttattatgaggatttgattagctttgcttcgtgtcagtctacccctatatattaaacttaacccctgcttagactttgacaattacaagtaatatatgtttaaagtgcattagcaaagttcactcttattatcttcgcttgggattaaaaatacgataccttggaatacttctgtatgaaatgctacaatggtacattcgtgcacttgcagattacttctgtaaccataaatataccaggactatttctggcgccattgctgggaatcaatagttctagtaatgtcgttaagaaataccaacaagtatacaatgtctttcatattcatgggccctatggcgttcttcttgggccggcccattagtggtgaaaggcctccatgggctgcagggcctcccaagccataaatatactaggactatttctggcgccattgctgggaatcaatagttctagtaatgtcgttaagaaataccaacaagtatacaatgtctttcatattcatgggccctatggcgttcttcttgggccggcccattagtggtgaaaggcctccatgggctgcagggcctcccaagcccttagctgaaggcatcttctacttcgggcgaaggcctcttacttcgccttatggccttcacccttagtggtgattcggccggatggtgagcttgatggcgaatccttcggtcttcgtcgcctggcttcgctcaggtgcttcgccctatggtttcgccctaggatggtgagcttgtggcgaaccctttggtcttcgtcgctcggcttcgtccaagagcttcgacctaaggctttgccttaggcgcacccttggattcagccgacgcctgatgagtttggtggtttggtcgaaggccctcatgacatgcctccaacaggttttaactgtcatgcataagaggttaggcattggcattaactacattggaacttcaatgccttcatacgttctagttcccctttagtgaatacgatgagttttgaagctttaaaatagtcactagtcagtgatacaatattatggtatatcgtttggtacataagtagtttttggaatatttacaaaacttgaaattcaattaagtgttttttcaatgaatttgtttcaccgactttccatcatgaagatacttcaatccaagggacttgtccatccttgcaacctggcaattgtttatatattttgaggacatgcttgtgggatttgatgtgtccactgtgatcctagtaggatatgcgcgttatctgaccgataacaatgaacacaacttactttgtaccagcatggtcaccacttcctaaaggtacgccaaaccaccagtttatatctatacctatataaattagacactcgtttggagctcccatgttaattaacaaaaaaaatctagctgttgatatgattaatcatactgttgtgaccacagatcgtattaagagtccttgttaaataaatcatgcaattggaaaataactagccgttgatttgatgattgtattatcttttgtatatcgtgttaagagtccttaaataaatattgtaatttggaaagatacatggtgactagggattctaatttttttcttgcattgagagattaaaacatatgtggggtgtggtgtgactagctatgtatcaacaacaaaacaatttataaagagtttttatcgttaatgttcttttttttcagtcgtatttttgtatacaaggaatgtcattgctaaacgtgaaatttttgtcatagctataggactttgggtttcaaaattggttggaattcctagtctgacggtagcacacgctcctactactgcaacaagtttgatccccagcgccaacgagtatcaatgacctcactattgttttcaatatgaaggttatttcaagcttatcttacttgcaaaatattactattccaaaacctgcatgttgtgtagccatgaagtttggtccacaaatatgtaaacatggcatacaagagaaaacacaaaatgaaatgaaatacaagatttcatcttagcgatacatcatgccatatattcatattttggaagaataatgtaagataagccatctcagcaaagccttgccatgttgagaaccgtgaggatggattgtcagtatagaaaaccaaatactttatacaaaagttcgtgggcttgatatgtagttgtcaagtcgatattgactataccgctaagtttgttcgagttcaacaatttaccatcgatattgtctttttctataatataccagtgactttatcaattgttctacaatacgccattgagctggctcatcttttcaaaaataccaaaaatacccttagagacaaataagattaacaattgatttatcttattagaagtttcaaaaaaaatatgaaaatttttatgtggcctctttacacaacatggaagtttgtatacaagtttcaagttttttttctagtatatttattttctagaaaaataatattttttatgtggtatatgagagagaattttcttatatgagagataatagcgtaaaatatcttatgtagtgtatgaaagatgatttatgttaaaaaaacaataaaaaggtattttatatagcatataacatataagttatatatataaatgtaaaacttgaaacttctataaaaatttccatgttgtgtaaggatgtcacataaaatttttcatattttttgaaacttctaataatataaatcaattgttaacctgtatgcccataagggtattttgggtatttttgaaaagaaggttcagccctaatggcgtattgtagaacaattgataaactcaccggtatattatagaaatagaaaatgtcaatgctaaatcgttgaactcgaacaaactcagtgttatagaatagattctctctttgttttaaccaccttgttagtttggaaacatgcaaccactcgcttatttctctcagccgcatccctgaattattgaggcccctttcattttttctgaattatacgacacccttttgtttcttttatatagcttcatatgcatggttattagcttccaggtcctatactttatttagttaactctacatagcagtgccttggatgtgtccttcatgttttttagataagggaataatttcatcaaaatgaaaattggtggatgtccttgttgtgaaagaaacatatctttcctaatattgtacaatagtgcacattaattatgaattaaactagaatatcaattattacgacaaattatttattctaagctacacaatccacatcttctgctatcttacctctggttgctggtctattgttctgaacatgtattgcctatttgtcttgcatgttcataccatgtacttccacaaacagcttccatgtgttccttcctttactggatgtgttatttcttggctgtgatttacttttgatagtatgataggtcaaatagatttatttcacattgtttttcttgtttttcttatttgcacatccaattgccagatgtttctttctcaaagacaacaatttttgttgcccaaaagcttatgatggtacaaaattggcccaaacctaacgatgggccgctagcaagcgagcgagagtactcgttatctctatataaaatggtgcaaggagatgattatgaatttgtgaaaccctatcttgttttctgtgacatcccggcccaattaggatgagacctgtga

SEQ ID NO: 28743 - DNA, 2240 bp, Oryza sativa
gagcaagaaactcatggttaaaaaggaggtaattgtgaatatataaatgtgttacaaaataatgttatatattggataggtggctttatgtgtgaactatttattgtgttgattatcttgcattgctgtactacttcctaatccacttcattattcctactcaagcaggaatctcttgacaacattaatcttttctcaatcataactgtgatgtcatttttccttttggcccctgttgccttcctaacagaaggcatcaaaatcactcctacagttttgcaatctgctgtgagtaatacacaactcaattcatttcactggttattagaaaatacaaaaacaaaataagcacctttctcacctttcatgatcctaatgaaatttctgactgatttcctgacacatgatgtagggtctgaatgtaaaacaggtgcttacaaggtctttacttgctgcactttgtttccacgcgtaccaacaggttagtcatgcatgctgtcgttttttcatgtttggtcatatacatgtttagttgggatagttgatagttctgtttatggttcaaatgccagaaagtgcatattttaagtctgttggagttaaagtattcttcttacagcactacattcaagtgatatgaataaccaatcccttctagttatttcgtggcttaagttcatactcctatggaaactgaacgtctaatacctaatttagaacccaggaatttcctgccaaaattgatacttccgtgataaatttctgcattagaaacagtgcctaaagctctaaaggaaaaactgtgcagattttgatctgtacttgtggagtcatggggtcgaaatactcacatgttctagataatttgtttttgcagattttctgcacaaaactaatgcatatttgcaagattgttgaaaaattagaaccattttggcagtagcatcaattccatgtaggagaagttctgaatcaccattgagaatacgataaaatttcttctccttcaatgtagtgaatgctattgcactagagtattttctgatcaattgatttattagtgtagaacttattttgttggtatggcaggctggcagctagcttgttttcacttcaagtggcagttggattccatggcatcatgtcctaattgcatttgtgtacctgcagtacttgtatatagaacaaactctattatggcagcagggagagtgaatagacataaggactcgtagggatgtgaacggtcatgtcatgcaatcttgtcctgcatggccggaggtcggcatggtagccataggggaaatcccttttcgtattgctttataccctactagctaaatgcccttgcattgcagcgggttattcaagataggaaaaaaataaaataattttatcccttgttgaaaaaaaattaagcttctacttggttgaaacaagattcttctacaaaaacaaaaagaaaaatgctatagttaagactatactccctccagttctcaaattcttgatgttttgggtgtggaaccaaaggcctctaattcttgacgttttggcatttggctgtgtgcatcggaggtgattgcccctgcatgctgcatagccattactgatcccaatagcgcagtagtacaattaatatggataaaacagggattatgccccctaataaatctctccttggtatatgtgattcactccaaaacgtcaagaatttgataaatcgagggagtatttctcaatatgagacataaatccatatgcttttcagtacttaaatatagattgatgactccatccgtgttaacgaaatgtctatttcatatgataatgtgtacttattaataaattttgttgtataactcatttagaattagaatagaagccttaagatgagaagaagcaaagcaatagaaatttaaagagctgcaccaaacagagtattggggagcaagagcagttggagactaactaaacaagtacacaagtacataaagtggtagcatagcactcacatgtgtaatagttacatcatggcccacacgttagtgttggtggtgatggcatactcaccaccatttgtacaagctatgccaaccttttacactcaggtggcaatgtacataaggaaactagagataaaatagcgatccaatctaaacaaactaggagatataaggaaaactttttttgcaaatatacttattatttcaataatttacgtttatatacatgcatgg

SEQ ID NO: 28744 - DNA, 3635 bp, Oryza sativa
aacgcgggacctcaacggtctgtagctccaaaacacgggactaacggtcccgcggctccaaaacacgccaccatggtagcaagtgattttttttaccgtgtcggtactgcttagtactgttttgacactatgtttgcactgtttggaactgttcacatgttggttcccggcagtaaaactgctggaactaacatgtgaacagtgtcaaacagtgtcaaatagtgtttcaatagtgccaaaaagtattaattcgatgtctaccgcggtggcgtgttttggagccgtgggaccacgatggtcccgtgttttggagctgccggaccgtcgcggtaccgcgggacgggtatattttcgcaaatccttcccatgaaggtatatagacgtaaattattgaaagaataagtatattcgcaaatttttttcgagatataagaaggttagagatcatatctcgatgcaacagaaagaactatcaatatgcttgtctccgcaatatactcagccatagagccggtccatatcaaccttgctgtaacctagtgtctctactcaatgtggactaaccttgtgacggggccaatgtctgcaaagatggtatttactagtatgtgtgtgatgtttctttgcttatcgatcttatgcacaactttgttgaaggtgtcctacatgatcctcgcgagggtgtctcctgtcactcactccgtgggcaactgtgttaagcgtgtcgtggtcatcgtaacatcggttttgttcttcaggactcctgtttctcctatcaactccctcggtaagtccgccatttcatcttgatctctatttctgacccattgatttcttccattgaagctcacacgttttgtatgacttccctctggtaggcactgccatcgcacttgccggagttttcctgtactcacaactgaagagactgaagcccaagcccaaggctgcgtaactgaagcatgcagttgccatcttattgtagcagtctttccaagatgaattgtcgtagcacacgtttggaaatttatagtgcatttagtgtagagggaagctgaacatgttcacgttgaagctaagtgtagtaggatcatgtatgtggtctaactcttacagttaaagcagggttttgaagtacatgagcagatttccgtgcgtgttgttgcaataaagtttcggcttcaattaatgcccatcaaaataattattattctagaacatcttaaatttcatgcaaacatcatctagaaaatataaagtatttcaaatcatcttcctcacattattttgttaacattgtaacatttaacatttctatgatatttaacatatatttatcaatgcattctgcaacaaagcgagggatattatatagtatatcacttgtttttgtgccattcgttaataccgaccgtgaacaaccatgtcactaagactacagtgattatgttagaattacacttcgagaggctccctcttatgtggattttgtggtgttttgttttggcctccacttatgtttaacattattttgcgttgatttttgtatggattcttttgagtcttgactgtctgtaagatgagaacaattgattattcataaatcagtcgttgtaatgattttcataattgataataataataatgcatccacataccaagggtatataaccatgaaaaagaagaataatgccaggtatcatcgtttcttctgttttttccccacattgctgagcaagtgaattcgatctctttggccactgcacaacccgtcaaccccttatcatcatttttaagaccttcaacttgtattcttgtccctcaaatattgagtcttcaatgtaatctttaatactccctccgtactcctaaaggaagtcgtttaggacagcgacacggtcttcaaaacataactttgacttcttttttcaataaaaatatttattgaaaagtgatatatgtatacttttatgaaattatttttcaagacaaatctattcatataatttttatattttcaaactcaataattcgagagttattcatgatttatattcccaaggtttgacttaaacattatcctaaacgacttcctttataagtatggagggagcatttttccttgccatcgggggccttcatctcttgcaattcaatggtgtttatagagagagattgttcatacactcgtatacccgtaaaatttaatcattgtttattaatgattgattgaatctgaatatgttgctatcattacttcattagtggcacgagaatattgtcacggctcgtccaatccttccggcgtctcgcctagattgatgtggatttgacgaactcgtaagaagatttcggtggaattttgggatagagaggaagaactcgagctgaggttggaggagaggtagttagttggaaatttgcttttctcttcttcgatagccagcccctgactcagaggtctgtatttatctagttacgacccaactgcctcagcctatatggtggcccgatacatccatctaatggcaacacaagtctaatacacaggccaagcctaacaatttcccttcccttaacaaccggcttgaccccaagctggtgcccttggaaaacgctgacgcagttgctgaagattttcttaggttgccagttcttccggaagccctgaccattgtaccagcccgaagcgtaccgcagcacaacctcgcttgattagttgttgacgcagtatcttctctgggcgacttccatctgcttcctccagacactgcacagggaggtcagaacaaacttgcgtacctggagcaacagctttcttgaggagagaaacatatacaactgggtgaatctggctctcctttggcaactccaagcggtatgctacctttcccactttatccagcactttgtagggtccaaaataccggaaattcagcttgtgacatgatctgcgcgccactgatagctgcacatacggttgaagcttgaggaacaccatgtctccaacctcaaaatgtctctctgagcggtgtttgttagcttgatgcttcattctttgctgagctctggtgagatgctagtgtaggagatcattcatgtgagccctatcttgtaaccaactgtggacatctggtacagtactttggccaagatctgtcaccccaaagtgatctgccttcctggcaaatagaacctcatagggagttttgcccaaagcactatggaatgaagtgttgtaccagtattgagcttgggataaccactgagaccacttagtgggacaagagtgaactgcacaccttaagtaagtttctaggcattggttcaatctttctgtctgcccattggtttgagggtggtaggacgaactcatatttagtttgacatcagccaatctaaacaattcttgccaaagtgcactggtgaatactctatccctatcagagatgatgattctaggcattccaaacacctcataaacatggcgcataaacagctgagccactgacaaagcagtaaatggatgtgtgagaggaataaacctggcaaatttagtgaacttgtcgattaccaccattattgtgtcaaatccccctaatctgggcaagccctcaatgaagtccatgctgatg

SEQ ID NO: 28745 - DNA, 5971 bp, Oryza sativa
  unsure (1)..(5971): unsure at all n locations
aaagttttgctaaatctggtaatgccaggactggggcttgcattaacgattgtttcagggcttcaaaagcatgctgctcagctgtgcaagtatactctctgtccttttttagcaattctgtcaagggttttgctatcatcccatagcattgaatgaatctcctgtagtaccctgttagtccaagaaaacctctcaactgttttaacccctttggaacaggccaactttgaacagccttcaccttggctgggtctgtagccactccggcactccttgtatgccaataatgtgccccaaatactccaagtgctgctgggcaaaggaacatttgctcattttgacaaacaatttatgcttatgcaacacagtcagaacctctttcaacatctgcacatgttcctggagacttttgctatagatcaatatatcatccacaaagaccaagacccccttcctaatcagatggttaaaaatagtgttcatcagcccttggaatgtagcaggagcatttgttaatccaaatggcattactttgaattcataatgaccttggtgagttctaaatgccgtcttatgctcatcctcttcctttaaccaaatctgatggtatccagatctcagatccagttttgtaaaccattgggcacctgccaactcatccaacagctcctcaaccacgggcattgggtacttattctttattgttatcccattcagtcccctgtagtccacacaaaatctccatgtcccatcttttttcttcaccagtagaactggtgaggcaaatgggctcacacttggctgtatgatgccctggttaagcatttggctcacctgcttttctatctcattcttctgaattggtgagtacctgtagggcttcagaatgacaggcttggcctaggactctagaggaattgcatgatcgaaatccctctttggtggcaactcctttggctcaccaaacctgtccttgaacctgtgcaacacttcttgaatctgtgagggcacctcactttggttctgctgttcttctatggtacacagctgaaccacttgagccactgccccatccttcatcatcccattaaactatttagctgacatgatcttgcactgatttaactggtctttcaccccaaatagcataatcctgttgttcttatgactgaacctcatcttctttctcttccaatctatccacattggactgaattcctctaaccaatccattcccaaaatcatatcatagcttcccaacggcagcagcttgagatctgtcacaaatgattgtccctgacaccaccactcaaccccaggagctacttttgcacaggtcatcttgcccccatcagcaatggttatttgtgacagggttgttcctcttattggtaggttcaatttttctgctaccctttcagccaagaagttgctagtactcccagaatccaccagaattaacaaatgatgcttctgaatcaacccttccaatcttattgtcttccttccagaagaacctgtcatggcacattctgatatgaccaattcttcttcacttccagagtctccctcttcagcctctccctcatttgcatctctaatctggaacacctcaagcagctcttccaggatgtgaagctggactgactttgggcatttatgtcccggcccccacttctcaccacacttgaaacactcccctcttgctcttctagcagacttaagtgattcaaacctgtcctcccatttcggcttctcctctaccttcttaggctcctcaggggttggacctagaatccccttccctttgtaacttggcttcccttgaggcttatatggctccttgaatacagtcttgctgtaccccttcttgcctacttcattcagcaattcttcctgcgtttttgcaagagatagagcagcatcaaccgttcttggtttatgcaacttgatcgcaattttaatttcagttttcaagccccccacaaacttagtgacaaaataggtctcatcataccccttgttatacactaagactcgatgcataagttcctcaaatctagaatggtactcctccacacttcccatctgcactagcccatctaactccttcaaatgctcctgatacttatcccttccaaacttactatgaaccgctacatagaattcagcccaactctccacactatgtagctcttcataggtctgcaaccatagagctgcattcccagtgaaatgcaaggttgcaaaggctgcccacgactcaaaaggaacttgatacatgtggaaatatttttcacaattggttttccaaagcttagggttatctccatcaaacctaggacagtcagttttgggcaacctagttcccccatatctaaaacttccatttacaccatttcccctctctgaactttcacccaactcgaaaggaattggagagtgaggaaactgtcgtttacctctgcccagggttcgctcttgagccgcaagggactcaacagcagccccctggtgttgttcttcgacgcggggccctacgggcgtcttcatgttcatcggcgtcgacgcctccagagcggtgacgtgcacttcgatcccctccatggacttgttcagctctcggatcccattgtcgacgcacggaatccacttctccatcccttgaagagacaccaagatgttgttgaggcttgcggtgagatctgccaccttcgtcgccattgactcggcatctccttccgctacccccatttcttcctgtagcagcggatttgccttcttcctcgccagaatttgggttgatcgaacggctctgataccagaaatgtcacggctcatccaatccttccggcgtctcacctagattgatgtggatttgacgaactcgtgaggagatttcggtggaattttggggtagagaggaagaactcgagctgaggttggaggagaggtagttgggaatttgcttttctcttctttgatagccagcccctgactcagaggtctgtatttatctagttacaacccaactgcctcagcccatatggccgacccaatacatccatctaatggcaacacaagtctaatacacaggccaagcctaacaaatatgagttgtgccacttgtaacatgctcaccgatctaattttttgcactgtgcatagttagtatttgaaggccagatgattcgatcgattttttagatagggaataagtgctgaaattttgtgaaattttaggagaaggctttgtgcttggtcttatatgtttggtaaagttttcagaaaattttaaatcgggtgacgaaaatttgtgaaattttaaaagaaagtgtttttgcactttttacctggccttaatttgttcacttttttgcgtttcatttttttgaaaacaagcaagcacataacaacatgacaacactgagcataggagattaaaactacggctgttacagctaggatctatctgttctgtaccaaaccatgcaaactagttctgattatcttgaggatatgattgatgacgaatcatatgattcctgtaaacctgccacacacaggcccttacaaaatacaaagctccacgtttggtgaaattttaccaaggagaaaagatctcgcagctgtagcagcgtgctcgaaccttgtatcacgaattttgttgtcgatcttatcttcatatagtactagccacccagtcgtgcttcgcgcgactctgagtgcttgcataacctgctagtaagagtaggcaattgaaatgaccttgttactgcccattcattctcatccgcaaaggcgttggtggggattgcgaggctccgaccgtagtagaggaggaagagatgttgtcggcgtccggtggcgttgcagatcaggagtaggagaaaaatgttgattagtggttgaactcactagtgtcgtcgatgttcttgacagggttgttttgttgttgttgttctgctgctggtagactgcgatggtggtgcatgactgcgcgtggagatggcaatggcgttgagctgttggtgacgttgatgcagcggcgcgtggagatgtgatggtgttgggatatgcggcgatgatgcaagggagcctctattgatgtggactgtgctggagattgctggagatggggggatttggatagtcttcttctcgttttttatcccctgcctttttctgctaccttccggatggttcttttttaaaaaaaaaattgtttgactaagctactttgactagcgggaactatgctgatagctattggtgtattatcctaatgatctaacggtccacttttcttcccactatcatcctagggctattattatttaggtgacgtggctcatcctcattggagagagcttgctgctttcacatatgtagatttgagttgtctctatagtaacagactccagcgcagggacattttccacaacatctttaagaaattcaagctgccctctctcccctttatacccagtgatgtgcatgttcttcagataactatattcatgttgctcgagatggggtgcaacataacccttatccgaaaaccatacatgatgagggcaaccaaactgcaggttttgaaacaaaacagtatatgatcagcatatggtatacatggtcatatgataaagatttctccaataaaggagtatgatcggcacacaattcagatttttacttattaatactcaagtcactttgcttatgacatagaattctgcatccaaactcaaaacaaaaaacttgatatcactacggtaacttcatctgggctttcatccttgaaataggtagtagtagatgataaataaaaataatgctgtgcccatcgtgaaatagtattatactaatgacttcatattgcaaatcaaatgcctgaataataagtgaaaaaaaattcctgaaaagtgctagatgaaaagaaaaggtatgaagcgctgaaggtttatcctgtgctgatatctagacttctaaacacagaaacatcatgcagatgactgagaaacgtgctaaaaacaagagttacaaatgaaaacatattcgcatgagtttgtttagcacactattccatcgtggaacaataaaaacggagacattggacaacaccatataacttgaaagcaaaaaaaaaaaaagacagaagggccacttgcgaattagatggatatcaaagatataagagtgtgtatcttgcacaccagagaagtatggcagagaaggaatgggagttacttacatggacctccaacttttcaatgaatggagctgccctaattaaggaaaccgcgtaatgtatcttgttggcatcttcagtttttaagttcattaacaactgcagatgcctaagattggaaaagctgtgtcggttatccaacagccatcgtgcctgtaaaacaaaaaagaaaaaaaaatatatgccatcaactagatgatggtagatacattaaaattgcagcttaattcaacgattttccaagagcaaacctctatttgttggaaacaaacatgcaatgtcagattccgcacgattggaatccctttgagaagtgttgcaacagcatcctggaaagcagccttgaagaaccaaatgtgtgcattttccacatgagatgtatttaggataataggaacaaattaagtgtccgtcaaatatgaaggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28746 - DNA, 12281 bp, Oryza sativa
caaaagattgtgggcccaaagctgcaaatctgatcatgaacctgtagcttattttggctccctattagggcatccacaatgtgcaaaaaaaaaaaaaaagtggatagtaagaagtcctattacctggttcaccattgtgggagtagctagtaaaatgggtagtagtatcatccggtagtagtgctactaccaggcaataaggaataaacaaatattaagactctctcatctctcattccctctcttcttcaaccacccattctcttaaatgtggggcccagcttactacctttacattgtgtgaactaaaataattactacttggttttgtaggttaatcggggcgttacataggtcccacccttgctacctaacttgatgcccttattggaggggaatctccgagctgaccgatgaaggctgaatgacaacttagtgtaatgtgaatgaccttactatgcgtcacataattttatgccgggctctgccagaacaacatgcatgtgagaaaggcccaatttcgagcctcacccttctttttaataaattttaataaggatatgcatgctgattttgttgggggatactatgcaaaatagtcaaaaacaatttctttttggcagtagactagactggatggcacggtagcagtggtagatatcctaagactttcccacagtggtctagctacagccttgataccgaagtgtcttcttcggcgaccctggttgtactttcccctctccacactgacccaactggcgacaccatgctatataaccaaatgaatcctctcctcgactcctccgtcccataccggcacagcatgcaggacacacagtgacgtcggtttgttgccacatgcgtgatgcagcggcggaggcagcgcgcgaggcagagagtcacgggagagagagagagatcagagagaggggaggaggaagaaacgaacgaaacgacgagaggaagaagacgacagcgttgagccaccagcaccgtatcctcgacagaacagaatggcgctgtttgtactgtactgttgctttctttcatctctccacccgtttcttccgatctctgcatccacctccactgcgctatgagtgctagtagccatcggtggtgccaccgccggtaaaacgtcgactagctagggggctgattgctacctcagagtgctctgagagcatgtcgaacctcacattcagaaccgtaccttggaatttgataccccgaaacggaacacaatttgagaccctacaagaatgccaagaaaaaaaagataaattagccgtggggctctgtaagaagcactacaacagaaaacgtttattggtgccagttgggaacccctataagtgttagatttcccaaccggcattgataagctgtttgaaaaaaaaaaagccggctcggctcggctcaatttgagccgatgcctcaaaagcaccaaaattaaatccaaaaatctaagaaaaaaatagacaaattcatataagagaatcaacaagttcatagaatgagaaatattcatgataagttaacattataggaccaaatattcatcaacaagtttattaaaaaaccaaatcaaagaatacaccaatcacagtggagaacttctaccgccaccgctgctcactggagaggaaggggaggctgctgcaaccacacacgaaaggaagggaggccgccgacgctcgttctgctgctgagggtaggcaaggtcgtggggaggcgatggaggcgcatcccccccttcgaggcgccgctctgcttgccaccgtcacgttgccgcaaaggagagcaagggaggctgccgccaccaaggagtcctggagagagagagagagatggagaggtggagaggtggaaagataagaggataagggagaggtggagaggacatgtccctctatcatcggtgcgcgtgaaaaatctcgtgaaaggctaggtcggcttggctccttcgaggtgttgtttttttaaaaaaccgacatctataatacttaaaatgttagtttattcaaaaaaccggcagcaatatttggtacctactttttaataaacatatacttatatggtgatgaggatacaactagctcggatataaccatgactaccttatgtattagtcaactaaaggtgcatatgttctatattagatttacatgttatatatttgaacaaacgttgctacacaatgagtttcatgtgtttttgtttgtagaggtacttgcttgggtgaagcaaaagagatcgagcgtaaagaatgcatgaatgattgaagaagtcgattgcggaccaaaccaagactttctccaagtcttctttcatctcaccacgtcacttttggtcatagaagacgagagataaagttccacacgttttggattcagattcagacctcctgacagcaccaacttcaaacggacctagccgctgatctagaaggaatttcggcgcccatgagtatttgttggaaagcttatggagtctactttcatatggttttggtcccacatcaaaattcctactgagctaccgggaatctgcaaaacaagccgcgtacctcatccagtccgaatctgatttgtgttttgggccttataattgtgtcgtggacttaggccaagggggtgtgcgccctaaggcaaccctaggacgtccctaatcatttttattcagtagccgtcatcgtttagagtcgggttttgcttagattattctgtcaagaacagtttcgccggtagatcggtttgtggaaccctaaattcgagtgcttaatcattcatatgcaatttggatgcaatctatcttgttcttgcttgtgttcttcgattcgcatgtagggattagccttctcggcgaggtcaattgggtttcggcacgattgataaccagaggagacgtggtgctgtgattgcggggctcagtagcgtgtttgttcagaagccggatcgagttgtgtctcgactccgtccaaatcgactgtttatcagtacctatcggaagatcgggacctaacacccttatcaataggatcaaatgtgtcggtcgtgttatgaggggtgggaaggggttgtaacttgtaagtgcctgttttagatgaattaacacctctagtgttgtttctttttttcctttcaatagtagcaaagattcttttaagtgaaggctgagaaaaaaaatatgtcatgatatagtgttttctttttattaaacggataaataaaatcgctgttgcccagaacacacgtttatattattgtcatgagctagctctttgtgttagcaatggttaccatcgaacgctttctggagcagaagaaaacaagtttgttatagccagatcagcataagagtaagagtgaaactttttgaatatcaaaagagtgatctttaaatacacatagacatagactaaaatataaaataattggggctctttttttttcgcgttgtaacgttactcactttacaccccctcaacactttttttttgagtttaatagtatagcaaactattaattagctttaaaatttgacacatcatttacagccaatcgaatagtctattcatacaatagttatatataaatatatactacaccattaataatatgtaccccgcttttcttttctcttcttccctctctctttcatatgtgctcgtagttagcttatactcttatattgtatttgctgatcttatctcctccacagatacttacagctgccttatagtctactacctccatccaaaaatgttgcaagattcattatcctaggataatgtcagtgaaatggtaaccggggtacccattatccggcaaaaggagcattatcaaataaataacatgatcaagatatctttagaaaataaaaaggtaaccttaaggtgacgtagctaggggcccattctgtagggtctcgagcccacctaagatttcatatatatgattctctttggctgagaaggaatactgtgtatatgagctaaaactctgagtataaaagtatcttggggcttaacttggatcccaagcataccccaaatataccttaagaatatagcctaaggtatgcatccctattccgggccccaggctcaccctagcccttataggttctatggtccttggcaagaggggcatagaaacttgtaaaacctatatcttaagaaaacgagctaaggtctgccttgagcccggcctagtcctaggccccgagctagccttagtccgcacaagtcacgcattactcgagaagtagaagtgatgatacttaccaaacatgaaggcgtaaactgaggtttgccttaggcccggccttgctccgagccctgggcttgccttggtccttgtctggctcgcctccctctgcctagaagggcgtcaaaacgtacaacacgcataatcttgagatattcttccatcaatgacactttcaagaagttcattcaagaataatcaaaattctttaaatgcgggaggacgcgatctcaaaaactgctaggaagttgagcgtgttccacagccagctgtgaggcagcacgccctgccataaatgaaacaggtttatgggggatccccggccagtctggagttgaaaggacgtagacaagacggcaacgttgagtcattttggacggtggtgcctaggacacgcgttgcacatgccccgcgtcacctgatttagccaaacagacagagaagcaaccgtggcgctgtcttgggcaggtcgggcctcatcgggcccaccacgctccacgtggtgagcacactggcagaggcccaactgtctcacacggagcccggggtaatatgaatagtaagatttgaagagtttcttgaagattgcattaaggaatcagccggcaacgacaagatggctgatgagacaagactaagagtagatttgtaataatgtgagccctcttggagtataaaaggaaggggaccaaatacggatgaatggttggattcttttagactttgtagtctagaaagacctcctttgtacttagctggtctatagaagacaacaaacaccaacacaagagtaggatattacacctctggatggcttgaacctgtataaattcctgcctccctctcctcgcagggtggccgggcccatcacgatcacagttacccagcacctctagccgactaaccccctggtcagatcttcactctcggagaggggtctccacttcccgctgtccgaagtaccaccccctcgatggatagatcacatcccattttaggttgcaacattttaggatggaggttactgtactcttatactactaattatttccgtcactttattatccctgccctaatatgctccacggaaaaactgcctgtctatgcaaaggagacgagatggccagatgggagcaaacgatggattgtttttccagatcaaactctgattttggggtacgtgcacgtcggacgagaaagtgagcaaaggcaacagtggggagagcaggtggatcgaggtggccatgcgtgatcgccatgatcgagccagcagtaggtccagtggtagctaggattggagagtacatgccctccgggcgttggtgtagcttgtcagcctttgttggcctcggcgtgtccccttctcgtcaggcaaattattaggggatcccgtcgatagccccccaccagcggccatcgatgcattttgtactagttcctgctttagggctgcatattcaaaccttaagttttccttcactcattgcttagcctgatctccgtacgtaacagaggaaattttcttgcggcatggaagtcctggaaagcacaagcaccggtggcatgctctatcatgtttcaaattcttgtgtctataaacactggagtaaattttatataactataaatattttcacaaaactatagattaaaggtatattttatacaaaatttctcatagaattacaaatttaagatgaagtgtcaaaaaaataaaaattaagtagtaaatatatcacaaaaatatagatttactgtcaatttaatcacaaaactacactctaacataacggtagtgctagagatttaaactatagaatatgtagttttatgataacttcaatattatatatatatagtttcgtgatacttagccttaaatctgttgttctgtaataaatttatcgctaaatctttagttttgtgatagtttgataaaactacacattgttttgagaaatttactctaaatattatgcttttgaagaaattagaggcagatggaatcaacagtttggttgtagcttttcatgactaaaaaaaaaggggaacgccattagtgtattaccattataagtttaaaatattgatttatttaatttgttttagaaacttttatttgaaaaaaaatgctatttaatttagcagtttaggaagcgtcataatgaaaagggtgaatgaaaagaactcagcctaagctcaaggacgttttcgataggaatagttttgcttattaagccgttcacggtgtggggacgtggcgcgttccttcactgcgccacgtcggaaaaacgcccgcgtgtcggtgcgagtcgtgtcccaccagagcgacttgtccccatggagggaagcgcgtttcttcgcctccgcgagtccgcacgggcggggaaagcgcgtcgcccatgcgctgtggagggcgtgccttcgtcgcgccgtgcccccgcgtcgtgcaatccaaccggaggaggagaatgggaagggagcggccaaatccgaccagaggagaaggcccatatggaccgcagctgaggagctcggcgccgccgcaaccctcactccatgctcgtctcgaccgccggcgccatagccctcgtcgggctcgcctcaaccatcggcgcatgcaaccctcgttgggtcgccgccgtcggggaagcctgaggaggccgtcgccgctccacgtcgcgacgaccccgccgatgctccatcgggggagctccttgacgccggcagagctcgtcgtcgtcttcttcctctacgcgccggtcgtgagtgggagagccagcaccggtggagggagaagggggacgccggccaatctcgcgatggatttgggggagaaaccgcgcaccgcccacaccatcgctgccgacgctgtcaactccgctatgagcttcttgcccgcaccggtgaggaggcgtcgatgccgccagatctgccccgagctcgtcgccatccacgccgccattgaggcttgttgccgggagctcgccgaacacacctagcctccatctgcgccaccgggagctcgccggccactccgtcacgcagccattgaagcgcgcctcagggatctccgcgaacgccaacggtagaaggaggagaggagagttgccggcggttgggctaggaggagaggacgccggtggagggaggaggggagagccagcgccgggcatgacatttgtgggggtggtggggtgaggccgtgagggagggggatttggtgagacaacactagttggtgcttgcactgtgaagaaaatgtcttagaagctcttcatcttaggtgccaccatgtggtatctcatagttggtgcttatacagcgagtgcccttgccaggtcattaccacatcaatcaaccccacccgtgaaagcctggtccaccatgcaaagcgaagcccgtacatgtacagggcggcacgcggggtggtggccagcgcaacagccgtcgtcgggtgatctccctctcccggagcccatatgcgcggccggccacagccgcagccgcaagagcgagagcgagcgagcgagactcgcgcgcgacgcgagatggcgtacgagatctctcctggagaggacaccgacgacgcagcggcagcgcagcgcgcgggcagggcagcggcgtacgtacgtgacaccggagcgagcggggtgggtcggcatatgccgtacgtacgtgctccacggcgaacgaacggagaacgcgacgaacgggattattcacggggcgtcgctgtcggggtgggcggggcctgctttgctttgcctgtgtccactttattcattcattcccctgtgaaaacctgcgcctcggctatcgtggattcgtggtcgctgccggtgccagtcggtccgtggcgtttccacactcggagtccatagatcagtcaatcgattctttctgtgtttgggagagagggactatgctgtgtttagtttgcactgaagtttgaaagtttggttgtaattgatacgatgtgataaaaagttatgtgtatatgaaaggtttgatgtgatggaaaattggaagtttgaaaaaaaactttggaacaaacacccgcttgtaattttttcttcttttttatacgagggacaccggatacacagtcaaacaaacacacacgatcgattctggtgtagtatactagtagtatgtcgtgtagatcggcatcaagaacgtgcatatggacgggatatcggtactgtcacatgccgataacgtagtgccgcagctcgtctctgagattgtggtctggctgggcagaatcgattttaagctgacgttaaaccttaacatcgatgtctctcttacctcctccttatctctcccttccttgttggcaagactaaggctgtgttcagctctatgaattaagaactaatctcccacatatgcaaaacaaaacgatttattagctactcccttcgtccccaaatacaaaggattttgatattttgctttcattgtttcaccattcgtcttatttaaaaaatttagaaattattatttattctatttgtgacttactttattatccaaagtactttaagcacaacttttagttttttatatttgtataaatttttttgaataagacgagtggtcaaacgttacacgaaaatagtaaatatcccaaatagtaaatatcccttatattagaggacggagagagtatttgtttgaaaatggattaatatgattattgaaaagagctttcctagattttttttttagaaaaacacaatgtttagcaatttgagaagtgcacacgaaaaacaagggagtagaggttgagagaaacacagccaaggcccagttctttttatcaacttcaaacttcaactttcgttttccgttagcacgctctttaaattgttaaatgttgtgttttttttttaaaaaaaactttttaggtaaaagttgtttaaaaaaatcaaataaatatattttataattttataataattaatacttaattaatcatgagctttttcgttttgcgtgcaccgaaaatatcactactatcaatttacagaacgaaccggtcctaaggattgttatacatgcggatcaatctacatcatcattgtctacatccccacctacaactaagtgcaaatttgtcacatttttgtctgctcctatttattttgttgcttttaagcatttaagggcacatgagtttttttatctctatatttttctaccccatatttatcgttttggataaggatacagtcttaaaaaaactttaattactattttttattataatataaatataaataaatatatgattttattaaaaatactttttaagattaatctatgcatatgatctccttaattctaagacaaatattttaggaattattcataatgaaatatattaaagtttgatatcgacctggttcaaaacaataagtattatcaacctagaaaatcattgaatggtataataaatatcagattaatacattctcatgtccaaaagacaccctcattcacccagtggtacttttacaacttttactgccatactttttttaccgtaaaaaagtgaggaggctcccatggtatattgaaaatggacatttagagggttttttacaagaaaatatggtagaaccagttcgtaagaaatatagcaaatgtaatgtagttgttgtcttaaaaagaatattaatttaacttgtgcacagcacactccgaattattttgcatttcaactaaattccttactgtcggctgaacattcatagtctaacttgcatgatgacaagcagggtagggttgtaggttgtgtggaccaagttgtaaaggtgagggttcacggagccttgctgaggatgagtgacgagtgtaacatccatgacaaaaggaatgaagttacaacgtgaggaaatgttgacatgagtgacataaggctcactattaaaactacacgtgatttgaatttcacattttgccaatccattctagtaactgaccatggcttgtgaaaacttttttttaagtgaaagcggcaaaagatttgccgaatatattagaagatcagaatatataagatacataagtgcgattgcaaatttagcccaaatacgacaactcaaaagggatgtgaaaacttttaagtaaaaggtactctttatttgaggaagaagtttgaatcaccatatgaatttattgcaacggtctgaattacctctttaaattataaaaccagacattctatactttgaactttctaaaccggataaataattaccctaataactcaatttgaagcggttttgattctacctagcatacacatgatagtccagtcagccaaaaaaataatagaaataagtgggctcgacctatcaatgctacatcttatactcccctcttctccattcttccacatcctccttccccttccatctatcaaacaaagacacacacacacactctctctctctctcccctcaacatgagcatgatttggcggctaacgttctccattacttggtgaaggataatagagaggaagacagtgacggcctccatgagatggcagaggaagacaacatcctgcaaagctccgacctccacttgtttccacaccttggcatcatttggggtaactgtagcgatggcagcagcgtccctaggcataggaggcggaacatgacctcctcaactccaccttcaccatgagtacatcatcctctttggcacacatgccaggcggctattgcatgcggagttcgacggaaatcagtgtgagaggagctagttgagagaaggtagtgagaccggtggatcttggtcacaccaaccgacaagagggggaggcaatggcagtcccatcttgacaaaccttatcttgctcccaacctcaccgttctctccttggcaaacaacttcttctttggcgagcttgcaatggagagatcctagggaggggggtaagagagggattgacttgagagggggcgaggagggacaaaaagggatggcaggtggacctatggatttattctatttttatggtgaccggattacaacgttgtcgccacgtgtgtcagctcatgttaaaaccgcacaaatagtgcttaggggttattcgtccagtttgagacgttcagggtgtaaaatgtctggttatgtcattcatggaataattcggactatcgccttaagttcagaggtaatttggaccttttcctttattaaaacagttgactaaaaaatgattaaaattttctttataaaatatacgtatactttggcaaaactaacaaaagaactacaaattaaaacttgtgtaccacagcactgcaaactggaggccaaatttactacaaaactacgtatttaagctcttttgaattataggaaaaacatattcagtagtggctttatgacaaaactacaaatcttaaagcttatcttatcacaaactatagaagttatggattttaagcctatattagaataacaatgtttggatgaagcacataaaatctatagttccatgataaattatatgctaaatatgtggtttaatgatttataaatttaaaatatgtaggttttagatgaaacacataaaatatgtggtttaataatttgatcaaaatatctgtagttcacggaatttaaattgaccaatactaacatctaagaaatgagtttcccatcttcaatttgcagctatgtgagcagtccccgcctactatacgagcctacccagtgcccctcaatcagctggtcggctggtcgcacacaccacgttccttctcccacctccgccatgccttcccgccttctccagcaactgccgcctccgccgccgcctcctcccctcaaccgccgccaccatcacctcctcctcgccgcctccgccgccgccgccacagccacagcgctgctgctgctcctgctcctgctgctcgtcgcgctctacctccggagccgccgcgcccgccgccgtagccccacgctgccgttctcgcc

SEQ ID NO: 28747 - DNA, 9014 bp, Oryza sativa
ctccctgctcgggtactccggccccggcggcggcgctgacgaccgcccgctcctcctcgtcttcgaatacctcccgcacggctcgctccaggccgcgctgttcggcgacgcccgcgacgggaggttcctcgactggccccggcggctcgccgtcatccgcgacgtggcgcgcgcgctcgcgttcctccacgccgaatgccagccgccggtcgtgcacggcgacctcaagcccagcaacgtgctcctcgatgccgacttccgcgccaagctcgccgacttcggcctcgcgcgcttcaagacccccgacgccatcgccgcctccggcgctggcgcggatgacttcatgagccaagaactcggcgaggccggggaactcttctccaccgcctgtgccgccgccgccggcggcggcgtcaaggcggacgcgaaggacgagtccggcccggccgccgcgtgggggaaggagtggtggtggaagcaggacggcagcggcgagctcgactcccgggactacgtcgccgagtggatcggcagccaaatctgtccggcgagaaacccggactgggccgacgacaacgacggcgacgccaacgataacaacaagaactcaccctccggcacggacgagcacgccgtggcagcctcgccggaggacaagaaggacgccgactgcaacggcaatgctggcggcggcggcgacaagaaaccagaggcgaccaagatgagggagtggtggaaggaggagttcttcgaggagatgagcaagaagggcggcagcttcgacaagcgtcgcggcggcggcggtggcgggggcgggaagccgtggctccggtcgatcagcatgaacaccggcaacggcaatgccaacggcgacggcggcaacaacatcgaggcgacgagcggcctggacatcagcagcttcaggaggaaccggaagcggagccggcggcgtgggcggtccgtgggcagcggcgacatgcacagcggcgacttcctcagccgggagctgagcacgacgacgagcatgcgcggcacggtgtgctacgtggcgccggagtgcggcggcgggccgtgcgagcacggcgccgagctgctcgagaaggccgacatctacagcttcggcgtgctcgccctggtcatcctgtccggcaggcggccgctgcacatcctctcgtcgccgatgaagctggagaaggccaacctggtgagctggtgccggcagctcgcgcgcgccggcaacgtgctcgagctaatggacgagaggctggacggcggctacgacaaggaccaggccacgctctgcgtgcagctcgcgctgctctgcctgcagcggcagccggagcaacggccggacagcacggacatcgtcaagatcctcgccggcgagatggacctgccgccgccgccggtggactactcgccgtcgccgcgcgtccggccgttcccgcggtcgtcgcgtcgcgcgcagccgcccgatgccaccgagtgattggtaactctgctcacttaaaaaatttgatccttggggatcaatctacaagttgccatgccctgtgttcttgcaggagatttaacaaaatttgtcgaattttgctaatctactagtattgtttttttgtacatagcaatagcagcaattcgtcttcccctaattgagcaatggattctttggatgtcaattctaacaattgatcttgcatcttgcaaaaacttagcaatagatttttaggatttagtttctgatttctttgtcagtttcaacatatttagcagaacagtactagtatttttgttgattgttatgtttgtacatgggagatccaaatccatcttatcatggaattctttgcctgtcaatttcttgatgtatcttgtttgcaaggatcactaaacatttttgtgtgatttaattgatttttctctcgtaatttcttcatgtgcctgatcttaataaatgaaaccttggtctctatcaaaggtggagaaaaacaaacgaacaaggtagtgagcaatcaagttgatcagatattttttcagtgctacatccaaattgcacagaaaaggaagaacatttgcgtactccttgtgtgttacgatacctaacatataggtcaaatacgatgcgtctctatcaatcttcagccaaaaaaataacaataatgatttgtagcatagaagtcaaccctttgtacatgaaaaacctttatgaaaaccaaaggtttggattgcttcccctcgcgacaaaattgaattctccaaaattctctaccggataagttggtttatgttcacaagcaaccgatcctggagaaatactacaattagtacatttttgctttattctcaatctatttgctgcagcaaatggagtttcctgtacaataagcggccagtctgcagattcaaaatcaggatactttcatagtctcaaaatgatcaaaaggggtgacttcttcctacaagtttcaaaaagctcattttgccaggcatccatggttggtgttttcagtcaattttcaccaaccacacatcaaacatggttggtgttttgttcttttactattccttccataaaggttttgcttacttttcctcaaggagataactacaacccaggaaaaatattcagtaaatttactccatacacgtgtgaaaactattcctgatgaagtgaagtgaatcttcttggtaccaactctgatcacttgttgtctgaagaaggaaaggcaaaaggattccctgtagaatttcagaaatcaaaatcaaaacaactccctcttctcctttcctagcatgtttcgtgggacgattatgcgtatgttttgttcatattccttagagcccacccgagttgctatgaacaaaattcattcatacgctttgtcgtcttgcgccttttgaggacttttttcacagttcattccttcttgagactttcatagctcccacaaattccatttcagtgggatggtccaaaagtgccattttgccctccaacaccatctagatggccctgaatcagcttcagcctttgattgattactgctgttggagatggtgtttggtgattgttgtatggtgagtccgtgggttttgcatgcactcaaaatgctgccacaatgttcttgctgtggtactcccactgccactgcccacatgacctttccagctcccagtgctcttcatttccttttagtttatggccttcatttgtttgattagggtgtgagatgtccctccctgcactagactaatgaaattgcatatctgttccttcagtttggcaaggcaacaatcctttgttactactggtcaatggttttagtggatgctttgccttgtgacatcatctactcttcaagttgttgtcttaactgaagaatcctcatggctatatgttaaccaatgaagatagcaaagatcttgttctaaaatgctgaagttactgctgatgctttttgtactagctagtagaaaatctctgtcaggaagcactgttttcaccatcttaaacactgtgcatactggtcagttcttctaggagactgacactggacaaatagaatggtcaaattttgttaaaagacaaaagcacccagactgcatgacctggctttgtgcatgatggatcaagttgacctgtaagactgaaaagtcttttttacagtcatttaatttgcaggccatgaaaagaaggaaaaggttgcatacttacatggtccctgatctaccatgccaagaaatgtttgagctgtgagcctgtgatagactacccttttgtccattatcttgtttataaaactcatgttttgtcacattttggatcctaccatcctagcaagtcattaaaaataattaatggtcttttagggtcaaaaagtttgttaaaagtgcaattctagatctgaaaaaattaaggttcaagatagatactgcaaatcttggtgggtatattagcatttctgagggatggattggatactgaagatatgagtgctatttgcaaagtgttaagaatgtgatgttcatatatgattagataaaatgcagaggggaaaagagagtaaaagtgaaacattctactgctatccgctagaccagctgacaaaagccagctactagtttcttttgtgacaactgaaattccacacatcctaatagcagctccaacgagaggataaaatcgaaccttgcaaaaaacaaaaaaaatcgaatgtgagtgaaaaaaaggggttcatgacagaagtcgaacacaaccgaatagaaaaaaaaattcatcgggttgtgcgagagggaggcatatgcggggtgaggctgatattttctttatgcgtgggtctcacactctcactgggtctatctctaaactgcagcgattgaaccgtaattttgttagattgcatggaccgaactactcgcaacaacgctagagatgccctaagaaactgaaacctaaataaaactcaatttactaattcagatatccaagaggggcactacaagatttcagtgtttctgtttggaaatatattatatcaaaataagttattgtacggttttctatgacactacaatttactatgcgatgaaattactatacaatttatatcaacaaacgttatatacccaaaattgtactttggagatcatgtcaatgtccaaaatacaactaatatttgactaaatggagtaccaaatgcagtactttgttttgagatatcacatttctaactgctactactaatataaagaaaagaaaattcattgtccatatattctccactctcatgtccctatcaacttatcaaggcgtttctcaaagaaattgatctatgagtcgtacgtaattccattattggatttgtctttcttgttaagtctttcccgcgtgcgtcatttaccttttaaacatgatatcctcatccatgtcactgaattgactcactgaatttctcaccttatttttctttgccttcacaaaacaaaaaaaaacatttcttttttctcaacaacattagctagagtcttcctgggtgatttttttactccctttaattaaattccgacaggtcttctgccgtcgttcccttaaaaaaacattagctagagccaggttgcttctacttcatatggggtcatatggggtcccacacgaattcatgcgatagtgctaattccctctagctaggcagctcacgtctgttgcagatatgctggataattattggaacaaaatattttttttctcagctagtagttaagatatacgatgtgccagcccatgaacacgggttttctgctcatccaaggccatgggccacagggacatgacgtcaccgtatgtatgtgttgtttactgcatttttttttccaaaacacaatacataggccgtgtttagttctcccaaattcccaactttccatcacatcacatcacatcgaaaactttcctatacatataaactatcaactttttctccaaactaccaactttctctaaactttctaacttttccaccatctaaacacagccataagcatgttcatataaacggtgctaaatgcgagcatactactgctataaacgcctacacacactctatccctataaacaggggcggagctagaacaaaacgaagggggttccacttacttgctttactctggtttgaatcaaatttagcttgatacggtgtgacatcccagcctagggtttaataggattaatataatactcatatcaacaagttgcagcttcttttccgaaagccgatttccaaagaactccaaggttaagcatgcttggcctagagcaatttgggatgggtgaccgaccgggaattctgtggccaagaggggacgttcctggcctggggttagtcgacggggacgtcttcccggtgcgcacgagtgaggtggcggacgtggccaagagggccacttcctggtgcgcacgagtgaggtggcctggggttaatcgacgggggacgtggcgaagaggggacgttcctggcctggggttaatcgacggggacgtctttccggtgcgcacgagtgaggacaaagtgtgcagaaaagacacgtgttggtctgtgagggcagtctatgacttatgaaagctgccagatgtaagcgggcccggcctgggagagccgggacattacatacgggtgcctaaatttaaactgacggggtatatatacagtgaaaatagataaactatagctaaattttttttgaaccgggttcctaggcacccctagctatactagctccgcccctgcctataaacacattcgaatactagatctgcatatcttaacattcacgaagtgttcatatacgactcgttgtcgatgaaaacattgcatataacttgagaaaataattagtcataaatacgagcacctcgtgccaaatctagcacttaaactcgggtgaacatgttccaaaaccaaaaaacctaacctaagtagctgagcaaggctcacttgcataaatttgatccggtgaaaaccatcaaataattaaaaacccgtgaaaactagacctaaaagttttaagaaaaaaaatcataacactccaccaaattccaaatccaaaataaactttattttgaagggacaaaacaaacaaatattgaaaaaaacaatgaaagtcccacgttctggagcagttgtcaaatccacgttctagtttcactgtttttttcaagggctttatccaaattcttatgtcagcttctcgttcctccaatattgcgcactaagggtatctacaatgcaagctactcttaaagtgtccatactaactaaggacactagtagggaaactcagctcgtaatggaggacactcctagatgggctcctcaaaatctgaagcaactaatagagacactcaaacccacaatgggtatcccagtccacaaagccccatatttatttttccaaccctacccataatctctctctcgccccctctttttttcaccacgcacgggcgcctctccatctcaccgccgcactcacctctccctctcgccgccgctgccgctcgcctctcccgtcaccggcgaccgcgaggacgacgaggagggccgcctctcccgtcgccggcattcaccgccgcccctctttctccctctctcccgtcgccatcatcgccatccacctcggcctcctccgtcgcgccatcgtcgccatccaccccagctctctctcttcggcggtggccgcgagaacgacgaggaggaccgccgcggccgccggagcttcatcggcaagggcgacgaggatagccgcggatccaccacctccgccttggatccgtcgctgccgctgctcgccgccgctcgccgctctccccacccctctctctctctctcgtcgctgctatttcaggccacagctcaagacctccgtcgacagctaaggcgagcccgggcgatggctactgcggcgcggtggccccgtcgtggatccgtcgtcgtggcgcgtggttggcctctctctttcttcggtggccggcgagggtagaagcggaaaaacaggaggaggcaacggtgtccttgggctactccctagccacgccccgcccagcgcgcctcctcgctccccccccagctgaggcgctcgtagagccgtgtccctcagctgggggacggcaaagcgacggagcggagacagccatgagcagggacacgctcggggatacgcattggtgatggcctaagggtatgtttggcacgtgcatagctccagctcaggtgaaactagaacccaatcaaatagtttgagtttagaaatttgagccctgccaaatagatcctctaagtgggttttgtttggcaaggttttgtttgtcatgtagaggcccgcaccccgctctatcccttagtttattctttagatcaccttagcttgctccgctttcttttgagtgaagctaaaccgtttggtttggatatagctctggaagaggaactgtagccctgccacgcaggcccaaaattgtcatatgtaacccacatatgaccaaatccaccttggatttggttagggcagtaatccagttcgaaccgttttagagattgttcggtattgcgttagagggaataaattggcctaaagcacaaattgaggagcaaattagactttttacttttatgagagggataaatccaaattacatccttattgggtttgttaaaaaaatatacttctcaaccatgaaaccaagcatttaacatttgtacttaaataccggtgaggctaatacaatccaatttttatgagcttgacatctaagcaatatatttttgagtaatttcagtcaaaattacagaaaaaaaaaacacacgagaatttttgtttgtggaataggttttatggtctaggggtttcacagaaccccacctttctcaagtaaatttgatatatatgaaacaataatatcaaaaagagtaaattaattacactctcaggacataaacttggtggatgtaaatagctacaacaattataaattgcttattctcaaacaataacttgtcatgagaacccaagccaaaattatccatgcaaagcaaaattgatttaacatgcacatactaatgtgtaattatattacatataagattttagacctacagaatgtgtaattattattcgtaggatatttttaagatttacatgactaaaagggaaaaaatgctaaaaatgtcagaccatgaaaactaattatatttgttcagaaaaaccgagaaatgccattgacaaatacaaaaatctaataaatatcatcaacgagtgcgagttctataaaataccattttacaagcactactataaaatatcaaataggtgtcgccactataggtgccagtagtactaaaaccggcacctatagaccttttcctacctccactagttgaaattacaaaaaaaccggcacctttaagtaattattggtgtcggttctaaataaaaaccggcacatattatattctgtatcg

SEQ ID NO: 28748 - DNA, 3957 bp, Oryza sativa
cctatctaaatcgagccgagccggagccgagccagcgggccccaccacgaccgcacgacgagcaatgcgatcgaggagataaggtcaagctcgctctcttcttctctctcgtctcgcctcttctctgtctcgctctcttctctcatctctctcctcccttcttgatctcctgcagccagcggaggcggaggcgacagcggcgaccgcgccctccccttcgccagatccgggggcggcaggaggggaggcgccagcggcgggcggggtcggcgccagcggggccggcggtgtcggcagcgggtggcgggatggccggatccggcggcgggcggggtggctcgaggaagggaggcggcggaggacccgccagcggggaagagccctcccctccgccagatctggcgggaggggaggcggcggcaggggcggtgatggggaggcagcgacagtgcgacaacgactcatgcgacgatgacttcatccggcggcatcttctaccctcccctcctgcttcttctccggtgatgaatgttgtgatttttttattgcataaatttgtgttgtgggatgattgttgtgggatgaatccatctttgaatgctgtgggatgaatcagtctttgaatgttgtgatttgttctgttcttgcggatgcgggttcttgcggatgtgggaggtcttgcgatgcgatgtgggaggagggactgctcgcctgcttggctcgatgcgtcggctcgatcgagctgtcacatcgagccggcttttttttgattcgtcgaacctaaaaggtgccggttctaagcaaccggcacctttttattttcaaatcagtgccgccttccttgtgccggttgggaaaaccggcaccgaagagggttccccaaccggcactgaaatcattttctgtagtagtgaagcgattttgtcccataaatattattgtcgttaaggttcatccatcccgcgccattaaatgcactgttcatcctatagcattcaacgagggatgctaacggaactctaacggtgaaggtatttttgggacaaagtcgtatgcacaatggtatttcatggaactcgtactcttcgatgacatttcttggaattgtgcacttgtgaatggtattttttggattatttcttatttttttagaagttgctgacttgctggtactaaggtgtgatagaaaattatcttggccatgaacatatatagaaattaacattgaacgaattatatagaggatcaatttttccaaaacataaaataaattttttctttcttaaacataaaaaatgaacttttgcacaacttatttctatttttgtttagattccaaatagtatcttcaaaacatagttgtgtgtttagctgtcagcatattatcggtgtgcgtcacgttgcgtccattttacttgcgtgaatcgtgttgggctaggttcgcatggactagccgactaattgcacctgaatgagtaatttgcaagctattataccaatttatacctatcccgtaaatttgtataccatgagcgcaatttatgttcaagagttagtaatcacttgtattaataaatcaataagtaaaccgtcaaaaaaattaaatcaataagtaaaagttttcatagacactttattcatgacaattttaagtaaatgtatgttcaacgtgcatacgggtgagtttggtgaaaccttaagaccgttatacccaaggtaatcaaagtacacgtggttttctgtaacttcgatttttttttcaaaaaaatacatatttagatgttaaaatcatgaaaaacactactccctcagtttcacaatgtaagtcattctagcattttcatatatgtctagattcattaccatcaatatgaatgtggaaaatgctagaatgacttacattgtgacggaggaagtagtatacaaaacaaggttatattgtacttgggggtattttgccaggctttgatagttgagaggtgttaaatgttgttttgatagttgagacttgagtggtactatttgttagagtttgtgtcgaatatgtgtacatagtcggttatagtttaggacttggagttgtactatgtataggactagagtatgagtcggactctatcctaggatctctcataaatagaggggcgtgcctgttgtaaccgcatgacgacatagcatagcgagagggagcggctgccggcggtaactggccgtgagtcgttgtaactctgatacgttgtatatgctagatcggggaggagcgctcgtaatcagtgccccggagatgtaggtatcggctgaactccgttatcaaatatcgtgcctcggtgtcgtcatcatgtttggatctcctgtggcgtttctgccgcgtttggtttccgatgtgaattcagagccggtttctaacaagtggtatcagagcctgcgggagatctatggtagaggtacgagggaggtgctccacgccgcgacgactacacggggtgtccagggacgaacatggacgcaaggtggagcacggcggcgatcaacggaatttgatcggtggaatcggacacttcaggcggtggtctgaaccgttcgatggctgcaatcaacagggagatgaccagacgtggtgctcgggttgatggcggcgcaagcgattggcggtccaatcggtgggtcggacacttcgggcgggtggctcgaactttctggtgagctactctcaacagggagacgtgtggccacacgctcggggttgattaaagctggaggcgatcggcgttctcgattgatggaatcgaacactctgggcggggtggcccgggcctttcgatgagttgcgttcgacagggagacggctagacgtagcgctcgggtcgttcggcggctggaaagacggcatgacgatttgtcggcttcggcttgcggctaaattgacggttgtcaattggaggtcggagcggatttgttggcgacgaagtccgagcggcaggaacacggcttggtgtggtcgtcgtgttggtgctggcgggattcgacgcgggccggctcctgtcaacggaggcggcgacggtatgcacaggagctgcacaaaagttggaccaatcaatagaagctgtttggatttgtgccatggatcacacatgcagtcacgcagagaagtcatcaagcatgaagacatcaattaattaattgcatggttgcatgcagggagtagttaattggatggatgtgcttgcaggctcggttcatggtggctgtggatgtgtgtatgcatgcagcagaggggtccatgggcatattgtgcgttggtccaaggcatcgagcagaggttgcatcggaatcggtcgtaggtagatagatgcatgagcagttttttccgcttgtggaggtcgacacgatcacggagttgttttcagctcggagatgtgatggatgtggagatcaatacggaggctaggtggctgggattgtcaccaaagccaagtcggttactcatatggacggtgctgttagggagtagatcgaggccataggatcgacagcgaaagtaatcgtgcatcaaggcttgggcgttacgattcaaaggcaaaaggttgtgtcggtgtaggagtgcagtaaggccacgtgcaaaagaagttccgggcaacggcgggtgaaatatgttgatggagacaacgggtctgtctgacagtacaggatatatccagaatctacggggtttgtataatggggatatatgaaatccgcgtcactaaaggagaagagcgaacgctatggtgataatttcttcgggtgattcaaggcaacggtgattttctcaaattgtccagttcagcctacggatgtggaaaagcgtggatgttgatttgttagctcggttcataagacgacaaggaagaaagggttctcttcgtgtctagtgagtttgatttatctatttggtgatgacgtcggttatctggccat

SEQ ID NO: 28749 - DNA, 137 bp, Oryza sativa
tactacagaatgggttttcgcatacgggtgaacacgatcttcgcatgcggtcggccggcccgcatgcgcgaaatggtctgcaaagatcgccatttgcgcatgcggccggcccagccgcatgcggtcacttaagacgg

SEQ ID NO: 28750 - DNA, 206 bp, Oryza sativa
ttactctcagatgttcttgtgtcaatgccaacatttttattgctattgcagtatacacgctcacaacaaccaccgtctggaacatggaaatccgagacaccttccatctcataagaggtccaaggccatagcttcctccctcaactatattggtggcacaataaaaagtgcacttgaagtaagttgctatacatcaactacttacc

SEQ ID NO: 28751 - DNA, 251 bp, Oryza sativa
aaacatttgtaataaacaatatatggacatcaacatgaaggaaaatcgattttgttttggacaagtcacaccgcttataatcacacaatggcacgagcacaagagaatgagtattagaccttggagatgctgccgtatgaagaccaccagcagcagcagcgagaatggcagtatctgctcgatccacctcgcgacatggtgcacgttataccgctggtaggcgcggtccccacccccgttcccggacgcgc

SEQ ID NO: 28752 - DNA, 1756 bp, Oryza sativa
ccttttggtatcgcccgtgcccgttgtgcggttgtcgaccccagtacccgtgtactggtgtcggtagtcgttcgcttgtgcgtgtggtgaccgtgtaagtgtgccggctcggtagcatcgtggttccaacgtgtgcagcccgtgtggtgtctagtggagtccgtttgtcgaccacttgcctcgggttgacacacgggatccgcttcagtcgacccgtggaccatctctgtgtactcggtctaccgtggtcctttaggttgacatgtggggtctgcatgtcacaggcgcagccttcctgtcttttccaggctagcgcttacacatgttttataattgcaaaacctaatcacaataatccgtaaatctccattgtcacgaccggaaataacccaacgggcgttccttacgtgcgtgcattattccttgtcccaggaggcaaggtataccaaaagttgatacaattcagagttcaacaagcggaagcgtaaatagttaatttataacatgggcagcgaaggcccaacacacacaaagacaatcgaaaacagcggaagactagggcgacgaccacaggcgcttgacggcaggcacaagctagacaccaaaaccttcatcttccagagactcctattctgggtttgggaaaaattgagcaagactgagtacaaccaccgtactcaacaagacacacccacaagtgcataataaatgcaagggagtacaagggagttataatataaagggttcgggttgcagcaaacagcatttaaagatacttagttgctcaaagctattttgtaaacacgattctagaacgatacaatattatttatcaaggccgtgaacccacacgaacctgtcttaacccaaggcctacgatgattcagaccaaaccggcaacccgaccctgggtcccagctcgttccaagccaacccaggccaaccattccacattgtagttgttaagcaggttttaagaattaaaacactaacttgggtacatagctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgccctggagatgtccatcgacccccgacttcgtccatctctatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacacactagttggggtttggttatcctagggtgaacaaaggaataataacaatagca

SEQ ID NO: 28753 - DNA, 650 bp, Oryza sativa
gctttgcttgtgtgcttcgcgtagcttctgtcgttccgaaggttctcgaagcatggtttgcggtcgtcgccaaaggttcgaaaggccgttctctctgagcaaggcaagtcacatcatccttgagcataatgaatcccagtttataaaattattttgatttaaattaatgcattaccgctttatttaaattcccgcgttatcactgttttacttagccatgcctatttacctttgttatgaccttattattattgctattgttattattaccttgttcaccctaggataaacaaaaccccaactagtgggtactctatttatggttccactagtatgaatttaggtagatgcttcgctgattaattaggtaacaataggtggttttataactttagactttaggaattctcatatcacttggatactatggaatggttggcttatggtggaattggacatacccctctcttcctatttcaaaacccctaaaacctgttttctggtggggtttgggtgcatgccagttgtgggaagtagcaccccggacaatataaggattaagctcgggcctctgttgcaaagcactaccgtactaaccacatgtctaatgggtaaggcttaactcggtgctcagtctagtcctgaacaaa

SEQ ID NO: 28754 - DNA, 661 bp, Oryza sativa
cttcttggccacctctgcatacttttggctcctttgaatttcttctggggagttcttcaaggtcagaaagtcgtcccactgattgggggttatgttggcatacgtcgaaaatggtgtgcgtccagtcttcacaaatttcttgttcaaggtggttttccaaccacgccaagacttggccattgtttgcagtgcacaatttcttactgctgcctttgatccatccgggaactggaagattttcttcaactctttccataggacttccttatccccattcgatacataatcccagtacttgaccgtgatggggatcttttcccttactattatgccacactgtgaactgaatttcgcacgtgccgtcttaggggcgagcggctctcctttaggcgaaacatgggtaacaacatggaacccttcatcctttctattcacgcttctctcgcccttccttttcttcgtgattgctaaccgttcgattttctttgtgccggttgagttagctggtacgtcgtcgtctttggacggaacttttttcttcggctgccgttttgatcgccgtggcgccggttcctacgagaaggtatacatggaagtttcgaattagctcgggctaatagttatcacggtgaacattttacatattaagtttacttacccc

SEQ ID NO: 28755 - DNA, 31101 bp, Oryza sativa
  unsure (1)..(31101): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcatgaaaaccactactttctcggcccaatcggcaaccccgaccccactgagttcatcatcggtgagaccaataggattccttttagactgtccaatccagatctaggtcattggaagaacacctttaaatcttggccgtctctagaaaaaacatcacccgagaaaagttggattacatggttcaagcgcatgtcggctagcaaaagagttcactgggatgaaatcggaatcggccaagcacttgacctaaccatagcaaactcagccaaggatgaacctctaatggcagctgcctcttacttctggtccaacaccatcaacgccttcttattcaaccaaggaccgatgaccctaactctcatagacatcattatgatcatgggtctggatgtcacctcaacggctaaccccatgaatctgaacatgaagaaccaatacgacttcaaaaccaagagtatacgaggttggttaggctatgtagcagcatacatgagccagggttctgtcaccctcgagaacatgtggcctttttgctaatgtggctagaaaaattcctcttttatggatcaagctgtggccctacaaccaactggcagttcatagccgaagccttggaagcaaagaaacaatttcctttaggcaaaatcctcctcggctacttgtaccaaatgctgaataatgcttcggctaagttagctgtcggctcagtagttggagcaggtggaccatggtggctgctgcagacttggttgaatctaatagtcatgaaagtcgttaatcggccatccgtcacagaagctgaatttccgagattagagccgattatagaagatgacgaagaacgcactcatcgccgatgtatgtcatatagagtatacgcatccacaccggccgatgctggagcaaagttatcagccgatctgctcaaagattggttctgcagtttctatgaaggctttcaaaaagatgctcgagtttggtttccctatgaagattcagcagacctcgagctcccatcagatttcagattcaaagacattaatcatgaaagattccaaacatccagagaagtcttcatagctgcaatcagtccatgcattcttccagtcggcatccatcaaggaagaaacatccaagcctcttatgaattctatcacccaatgagttcagctagacagcttggaatgggccaactcccaatcggcttattctttgctgacaagatccaatgccgaggagaaatttcatcaaccttgatgatggatcggctgctcagccttccaggaccccctctgggcagcattgaaaacatagagctagcaatgttcaggagcaaaaactttgatagatggtggggtgaatggaagttgcatctattctaccaactagcttcaatgtacatgacaaacctctttccagatgttgtccctcaggtaagtctttgactttacttgatttcatttgaataactgcttagccgatttaccttaactaatctcttctttgatttgtagacaacagaatcctcccctcctcgtcaaagcaacagtggcagggacatcacctacaccccaggcttaattcctaatggaggtgggccatctcctcctgtcatcggctatgatgcccccaagacttcagctcttcttcaagagctcatcagagaaccagccgatgccggcaagaaaaggaaaaccagatcatcagctgtagatacttcagccctggctccaaagaagaagatcaaaaagaaagctaaaccagctgatgatctgcctgccctagatccatccattgaacaagctctggataaagaagaaatcggagaagatgttgatcaagccgcagccgaagtaagcgatactgaaagaacaccatcggcttcacctaagcagacccctccaactccttctgctccaactccttttacaagagtaagcaaccttctctaaccacttttgtaatcatcttactttatagccgattgctcacatacctggtaattgcagaaaaggaaggctgctgtgaagaagaaatcggctccaatggcatctaaaccagctccaccggtacaatagccttaattctttcattagttaatctcagccgattttatataacacttgtctattttcagcctccttcctctccttctcctcctattcaacaatcatcaagcgatcggaccccatcggctgtagggagtcattacatagaagaagaagttcaactaactgctccgactatcccagtaaatttcttataaccaacatatgcagatcggttatgcctatttgatctctaactctctttaaatcatcactgcaggtcttagccgatcttttctcttttgatatcagagattatcttgatgaagagacagaggttgacactactagcaaagctctagctcctttctctgatgacgtaaagaaaactcttgaagacatctctcatcagctagagacatcgtcactagacagcctagtagtcgactgtggatcaattaggactcatcttcatgaggtccaaactcaaatcctagatgagttagccgatatccttactccagctgtttatcttgaacaacatcaatttaagctggaaaaggccaagctgagattagccgaacatcgagagcgcaaagacattgaagcaacaatccaggctaatcggcaacttgttcatgaagaaaaagccaaactcgatcaattatctgaagtcccgatcaaatccaatattgaccggcttgaagctcgcaagattgaactcttagcataacttcaagaatgcaatgccaaactggatttagagcacaagaagttagccgatctcccacaatctatcgaagaacaaagagcaaagttaaaatcggctatcaagaatgttgctgatatgaccaaatctctgaaggtcattcctggaaccgatgctcaagatgcccaagccatagaagaagtacaacaaattaggcagagagctatatcggctatccagcaatacttatctcaattttgccgattaatatgacatataagctttgctcaaaaatttttgcaaaaaatttttttgcactgtattgtcttctgtattgtgatagacatatatgcccccccagttttacaatgtcaagaacattgataaaaatatgaaacaactaagggcaatataacaatatcggccattgtacatcggcaactctcaaccgattacaacaaaacaactaagggcgatataacaatatcggccatctcaaggcgatgcaaacgcaccggctatcatgtatcagcaatattagccgatcatgcatcaacccaaacacttgggtaatatttcttcaaatacttgccattaagcgctcgcccaaaaacttctccatcgagtccttgcaacaggtatgctcctttagacacaaccttatggatttggaacggcccttcccaatttggtgaccacttgctgaatttgcaatcccgagttccaatcggcaaaaccaatttccacacaagctcaccgtccgaaaaagtcttaggtaccactttcttattataatgccgagcaacacgttccttatccctagtaactcttgcaagtgctcataattgcgactgaaccaagtcctccggttcatcggccataagattatagtactcttcggctgtcaaatcattttgcaactctgttcttcttgagccgatttgaacttcccatggtaaaacagtttcatgtccataaacaagcttataaggaggaacttggattgatccatgacaagccatccgataagaccacaatgcttcggctaaacgggtatgccactgctgaggataatcagaaattttccttttaatcaacctgatcaaacttttgttagatgcctcggcttgcccattagcttgtgcataatacggtgaaaaattcaataatttgatacccatactatcggcaaactgaacaaactcataagacacaaagattgaaccttgatcagttgtaatagtctgaggaataccaaatcggtagattatatgttcttggacaaactgtattgcatctccagaatcagccttcttcaaaggaatcgcctctacccatttggtgaaataatcagttgccactaatataaacatatgccctttactcgatggtggattaatcatgccgattatatcaatgccccatcctctgaatggccatggtttaatgataggattcatagccgacgctggcactctctgaattgcaccaaatttctgacaatcttgacagcccctataatatctgaaacaatcttctaacatcgttggccaaaaataccccgtacgccaaagtaaccacttcatcttatgagccgattgatgagtaccacaaattccctcatgaacttcgccgattgcaactttagcttgatcagcgctcaaacacttaagcaatactccatcaatcgttcgataataaagctcatcattcaataaaacatatttcaacgccttatatcttaacttcctagaagccgactgagatggatttcgtaaatattgatgcacatcatatctctaatcatcggccgttatggcagcaacttcaatctgaacatctttgatcatcggcttatatcctgatgccccttgagctagatcattggcctcaatattctgctctcgagatacatgcttcaaagtcactagccgaaacttcttcatcagttcttggcacttctcattataaactatcaacgtatcattcttgcactcatattctcctgccaactgactgataaccaacaaagaatctcccatgatttcaatagcatcggcttcgacctccttgagcaattgcaaccctttaagaactgcttcatactcagcttgattcgtcgcataaggtttaatactataagcaaactcaaagcatgccccccgaggcgaaattataactaagccgataccacaaccatgagcacaaaccgatccatcaaaaaataaagtctagggcacaatctcaactgagccgatcgaatcatcatgatagtcaactatgaaatcggctatagcttgccctttgactgccttcggcgactcataccgaagattgaattcagttaaagaaaatatccattttccaacccttcctttcaaaattggagccgacaacatgtacttaacaacatcggtcttacatatgatagtgcattcattggacaacaggtaatgccttaaccttgtacatgaaaaatataggcacaaacataaattttccacagaagaatacctagtctctgcatccaagagcctacgacttaaataaacacannctctttctttccctcaaagctcttgaatcaaaaccgagcgattgactttctcaccggcgacaaaatataaccgaaaaggtactcctttctgtggagaaatcaaaactggaggagaactcaaatattccttaatattatccaaagctttttgctgctctgccccccaagtaaactgctgatcggcctttaattgtaataatcgcgtaaaaggctttaatcttccagataaatagaaataaaccttctaacgaaattaatcttgccgatcatctcttgcaattctgttttatcctccggaggcttaatcttcttgatcgcactgatacttctttgggtaatctcaattcccctctcatgaacaagaaatcccaagaactgaccagccgacacaccaaaagcacattttgtcggattcatcttcaagccatacttcctggttctctcaaaaaccttcctcaaatcggctatgtggtcctctatctctttagacttaacaaccacatcatcaatgtagacctcaaccaaccagccgattaaatcatggtatatataattcatagctctttgatacattgctccagcacttttcaagccgaaagtcattacaacccactcaaacaatccgattgcaccgggacacctaaaagctgtcttatgaatgtcttcttcagtcataaaaatttgattgtatccagcatttccatccataaaactcaaaatcttatgccctgatgcagcatcaaccagttgatcgactactggcattggatattcgtcctttggggtagctttattcaaatctctaaaatcaatgcataccctaaccttgccgtttttcttggtaacaggaactatactagaaatccactaagcatatcggcaaggacgaataaaaccagcatcatataagcgttgaatctcagccttaacaggttcaagcatatcggctttgcatcttctcggcggttgctgatgtggtctaaccccgggtttgataggtagccgatgttcaacaatcgatcggctgagtcctggcatttcataatattcccaagcaaagcaatctctaaattcttttaagagctctatcaacttagttctgaattctacacataaatttttactaataaatgtcggtcttggccgatcgcctggacctatatcaatttcctccagatcatcggccgacataaaaccttgaccttgtttgtcatcaagatcatctactgtatccttggtgtagacgttcgaaccctctacgacgccctcaaaataatagcttgggttctccatcttcaattggctgtatatcagaatcatatacttttaaaaaatctccatcccagacctttccagataaaaaatcaaggccatccatctcccaaagagctaaattagcactagcaacattgactgacttgtcagccggcacgatctctaccttgtcgccttgccattgaatcaagcattggtgcatggttgaaggaatacaacaattagcatgaatccaatcccttccaagcaacaagctataagaacccttcccatcgatgacaaagaatgttatagggattgttttactgccgactgtcagctccacgttcaaaacccctttggtttctgatggattccaccaaagtctttaagcaccatgttcgttttaatgaggtcttcagcgttcctacccaatttcctgaacgtagcataaggcatcaagtttactgcagccccaccatcgataatcatcttagacatcggcttcccattgacataaccgtttatatacaatggtttaagatgccgaatctctgtcccctcaggctttttgaacattgctcgctccggtgacaaaaccaacttagccgattcctcttctacctcgtctacatcggcctgatcaatcccgaattcggtggcaatgtaaagaccatgttaattggtgccgttacaatactcttccctttgccaacctttttgcctcttcggctacaacatcatcggctataggaacctgattcttaacacgtcattcctgtcttggctttgctttctttagccgatagttaatttcctgttcaacctcttgaagacgctccctgttcctcaacctttgaacccttctcttctgattcttcgtgaaaataccagaaggacaccattgatttgtcctaactatctcatcctcctgaccatgaccttgattcactgggcccaatctttgatgaacagacactctttcctgcctcagccgattactcctattatatgaccggcttgagctcccaatgatatcactacacccagggcagttttcaatggacggtaacctcatcccttcattccagcagaatctaaagaactcacaaccccaatgaggatcaaaaccatcatcgtgttcttcataatgcttctcctgctgcttgtcatacttcctctgatatttgttgattatcttagccgaactcacttgaaaaccctttgcacagaccctatcggctgattggccagctgtatgtaccatattaatagaaaaaggattaccatcgaccttcattggtttcttcgaatcatcaaacttgatttttcctccctcaatagccgtttggatttgctgcctgaagaccttgcagtcattagtcgtatgagacccagaattatgccacttacaatacttcttcttgcccaactcttcagccgatggaactttcctcttttcctgaggtctttacccattggcatggtataacctttttgctcctgacccactcggctgccgctatttcggaatcatcatcctcatcatccgatcttctgtgtaagatgtgacaagctttcgaaatcttcagatgagaatttttccctgatcggagcaatcatcccttgaaacgccaaatcggctaactgggcatcagtcaaattcaagctgtaacatttattcctcatttccctgaacctttgaatatactcatgcaccggctcatcatgcttttgcttgattgacgtgagatcagacagcttcatcacgtgaatcccactatagaaataactatgaaactgcttctctaaatcggcgcaactgttaatcaacccatgtggcagagaagaaaaccaagtaaaagccgacccagctaatgacaaccggagtaacctaaccctcaaagcatctactgtcgatgcctcaccacactgagctaagaatcggctgatgtgttcataagtcgatgtagtatcctgtcctaagaactttgagaagtctagtactttaaaccggttaggtaaaggaactctttcaaaccattcaggataaggttgtcggtacaaattcccagtctcatttggtttaagcccaaattgctccctcattacatcagctatcacatcggcccatggtcgctgctgaggtgatccttgaggttgttgtggtgtaggctcaaactggttgtagaactaaggctgaaccgatcctgcctgttggtactgaacttggggtgatggaggctgatattgataactcaaattgccccctggtaattatgaaggttcggccgaataccacgcgccaaatgctcaggaataacttgaggcaccaccgaaccatccggttgcacatgatgaaccaagtgttccgggaccacctgatttgcagggtactgcacaggctgaccaccaggcattgcaaacctagccgacgcattcattggggcttgttgctgaatcggctgaacgacctgctgtctcaacggtgtctactgaattggctgtaaagccggttgccttggtggcgtctgctgaactggttgcacggcctgctgaattggggatgcttgttgaataggctacacaacctgttgcctggacggtttttgttgaatcggctgctgctgagccgaattaatagcattttgaggaggtagaaacatagatgcaacctggtcttgtgttaactgagtcacattcggtccaggatgctgtgattgctctcttaccaataattggggattgattaattgacctggagccgatgacggtgctgcaggtgctggagccgatgctggtaccgtcgattgagctggaggagttccccgggtaagtggatgaacatcggtaatcaaagtccgataatttggaaaagtacccccttgcaaatagactgggcctgcagcctgatgttcagctattgaaccatcggctaccgatttcatcatatttgacaaagtattagttaatactccagattgattgatcaaagcaatatacacagcatagtcgacccgatcttgaaagttattgaaaaaatcttggaatgcattgtcattctgattaagattccccccttgcaatccctgagtgccgtcaccttgaactccatgtactccatgagagtagtcaccctggctctcctgagtcgacccatctgtaacacttttgtcactcggctgggctgatccatctggaacttgtttcttttctccctctttagacgaaccgatcccaagatcctcaggaaccaccttcaccttgtacttctgaacaaatgtgtcgttgcgagtttgcatgaacgagcttaaaaattgatcccgtgcttgctgcatcattgcattgaagtctttcttctgttcgggagtgagcttctctggatcaatgggcacaacgtttccttcatggacgtcagtcaaaccgaacttctgagtcttttccttaactttacccgggctgcccgacgacggagacagtggtggtttctcagccatgaaggaggctgccttctgacttctaatcggtcccaccaggcgtgccaaaagcatgttgatagaaaacatgaggcctgggagatctgcttaactccagtgcaggtccaaaactcgcctttggatgtatgagcgtgccagttgatttgatcctgcaaacaacaagaaacaaagacagagaaaccatgattaaattcataaatgatagccgatcggctagatgacgatgacatatcatttatctttgagccgatgtcatgtgtaaatcgatcggcaattgttaagtaaacaaatcagaactaaatctactcaatcggctgtagatatcaatgatatataatccttatatcgatatatacttgaatcaagtgattgggatagatcggtcaccttgccgagacagtataaatcacctagatcgaaatatatattaataatgagattatatatatatattcatagcatagccgatcagatagatgtagcgtgtatcggctaatactgcgatactactttatattaagatattaaagcaaatagaatatactaaacaaaaatctaatatacttaaatgcaacaagatcttaacaagatggaagcgctaatctcgagaacacaagccgccataacaagttttacctcttgttgaagatcgaagccgatgcagctcaacctgaaagcaataactcgtcgagataaaatgaaagcaaaaagggtggcgatgcgccgaaattgtattgaacgtgtgtatgtttttattacatagggctcggggtctatttatacccgagaaatacaagatatgtccatattggacacgactcttatctctaacaaactctaagataccataagtctttgcggcagacttttgcccacattttatctctaaggaatttagataaaatatcctaattaatggatacaattgccttctcaggactctatccatgcgtggcaatcatcttgaagcacatcaactcgaacccaatgtcacacacgggtcgtattgtcggaatcggctgtatcacttaaccagtccaactcagacttagccgatcccagtcgtagccgatccaaactccagccgattcttactctgtttccgaaaatacccttatcttctattccgctttgatttcatcttcatctccgatgctgatattaccaaatttggttgttaacaccttgccactcaccgtcgcagacgacgcagctgcacccgagatggatctggtcgtcccgaggatggcaccgccggatctaccgcccttgtcgtgcgcccaccgcgacacccaagggacacctcctcgtcggcggcgccacctgtcatcagaggagaggagatgagagagagaggagaggagagaaacagagaaaggagagaaaaatatagagggagagaaagaaggttgaaaaaaattaaagtggtgagggaaagagagaggaggggataaaaaatgaggagttatttttgcatgcaaatcacataagaggagctatccattatctcttaactttacgattcaataacatgcatgtctagattaatctaggataaaagtactgcgaatttggataccatgtctaaatatgtagtcttagaacatatggtgtgtcagggttacggataaggtataccctctacccttagatatacgtcatgtatcgatatggtatatctgcgtgtatacggacgttctctgtacacgctaaggaaattcatcacggagtccatagatgggaggattcctactcggatagaactgggtcatcactgtattatgtagggtccgatgtctccaagtcctacttggaggccaactgacctgcggtataaaagggaccccccgggaggacccaaggcatcgaatcgtaccgccaacacatcgaccacagcctacatgagccaaatcgcctggtgatctagtcgaaccaactcgactatgatctcgtcggtatcatcgagttccactattccctttgtaatatgtgatttatgtcatataatctcatatcaactagattagggctattacctaccaaggggcctgaaccagtataatccctgtttttgttgcttgatatcgtattacgtagatcctcgtaccagcgtaccccaataccctctatatccggtctacgggtatcccccgttgacagtggcgcgccaggtaggggcctttggtgctcaaggttctactactatgtcatcaagcttcgtcgacaacagcgtcaaccctggcttcaaccaaggagtttctacttcaacaatgctggtgtggactcaagtcggtgaaatcgtcttcccggtttacacctcggtgccgatctcgactggtccatcaatggccggaagtgagaacgccgtggttacaaccctggacgactccatgtcgaaggatcctcccgctgaagtagagaacggaacgtcgacaacatccaagcccgagaaggatcctagtgcggccaaaatcttgtccttccgacaagaatcacgagccgacaaggacaacttccgaggtgacagggtcctagtgtcctatccacaaaaccaggaaacacaccttgcaagcttgctgggtttttctcaacgtacaagctgagattcgtgcctgcaaagagcgtgggattcagcgtacttcttcaacccgtgatgtctattgtcctattcacaagacaaagaatcacgacctctcaagctgcaaggtccttctcagcgccatgaagacgtcgcctcctaaggtccagcagttacaaatctctcttagggatgaggacaaggaataaggagcgacgcttgtctcagatcgattcgttggggtaatcgacattgatccccatgagccgtcagtcctacacttgctcgaagaatagggctcatcgtcaacgagtacaccacgcgatgtatttgctatcgatgggaccagcacgtcagcgcgtgctaatgtagaagcggagaatcaagtggttacgccggcccagcatatcagggccatcaacacaatactgagggaaaccccttatgatcccgttctgaacgatgatcttgcacagtggacagaatgactacacgaatcagtggccaacctcagcaacgcgttcgaggaggccgctgccagagcacagctagaacaaccgacagctggcggcgccgatggcgaaccacctgagcagcggacatcacctcaatgagccactcctccacctcgtggtaccggcaatctaaatgaccatctgaatggtcgccgagaagcacgacgcgtgcaagacaacgagaaccgttcccgacatcgcatctcttcacgatgtcacgagaacgaagagcgaggagacgctcgggcgaataccgagaccgtgataactgccacgatcacgatgatcacgaacagcagatgccgggcgatactggttgaggacgtcgccataacgatgacgacggtggagatcggtgccgggacaataacggggggcgacgacaggattctcgagatcccgaacttcatcctcgtaatcgtacaccggaaccaagtgactcatcatcatcgtcatcatcctcttcatcctcatcgtcagatagacatccacgaaggacatacgatcgctgacaacccaccgcccccagcgtcgggtgtagagctttcagtcgttcgctgcgtgatgtccgatggcctgagagattctaaccgggagcagaagtacgatgggagtaccgacccagaagaattccttcaggtctactccatggtactctacgctgccggagcagacgacaacgtgttggcgaattatttgccgactgcattgaaaggttctgcgcgttcatggctgatacacctctcgccctactcgatttcttcatgggcagatctgtggtagcagttcgttgctaacttcctagtaacttacaagcgccacgcgatcgaagacgacctacacgcgttgacacagaacccgggcgaatccttgagggactatgttcggtgctttaatgagtgcagaaatacaatccctgaaatcaccgacgcttctgtgatccgcgctttcaagtccggtgtcagagatcgctatactacccaggagttggcaacaaggcgcatcacaactactcgaagaatatttgagattgtcgatcgatgcgctcacgtggacgacgcactaagacgcaagaacgacaagccgaaggcagggggagagaagaaaccagccaaggaagcacctgaatcaagcaagaagaaaagtcacaagagtgggaaaaggaaagcccaagcggaagtcctcgcgtcagaatacgcgacaacgaggcatggacaatggcgttcgacggcacactcaacagccaaggagcaggggcaggattcatcttgacatcaccttcgggagatcagggcaaccaacaacttcagggcaaccaaccaacaccttcaggagatcaggggcacgcaattcaccttaacttcagggcaaccaacaacactgccgaatacgaaggactactcgctgggataagagcagcagccgcacctggagtcaagcgtttgatcgtaaaaggggattccaaactagttgcaaaccaggtgcacaaagactacaagtgttctaaccccgagttgtccaagtatctcgcagaagtcaggaagttggaaaaatgatttgatgggatcgaggtccgacacatataccgcaaggacaacatcgaaccagatgatctagcacggcgtgcgtccagatgggagccactcgaacccggcacctttctagacgtcctgacaaagccatcagtgaaacaggcaaacgacgaagatagcccagtcatccccgacgtcagctcgggggctatagaggcagagcgcgccgtcgccgacatcgagaccacggacgactagcggaccccactcattaaattcataagcagcgacgagttgcccgaggacgatgcagaagccgagaaaataacccgtcaagcaaaaatctactgtatgatcggcgacgatctatataagaaggcgccaagcggggtacttctcaaatgtgtctcgtccgacgacggcaaacatctcctccttgacatacatgaagggatctgcgggtcacacgccgccagtcgcacattggtcggaaaagctttttgacaagggtttttttgggcgaccgcccttaaagatgtttgcgaaatggttcagcggtgtgaagcctgtcaatttcacagtaaacacacaaagctaccagcacaagcgcagaccatccctcttacttggccgttctcgtgctgggggctcgacatactcggaccattcccatgaggacagggcggctacaggttcctattcgtggcaatcgacaaattcactaagtggattgaagcgacacccacgggggaaatcaaggccgacaacgtcatcaaattcatcaaagggatattctacagatatggattgcctcaccgcatcataacggacaacggctcccagttcatcagtatcgacttccaggattactgcatcaggctgggagtcaagatctgcttcgcctcggtttcttcccctcagagcaatagactggtcgagagggcaaacggcatatcactacaaggaatcaagacccgtgtctacgacaggctcatgtcacacggcaagaagtgggttgaagaactcccctcggtactatactatgggccgtacgtactacactgacaacgtccaacaaggagacacatttcttcctcgtgtacggctcagaggccatgctccccaccgagctacgacatcagagtacacgactacagaagtactccgatgaggatcaggaggagcagcgaaacgatgatgtcaatctactcgaagaacatcgagaacgagttgccgtcagagcagctagctaccaacaggcccttcaccgataccccgagaagcgcatcagagcacgcacgctttcaatcggtgactacgtcctccgacgggttcaaagccaagcagggcgaaacaaactctcacccaaatgggaaggaccgtacacgatcacgcaagtcttgcggccaggtgcattcaagattgtagacagcgatggtcgcgagttggtaaattcttggaacattgatcaattacgtaaattctatgtataaatcaatagtattcatacttgtaagacatcttacagcttctataaagtttattttcaggtaaagattacaatcaaagtgttccttcctgacgatcccttaccacgatgacacctagcgttgaaacctatcctactgtccctttacgccgtcttgacaaggcctccgaggaacctaagggaacttcggctggggacgcccagagccgataaagccttgtcggatcctgtagagacaaaagaccatgtaagatctggtcgtgtaagagttctcaccgtgcgtattaaccaagccgtgtaatcggaaattaggttttccaacttcacggctgggggctaggatcagtgcttgttcaaccaaggcaggtcaaaggtccaagagccttatcttctaggggctagggagagtgtatgactcaagtgagaagacactcgtacacaccgcatccagagtaaggaaacttagtaagatatatttcttttcaatttcacaagtacttcttacagttcgtaaaaattccaaaatatattacatgcctccctgagatatttgtcacaggatataaagactaccaggaaggccagcaccagtccatggactgaaagactttctccgcaagcggcgccatcgactttgccaggttatctatctctgcgagagtcctccgagaacgtgaaaaccctccgtggaggaactcgagatgcagctgcggacggcgatctcgcatacaagccagcacatgccctcaagcatatcggctcgatcgacggcactcctgcttcagggcctcgtcgatacgcttgccgatgccttcgagctgagcgcaggccctattcaaccacgagatatatccggctgccgactcctcgggatccccgcgaggtactcggagttccctgtagactccggccatggccgtgcaacagctcctgaggtacgagttgaaccacacttcgcgacctcggagtgcttccacggaccggtccttcttcacttccaccatagtcctctcgagttcggccacctcgaacttcgtcctccagtattggatgcgacgatctcggtcggccagtgcactctcgaggtctgctcagcatggaaacgactaagtcaagctgttcttctctctcgagaacacagcaaattaagtcaatcccgacagaagagcaaaggagatgaaaacaaaaaaaaaaaaccaacctaaggaagtcgtcgccatgcccgctttcatgggcaagttctaatctatgtcgacctgcagcacatatggctcgagcgcaagtgccggaacgattacaaacaactcaggctgtctgcgctgctggacatcctcgacatcgacatctctacaacgacaataaagtactcgggatcaaaatgctaaagaaaacgaaggtgatgactgcacacacaaaggcagttggaaccaacaagagttttacaagcacgactaattaaggagtacaggggaactgaaatcctactcttcaaaaaggggaagaacagactcccccagatcaccgacttcttccatcacgcccttacgcgcgtcattagcagccccctgatccaagataatctagaggtcaagttcagggtgcgccaaccttacgcattcgaggacgtggcacgccccggtgtagatcccgttggacgtctcctccccgatcctggccacatgcttggaggggatctcctccatcgccgtcaccagttccgcgagcgaagtcgtcagcgaaaactcatcgggattcaccgggatggtggtcgtaacaccgcactccccgacgagctggtgcaggccggtgtaggtaatccgcagggagccacggatctccgacaagttgttctcgagctccgacatgcagtgctcgagcccctgccgctgccgctcgttgccgaccaccagctctctcatcttctggaggtcctcacggacctccgccaggtcacgcgccagcttgtcggcgcgttcgttcaccgacgacgccgctgccgccttcgcctcctcaatctcgcgccctatgccgcgagcaccggcctggaggatgcgctccatctcgatttggagctccccccagatgaggatgtcagcgggcgggcctcgagcgggcacaaggccgcctgcagggccgctgggcgtcacctcacgactcttgggcacgaccatgacctttgtcgaagccgctgcaggagacgcactggagttctctccagacccgtcttgcgccgccttcgcccgtgccgccctgtgaaggattgccgtaattgccatcaagacgggctgccagagttcgatgaattaaaaaacctcaaatttgtctacttacttctcgccaagtgtcaccagcctctaccgtcgctgaggcgggggagacgcatccgaggcctgagtaaaacgagtacggtgtgaggacaatatcttccgactacacaataaatgaccaaaggtgcttaccgatggggtgggcgccttccgacggttcttcggaatgttgccgccactggtcatggcagcggcagcagcagtagcaacatcgaatgcctcctgggcgacgccctccttcaacgaagctgccgcctagtggtccacgagcagcccgaagatgtcagtcagagggagagcctacactacatgaagtcacaatgcgatcctagaagaaaaagataaaagggtcgtcaaatacactcacgttgattgcagtttcacgctcggctgtccctttctcgcaaagggggacatggacgttgctcgccgttgtggggccgctgatcatcacttgaccgacgcggctctccacggtttcgctgttcaaacctgtagatcgagaaccagaattcgataagtcaagaggaacatgcacataaggaatggaatccgaaatacaagaaaaataccccgaggagaaacccgggtcgcgtcctccggcctagaataatcaaaggctggatgggctcgagcctggagcggctggatccgcctaccaatgaagtcggcagtgacttcataccccgacaaccctcacactcggaggtcatcgatgatatcgatgaaggactgaagggagggggttaaggcgggtttgacggtccaagacgaaatcttgtctggttgttcctcagggacaacaaagactggatccgaattctctatctgaaaatagaaccacctcgcccgccatttgctatgagaaaaggggcactaaaaggggatgtatcgcgacttcaggccatcccgaagtcggaaaccgacacatccggacacctttttaggttccatccagcgcaactcgtagtagaaacgaaagagatcaagaaacggctctaccccaatgtaggcctcacaaagatgggaaaaaatactgaggaaggcgatggaattggggttcaaatggagcaaagaaagaccgtagaaattcaagacgagaagaagaaactcggaaggcggaggaagaaaaccacaaagaatatagtcctaaaccgcaaccatgcggcccaagacaggttcgggttcaaccatactaggacaggtatatacctcctagttctctctccatggtcccgcgaccggggagagcgtcgtcctcctgcagcttcttcagggacgcgccggtggaagtggacttgtcgagatccatagccgccggagatcgctgaagaagggactgagatgagcaagctagggtttttgcgggagcggagaagacgaggagcgcttggaggctggaaagtttttcacaacaggcggacttcaaaatggatcctcaaaactcccttaaatagacgcactaccgacagtatgaattccaaggaaaggagagagatggccgccggaaatttctagccccgttacgcgtggcagttttcggacttcaatttaaattcacttatgaccgttgaacttcgcacggggttgtcgattactccatgtctctacggttctcacaccgagatcgaccagtagagaacgacaataaccccgacatcagaagtcgcgatcggtcacatgagttcatttaagcagaagtcgggggctactgtcagggttacggataaggtataccctctacccttggatatacgtcatgtatcgatatggtatatctgcgtgtatacggacgttctctgtacacgctaaggaaattcatcacggagtccacagatgggaggattcctactcagatagaactgggtcatcactgtatcgtgtagggtccgatgtctccaagtcctacttggagaccaactgacctgcggtataaaagggatcccccgggaggacctaaggcatcgaatcctaccgccaacacatcgaccacagcctatgaaaccggagcctacaggagccaaatcgctgggtgatctagtcgaaccaactcgactacgatctcgtcggtatcatcaagttccactattccctttgtaatatgtgatttctgtcatataattccatatcaactggattagggctattaactactaaggggcctgaaccagtataatccctgtttttgttgcttgatgtcgtattacgtagattctcgtactagcgtaccttaataccctctatatccggtctacgggtatcccccgtcgacatggtgtatattatggaggcacctacaaatccctattttcttttgcaaaaatcgggcactgtttcaccaagtagatcggaattgtttcactaagtagatcgaaaatttttaatattttaaaaaaactgaaacacaaccaaatcaccttgtgaaacattttgctacaacgtacgaaacaatggttttcaaaaaaaatcgggcgttgtttcaccctatataaaaataatatttcagcaaatagtgaaagaatgtttccattcactgcaacatttgatctatacatagtgaaatattacgagtatacttgctgaaacattactagatgaacaaaaaataaaacggatttccttaatacaacgtttccgtaatatgcggatgatttgttgtaacggcgtgtgtggtggggtgcgcgtgtgtgtgtgggagggggggggacagcgcagaggcgcgggcggcggcgggcgcccgatcgctgccgttttcagtatattatctcatattaggttaaatatatagtattatctaatttctacatgccatctaagatctgagagacagacttaattaaaattagaataatgcattaacaatgttagtgtatgtaccgagttgcgtccacttgtacgtgccaacccatcgtgtcttgcactttggaatgcaggaatttcacaggaaatagttcggttcgtccaaattaaatttccctgaaattaatttctccaatccgaatatatagggcctaattatatatgctgaacgagatgaaccggccggtaatggcgctggtcagcagtaacagattggtaagatctgttggaatgcgcagcccatcaatctctgcgatttttttttccttctccagcttctcacgtggccgatcgacgatgacgtacgcgtatacgcctgcatacaatgcatgacgagattttcaccagaaggagagcctagcttagctagcagctagatagctagattatcgatctactggagtagctaggacggcgacggccggccaccatgtgcgtacgtgcgttgtgtctcccgcggacagaccggtaaaaacgacggtagagtgagtgatgagtgatcgttgaggttgacgagccgagtggggtcgtaagtacattttacccactccaatcatttatttaagagtaaattttactttggaccatatttattgaccaaaattttacattgggttagggctagactcatgttttcgcttaacaccacgtataattaccgttctttgaactttggacctgattttatagttaccatcacacgagttgttatctaggtgcttagcattttacaagaaacaatgatatggaaatttttgccatgcaaatatgcttagcacaagaacaatgatgtaacatgttacaggatatcctatcagattaatgggacttcattactactacatatgaacattcacaacccttatactatagacaaaattggagaaatattgagtttaagaactatttttttagaaaagatattacatgttttacaaacccaactgtagtgttagtacaaattgttgaattctaagttttctaacacaaaaaagaaatgagatcagctctacgatcattatactatgtgtaatttgtgaaacccggtccaaagtgcaaatgatggtaactatatatggtgttaagtgaaaatataagtctaattctagtccaatgtgaaaatttggtaaataaaggttgaccaaagtgaaatttactctttatttaaagagagaatatcttatataccactagtctaatcccttttatgccattaaaaattagcttttcccctatataccattgttcaaaatttgcacatcctctcatgccactcccgtatgttgaccgttaactctaagtaaaaaagatacatttgcccttctgaatataggatatgtctaacaactcagaagggcaaatacgtttttcttacttgagagttaacggtcaacacacggaaatggcatgagaaggtgcgtaaattttcagtgacatataggagaagagctaatttttagtggcatccctaatcccaatatatcataaatcttttactcctaaactgtaggaaacagtacaacttagatcccatggcagtatatacccccattttctcctattttcgctaactaggaaggtagcccgcgcatacgcgcgggcatgcaccgtacgtaggataaatttgagaaacttataaaggcggtataccagcgaattaatatctgcaatgttttaaaattatgtttttttcccatgaattttcttcgttagaattgcatgacgaatttaattgttatttataaaattatctattggagattaggattggtatcttacggtataaaaaatggtacctaagacatatgactcttgaggttccacagggaaagagagaaaacttaagttataaaagacattacatatacaaccatatataattaatggctctacccattttttagaaaaaaatgataattaatttattatttgacggcaaacattgattggtcatagctatggataattcctcataggaaattgtgattccatagtgaaagagaaaaaacttaagttataaaagacattacatacacaaaccatatataattaatggctctactgatttatatagaaaaattggtaattaatttattaaacataatatatgaccctcgagtttagaccattatttgtaaccattggatatgtagaagatctaacatattgtgtagagtccaactaagcaaattattcgtcttccctcaccatggatggtagacatgttaattcgtgtctccggcagcatgctcacatcatcatacttagaagaaaaaaaagtgcccttcatgtatatacatgtaactacctcatgcccctcttttcattaaagaaaaaaagttctatacccatgcatgcacaccgggatgcaccggttagccctccaatttgttcactccatggacggtatgttcctttgttctagtgattagataatttaataagtacaaataagtatttgaaatcaatttttattagtaaaatatccataaggactgatctgtagacaccctctgttcttcttcttttcttggtgtattagttggatttaagcaacgtgatataggtattttgggatataagttaatgtccaacttccaaaggattaaggtttcccaaccctcagcaccgaacacagcataagatcgtacatttatccttaaaagaagatcatatattttatcagggcattggaattaagtaaatagcatccacatatatgtcgagagatataattaagttggttgtgagtcaataggtccattgatgctataattaaggttaaggttagcggtttataagttattttgattttattaaaaaactaagttggatattttgatttgtaatgagaacatttaggattttttgcgtatggatgtgggtccaaaatataataattttattagcaattaaatatggttggtatagatattaaactattgatttaattaaaaaaacacaatggaattaaatatggttggtatagatattaaactattgatttaattaaaaaaacacaatggttcaaacagatcataaattgaatatataatttaaaatttacagctattgaagattctttatttatttataaaacataccaagatcaatatgtatgagatatattatttatacctatatttgcaagtgtatgcaatctttgaaagtatgataaaattaacttactaatatagaagatattatatacccttaagccttaacttaattaccatcgaaaaaagggaggcgagcaaggaaaaaatcacacagactcttatcatgcgtatggatggaagcatgtatatgtgttgggcggactcgtaccgccagattgatattaagttttttactaaagataaatctaatggtatctgatggtaaaaaaaatattaggtccatcagattaaataaaaccaatggttagatgttctcctttttccatagattttctacgaattaattagagcgttaggtgtcatctttgcactgtttcttggaatctcacgtggcagtttaggagctttttaggatgtttaatggacttttatataatagatagatatatctacgtgggtttgtgaaatttactccataatatatatttccatttttaatattttgtttttatttggttgcattgcaaagaaaaatagtatatattcaaagttaggaaagcgtttttcttatataaagatttgataggttcaccggtttaaaccatctatatacctaaatctaatggttttaatgtttgtttatatttggttttcatgcaaagcacaacgttctatggtaaaatttagggaagtgtttcttttatatatagattaatgggttcaccggtttaaataatcgttaaaatatttttttagggacaatggttaaaatagttggttcaccgaaaggttagatgttttattataatattttttcatgttaaaattttcatctagaaataggaagagaaggattggaagaggggagaaagcatggcattgtattacgtacatacatacttactgaggagagaaggggtgggttgtgggatatttttttttataaagataaatataatagttgaaaatagtgagtctagcaatttattaaacaaatagcggatccaccgatttattagaacgccacgtagcggtttagaaacgttttgtaggatgccacatggtaatttaggagcgttcgtaggaagtttaatgaacttttagtatataatagaagatttttctttctaactaataaagcgtaaaaaatatgagaaggaagagttaatctaggaagagggtggtgtaataataataataatacatgaggtatattattattattttcatatatagtaggtagttgtatatgagatataagtacgtacgctgggtggggttaggtttgggtggttaactttttctataagataaatttaatggttgtaaataatgggtccatcaaatataatgaaatcaacggttatatattggagtggcatgtggcggcttaagagcgtttctaggatgccacgtggcgacttaggagtgttcatagaaagttttatggacttttagttaatatacagatctaataacgacgtaaaataatgtgtccatcgattctagtgaaaaccaatggttggacgtttctctaatttaagagtggcacacaacggttagaaacatttatatgatatttaatggattttaacgcgtttgatgtctatttgtgggggtattcttttctataaagataggttcaattttaattaggattggaaaaagaaaagaaaggaacaaacgaaaaaaaaaagtactaaacagaggtggtggggccggtgggaggtttttggtttttaaaatagatctaacgatgtaaaataatgggtccaccgatttaaatgaaaattgatggtcagatttctctattatattagagtgccacgtggcaatatgagagcgttttgagggagccacatggcagcttgagagcgtttatagggagtttaatggacttttagtatataatagatagatagatagatagataatagatagatgaggcatatgtacgggtccacttatcagcatgatgagtcaccaatgccattctggatgaacaacgcgtggacagcccagcgatcgaacggctccaggagcaacgtaacgagaatgcgagctcggctccaagcgcagaaacggggcttcccgtaggcttaatttgaatcgcgtcggcttgcatcttcctcctctccggtgtatgcacagatacgcgatactggtatgacgatacagggatacggaaatttgcaaaatcatgaatttgtcgatacggtgagtatatatattttgcaaaaatagattatgttttagaaaaaaaaagtaagccatatagtcaatgttttagacaggtttcaaagaccaaacctttctatacttctcaaacatgaattctacagtagttgaaggatggagtatgctgccatggtaagcttggatcatttcatcataaaatcaccataagatctgaaaaaaataactgagtgaaagactaaaaaggtggacggcaacaatgctacagcagtaggcagctccaggccagtggctctcgagaagggactatatattaaaagaaaagagaaaatccatgaaatgccattgacaagcaccctaatcctaaaaatacatcgataaaggcaacttccaaaaatgccattacacaaccctctttctcctaaaaataccatcaccgtcaactccacaccgtcataaccgttatttttttaataataaccattttgcccacagtgcaaaatatacctagttttcactgtcaaagaaagaaaatgaaatttctaaccctaaccctactgctaccaatcccgatccctatccagcgctctccccagcgccgtctcggcgacggcggctcggcggcggtccccggcggtagccctggcaccgctatgccggcggtccacgggggcggcgcggcagggcgcggcgaggaggtccacggcagcggcagtgcggcagggcgcggcgaggaggtccacgatggcgtggcagtcacaggatgcggcgcgggggccgtagacgccggcgaggagagacttgcaggtgtcggcgaggaggtcgaggagaggcccgcagctgctgaggttgtcgtggaggaagatactgcagtcctagcaggtggcgcaactctctgatgttgatttttttcccttttgcttgatttcatttgaagactttgtgttacattatgtgaatcaaattcagttggtggctttgtagatggattgaactagggtgaaggggagcatgaacatgggttgtgatggtaagtactgggaaccctttgttttgtgaaaattcatgttgatcacaattggtactttgtgtgttgattgccctgatgttttagctcagattgatagcaaaaatttctgaaattattggtagtcctgggtgtggtggtctctctgctctgtctcggcactgaaatttgatttcagtgaatttaattatgtaatttgattgatagcaaaataatgatgttggtgaatttataagctaacagaaataaaaattgttctgagcaaacaatgcaaaatgatgttgtgtgagcaaatggttgcctaggggtaagattgtcttttcatgcaacttaacggaaagatgctaacaacagtttgacagtgatagcatttttgggagaaagaggcttgtacaatgacattttggtaagttgcctttgtcgatggcatttatgtgattagggtgcttgtcgatggcatttcatggattttctcattaaaaaaggccgcaagtttttaaggcaaaaactttcaaatctaactatatataattttaatttcattatatctatactataactataatataacttatatataagtattaaataatatatgcaactttatatctaacatatatagagattataatgtagttacagtatagttaaactgtagttacaatataactatagtgtaattatatcgtagttccactacaactatactatagttccactgaaaggttcttttttccaaaaaattgcgacagttagggcttgtttgatagagctccaactcctaaatttagctccaggagttgggtctggaatggagttatggagctgcctaaacctagcttcatctctctagtttattttgtgaaagagcgccatccagcttcgctcccatttttaagtggagctgaaactgtttggctgagctccagctccagaagagatggagctagagctggagctgtgccaaacagtgccaaacagaccctcctctcggggatgcaagcagcggctcctgcgttacaggctgtggtgggcttcctaacgagggtttggttgcgcaccatatcgaacgaagtatcaatgctgtatcgaggccgtatcgctaatttttttattttattttcgctaaagaattagcgatacttcatcgataccatatcaaatgcgtatcccgcatatcgccgtatcggagatatagctgaaaactgcagtatatgtgcatcatgcaccacagcggatatgatgcgtcgagcctcaggctacggtggacaggtctgccagctcttgcttttgggcgtgggtgtggcgcggtcgggggcgctggagtcagtggtgatggcggtgtaggcggaagaaaattgctccctccgttattgacgtttttaatttgatcaaagtcaaacttaaaacagtttgactatgtttatagatagatatagtaatatttataatattaaattagttttatcaaatcaataattgaatatattttcataataaatttgtcttgggttgaaaatattactttttttctataaaattagtcaaacttaaacttaaagtagtttgactttgagcaaagtcaaaacgtgctgtaacctgaaacgaaggaagtacataagtcctgcacttatccgaaggacttcgtccccttatgtgacacgtgtccactacaaatctcaaagcacactgaccctctcttccctctaatctaatacccattgctcttcctccgctcggtgagaagtacgaacttcagagccggccatggaaatttttttatttttagacatttttttaatttattaatagaccattctcaaaagtattttcagatctgaaccttttagccacaccagcttgcctggcgtggccaaacaacgctgtgataaaccttgagctccactcgatacgctcaatggtattgtttgccccgatcttttggtgagttgagataactacaatgacgacccgactacaatcgtactagacgttgcgttgcgccttagcgaccgatacacctcttcgtgggttgttgatcttaccagcgcaaatcaatcttattcctgcaagcaaatcaaagaatcaagcaagaacaagataaaagcaatctgaattgcaaataggaattaggtacaaatgataatttggggttccgaagacaagcacatgaacggtctagctgacacgtgcactgcaagcaagtagcaatggctaaactttaatcaaataaaacccaagaaaccctgaaaggtacctgtgctatttatggaggtgggagggtgacctagtggtccctagggtcgtgctccatgtggtcaaggcacacccccacatggccccacttgggccggagtcccaaataaagttagaagcccaaagacctatggcaggtgatgcagcacattgtttctttatttgtggattactgggatagaatttggaactgaggctggatccgttggaaagaggactccgaaagctttccatcaaatactcatcagccggaaatggaggtcgtatgcagatttggcggccatttaaagtcagcagtatagcaggtggccgaatcggattccagtactaggaggactatcttgatattttcttcatccatgatgtgagcaacggtatccataatagccatggtcacatcacgctgccacgccaaaaggttcagttttcaaaaatactttttggattggtctattaataaaattaaaaaaatcttagaaaaaaattcctggccatgctagcttgttaaaaaaatacgaaaaagtacgaattaacccccccgaactatcgcggtcgtccgaattaccccctgaaccacaaaactggatattcttcacccccaactatgcaaaccggacgaattacccccctcgacccaatccgcggtggttttggcctacgtggcatacacgtggcactccagtcagcattttattttattcttaatggtgggacccacatgtcagacccatttctctcttcccctatctctttatttctctctcttcgtcggtcacgacggtcagcggcagcggcgcgcacgccggcggccgacacgcatggcgcagcgcggggaagggcgatgggcggcggcacgggggcgggttggcggtcggcgcgcggggaggtggaggggatgggggagaggc

SEQ ID NO: 28756 - DNA, 4628 bp, Oryza sativa
ccgcccatcgcccttccccgcaccgcgccatgcgtgccggccaccggccgtgcgcgcgctgccgctgaccgtcgtgaccgacgaagagagagagaaagagagagaggaagagaaaacgaagggtctgacatgtgggtctcaccattaaaaataaaataaaatactgactggattgccacctgcacgccacataggccaaaaccaccgcggattgggtcgagagggttaagtcgtccggtttgcatagttgggggtaaagaatgttcggatttgtggttcaggggagtaattcggacgaccgcgatagttcgcggggagggggggtaattcgtatttttttaaaaaaaaaacatacgtaggtatctgggtttcgtgttctgttattttctgttaattagtactctccccagtttttgcattagagtctgtttgagtcagctcacgacttgcaagatgtgcggtcctgatcagcgttgtggagtacttcgtcgtgttcgttcttctctctcgcgtcctagctcgttcagtttgcaggtttcgctacagtacaatggctactttcgctaacaatgcctctctcggcgagctgccgagctcgtacaccaggtacatgtacccgctcatggcgcagaagccgtacttggagcttgacgatgttcccgtagcggacgcgcgtcagcaccagctcgttcaattctccaagctcttctcactgatgtcccagcagtcgccggtttactacacgtcgagccgcggcttaacggcgatagagcgccatggtttggaattttcgaaatttcggcccccaacagcaaggtcaaaatcttcctgaaattttcggtgtttgccaaacatttgtaaatttggttaaaatttgtttaaattctgtcaaaatatgttaaaagttaaaaaaattcagccaaaaaaaatccaaaattactgaaattttggtgattttgggtttttggtccccactagtagaaacacaagtttcaaaatcgcaaaccctgtagagcgcccgtcgatcggccagtacgttcggcgttgtacacgctcacgaagctcccttgccgatgcagaacgcgtcgttgaagtgctccggccgtgccgccagaatgtcgcgcatataaggagaacgtcatgtccttgctccatatcgaaacctgcaccgccatcgagctcccgcgcgctcgccgacatgcgacatctccgccttttctaacgacgacgaccgacggctcgatcgcctcgcttaccggggcaccacggatgcaaaccatagagaccatgtggtagcatgcagcagctccaacactaccgctgggctgctgcacgcggctgtcagaaggggaaggagctcgcgaggaggcggtgtgtagggatgaaagcaagctgatcgatccgcaaacctagtttaaataaatggtaatccgcgggtttctacatcttgacccggcttgccacacttagagatgcaagtaggtcaatccataaatctatttatagttcaaattaataggtaacctgcgatcaaatacgcgggttacccactaattttgtttataagcgggttctattaatagtgaaatttggtaagccccgaagtcattatcggtctagagtcagtatcggcttcagagttctagaatcggccgatggaaattattaagtcgccaatagtcggattcttactgtattcagttaagtaaattaatccattaaagaaggttaagtaaattaaacaattaaaggaagtttatccagaaaagaccgagttcaaggaggatgcagcatggtagtttatctattaattaggaagagtttgttagtttcctttttatctttaggaaagtatgtttagtgtccgataagaactttatgtttttcttttatctttaggaaaatttctttcttacccaacaaagctattgtgttcgtcgacttagttcgcgccaacacagtttcggcacaatcagccgagcactgattgttcatcaacatattcgcaagttgatccgcttacaccaactgacaggttgaggcatgtgtggaggggcaggggttggtagggggcaaagaggctgtcagcgtcgacgaggacctcgctgctcctacccaacttgccgtggttaccaacgagatagagaagaagagatgagagagagagaggggggtagagaaggatgttaatgacgtgtgtgcctcatatcacgtgacgtaggtaccacgtcaatcaaatccagcctcaatagtgctttaggatttcttttccaccagcattgcgagttgagaggtgaagatttttcattgcggtttagggatgacaattaaactcagcggaaaaatgaggatggcaactagacttcctttccttctcttgttgctagacatgtatgtatgcttgtgaaggcagaccagagaaatggaggcccacacccgagattgatggtagcaggcctgaagagctggcgtggattctcgactattatatctcggcccattctatcttggaccagaagagaaataacagattgtgttgcaaaatttgctcaagtaaattttgtttttgtgggtacaaaacccggtcatgactcatgagacgtgtcagcttgagatgcttgtacatgccaaataatatttgtcacccaaacaataggttcattttcgacaagtaaaaaaataattttaaggagcggtctagatctatgggtttgacacacgttcacccttagatcggacgactcagatcaccctctttgtcacagccaaatattttcattttcacatccacctcacagcgatgttactatattggtaactaagctgcttatatctttgccgacatctgcagctccctcactcgcatggccggttttgctggattatggcccgaaaatggtgcggaatttggcaatgttggtcggtacgattcataaggaccatggcatagtataacaaggttgtacacgcactaatgtactatgtacctatacatttgtgcagttaatatgtacaactcattgtaatgaagctgcaggatgcgcggtcccctgttacccgatctgaacaagacatccttatatatatagctgcaaatatgggtggtagtaataagtggtggatgaatcgcatttgggatagtcatctccatttagggctcaattggaaaaaaaaaagaggaattatgaaggatttgtatcctatggaacattttcctattgagttctttggaacaaaggattcaggcctacaaatttccattgaaaatcctatggaatattgcaagaaaacaagcataaggtgttagctcgtactttcctttttccgatacctctaaggctcctttggacgtatgaattgaaaatcatacgaataagaaaaacataagaatagaaagtcacgatatatgcaattcatagcattgaaaatacatggaatatgtcaaacaggttgtttggatactccacatgaaattcacattttaggaaaaattccctatgaaaattcttttttttttagaattacacagaacaacgcagacactcacaacgcacgtgcactcacccctatgaacgcacgcacgcaaaccctatccctataagcatcttcgaagactaggccggcaaattcttgagagattaatgaagtcaccataagcgcctcgctgtcgacgggtacatcgcctaccacttaaattataatgccgttaaaatcctggaaaattcactcccatggggagtcgaacccaggacctcagatgctactgaggctcatgtaaccactacgttataggccctttcgccctatgaaaattctattgttccaacaaggagccctaagtacctatgctttttgcgtgtgtcatccaaacgacggttttataactaacctgtgttcctatttgctgcaggaattgaataatgggcatgtcatcctattaaattttccccaatattatggaattaacaatgacatttaggttcacgtacgttgtataggaaaactagatggaacgcgattccctcacgctgggtcacggtacgtattaaatagggtagaaacagcctctaccgtgacgattacaaagggataacaacatatggttacaagagataaggataaaaagataacaacagaaacaggataactaaacttatctatatttcaacaccccacctcaatcacaacttagcccaagttgagattgtgtctaaactgtgctaaactcggcgccggcagggatttagtgaaaccatcagctagcttatctgttgtagatataaatcgtatatcaagtagcttcttcgcaacttgctctctcacaaaatgataataaatctcaatgtgctttgtccttgcatgaaagactggattagctgataaataagtagctcccaaattatcacaccacaattgtgctaccgaaggtcttgcaattctcaattcatccaaaattttccttaaccacataacttctgccgtagcattagctaaggctttatactctgcttcagtactagatctagaaaccgtagcctgttttctagcactccaagaaattaagttaggacccaagaaaactgcaaaacctcctgtagatcttctatcatcagaacaaccagcccagt

SEQ ID NO: 28757 - DNA, 18232 bp, Oryza sativa
ccctgactcactttcttgacctcaattccaagaaagtagtgtagatctccaagatctttcaatgcaaaatccttctccaagtccttaagtaaggctgcaacagcttctgaagaagaactggcaacaatgatatcatcaacatacacaagaataaatatagtgcaaccacccttgttataaaagaacaaggaggtgtcagcctttgaagaaataaatccaagttcttgcaatttcgtacttaagcgagagtaccatgcccttggtgcctgtttcaagccatacaaggctttgtctaacttacacaaataattaggctggcctttgttctcaaaacctggaggttgtctcatatatacttcctcttctaaatatccatgcagaaagccattttgaacatcaagttgtctcaaactccaaccttttgagactgcaatagacagaattaggcgaaccgttgcagctttaacaactggactaaaagtgtcctcataatcaataccatacctctgcttgaacccttttgcaactaatctagccttatacatgtctattgacccatcagcttttcttttaatcttatacacccacttgcaatctattatatttttaccttgggttggtggaactagatgccaagttttattactcataagagcatagtattcttgttccatggcaagcctccaattactatttgccatagcctctcggagattttctggctcaccagtagttgtaagacatccatacctaacagtcccatctgtataccgcttgggtttagaaatacctttctgtagtctcgtgactggtctcgtctgatcacttgcctgtgttgtctgctgctccggttcagacagctctgacgctgctgatgatagcaatgtgacttggtcagcatgtgtgccatgcactgctccaccactcggtgcactagtactaggtgatgaagagattggtgcagcatcactgtctgactgcagctctactgacacgtcacgtagcactggtgaaccatcatcatttcctgcgccagctgcaccaatagaaaactgagactgcacaggaccatgcataaaatcatgtggcataaaatcatgcgtttcctccagtaaaatgctttcttctctgctggcgctacccggcgacccggtttctgcttcgctgcttccagtagctgaaccaccaatctgagcaactcctgttcttaaagaattctcaccaatttgattagaaaaattaggaggacaattaaccaacggttggtgcactatttcacccccatgatcagattgagtggtaggagagaaactatcgggaagaaggaggagttcaatacgaagcctagtgccagcattcggatgaagagtagcgaatggatacacagtttcatcgaacacaacatcgcgagagatataaacccgaccggaagcaacatccaagcatttaaaccccttatgaaggaggctatatccaaggaaaacacactgtttagatcgaaaggatagcttatgagcttgataaggacgaagattcggccagcaagcgcaaccaaaggtgcgaagggcagagtaatcaggtttgatgccaaagagatgttctaaaggtgtctcaaagttgattacccggctaggaactcggttaatgagataggcagctgtaacaaaggcttcatcccaaaacttgaggggcattgaggcatgggataggagagttaggcctatttcaatgatatgccggtgtttccgttcagctgagccgttctgttggtgtgtgtgtgggcaagagacaagatgtgctatgccaatctgagaaaagaagctattgagtctttgatattcaccaccccaatcggtttgcatagctttgattttagtattaaatgaatgttcaacaagggtctgaaattcacgaaatttggagaaaacttcagacttgtgtttgagcaaatagacccatgtaaacttactaaaatcatcaatgaaacttacataatagttcttattgcccacagaggagggagctggtccccaaacatccaaaaaaactagctctaaaggagctttagacacactaacagacttaggaaaaggtaattgatgacttttaccctgctaacaagcattacaaacttgattctgagtactctcagaagacacgggtaatttatttgagctaaggactcgatcaatgatagctgacgatgggtggccaagccaattatgccacaacgtcggggaaaccttgaaagcgccaaggacttgctgagcttgtttattgtgaagcgtagatgacggaagtgggcataggccggctctacatctgccgcggagcagcgacatctttgttgcctgatccttgatcaaaaagaaggtaggatgaagttcaatgaaggcatggttgtcaagcatcaagcgataggcagaaattagattttcctttgtattaggaacatgaagaacattattcaaataaagcttgcgagtgggagtgtgaataatggtgcgactaacatggttaatgtccatacctgagccgcttgtcgtgtgcacttgatcgttgccggcatatttgtccttcaccgtcagcttgtaaagttcactggtaatgtggtcagtggcacctgagttgatgtaccagtttgtgtcaaccccgtaggacaaggctgcgacattggcactcttgtcttccccagtgaaagaggcatcaaacctcttccagcttttgtgcacggtgtggccgatcttgctgcagagttggcatgtcggacgattgttgttgttgaaggagccaccgtcacctctgccactgccgcggccaccaccgccacggccgaaaccaccgcgaccaccgcggttggcatctccattgcgttcgccgcctctgccgccgccgccgcaccctcctcgcgacacagcattggcggaggactgagagcctccttgaaggagaccaagacgctgctcgaaactcagcagttgcgcatagacttcaccaaaggaaacagactcagtgcgtcccgtaatcgaggacacaacaggattataatcaaaatccaaatcagcaaggatatgggagatcagatcatcatcatcaagggcttttccagcagatgccatctcgtctgcaagccctttcatctttccaacatactcggcaatactatggttacctttcatagtagatgacagagccatgcgcgtgttgatgatacgtgcacgggactgcgagttgaagatctcctcgatggcatcccaaacgtctgctgcgttggtgaaggttgccacctgagcgaggatatcccttgacagagacgtcaacaagtagctgagaacttgttgttcttgcgcctgccattggagaagcgccggatttgccaccttctcggtggtctccttcccgccttgtccttcgtggcaaggatgattattgctggtggtggttggatcgagcgatccaggaaccccgccatctgcgctcctcgcagggtggcgagaacttgcgccttccaaagaacatggttggccttggtcagcttctcagtcaccgcctgaccatggagagagggagccgccaaggacgacgtcgccatggcgagatgagctagattgatctggagggagagggctctgataccatataagaaaactagatggaacgcgattccctcacgctgggtcgcggtacgtgttaaatagggtagaaacagcctctaccttggcgattacaaagggataacaacatatagttacaagagataaggataaagagataacaacagaaacatgataactaaacttatctatatttcaacacgttagtgcacaacaggttttaaatttgacaattaaattacattttatgatttttaagggccaagttagtaatgcacaacaagatatagagaccaggtaaaataatacctttctcaaaaaaataaaaaaagttagtaatgcatttgggagtaaatgatttttcgggaataaaagtatcatcatatatattttaggtaatccgttgtgaaacaaaccacaccatcacaaggcacactacccacttattctatcttactataaagttgatgtccactaagggtgtgtttagtccacgtcaaaattagaagtttgattgaaattggaacgatgtgacggaaaagttgaaagtttgtgtgtgtaggaaagttttgatatgatgaaaaagttggaagtttgaagaaaaaattaggaactaaaccagacctaactactaaagctcaacatgcaagtgtgtcacgtcatcaccaactagcaattattttctagagtattttaattcacatacaagtatgccacatcattacccactagcaattattatctagaatattttaaatatcatgcgagcatgacatataatttacaattttgttatattttgagaacttaatatgcaagcaatgtcaaaccattatctctacgtcattttcatattatttaaacatatatatctaccatttctataattaatatgtattcatccaaatatcccgcagcaaagcacgggatatcaactagtactaatgaaagctagatgaatacatttgactaaaacaatgtatttacgtgggttttacttttaacacaagaaaaataagaattccaattgtgtgattcaacttttaactcagtaatcaacttccaataaatgattttgacttttcaacaaagaaaaagaaagaatttcaattcaaagatatgtaacaagctatggtcgtggcaacaagccaattaattgcttctaggagcaagctcgctattgtacaggatcgaccagatgttattttgatttgatcttttattttgagtaatctattttttctattgattcagttggtatctgatgaaaattttctgctccaaatttgaaatttttactcctcaaaaccgtctagagtgaagtgcactgctaagttgtttttcttcttaaagtcacttttttggaaaattcttggtgtatatatttgttaactaaccatatgaaggtcaaaagatgataccgggttaggtatagaattttcgctgtttggcgaacacctctatgttagagcagctataaccagtttcaggggaagaccttgcgttgcgttgtggcaaatggcaagccgccataccttagtttctagcatggacaaccctgaacagtgacgacggagccaaggaggaagagagctccgctgtaaaactatcatttgactgccctgactacgagtataggacgtaggcatgtactagtgcattgcagttgccagtttagggccttttaactgactaggtagtctctgacgttaagccacaacgatcagtttccttccatttttctttggttctgaactttatggttaaactactagtctatttaatatgtacaagctaatatactaattaagtgctgttgactacatatgctgggtttctatttgaggatttgagcaaaagtatcattactgattttgagacagtagcagcaaactttttgagaatatattgagtgaatttcattttggacccctttttattaccctagttgcacaatggacaagggatttaacaaaattttcacttaacaccagctagacttgccaaaaacatagcagtagtttggaccagggtattgctctagctgctacggtgctagtgctaccatggctatttctataatccatgggaggaaacatttgcttaagttagggacggaggcatcgattgtttcgctttagttgcagttgcctgaaccatggctatttggctattaataatcatgtcatctgtttgtctatagttgggctggtgtgcgaggatcaaatcagagtagcacatcagattgcaggccaccgtcggtgagcttgagatcgagcatcaccatcctcccattccgtgcttgagaagttgagattgagacctgtacgtgtcggcccacacttgaacccaagcaccgtcgggcgctgactatctcagcctgaagaccaaccctttgcgttgcctccctctctgctgactatctcggcctaaagacccgccttttgcgttgcctccctactcgagctccatcaccagcacctctagtgctgttggctgttcgctcgagctcgagctccttcaatgctgtcgatccatgctcgctgctcctccctccatcgatgctgtcgatccatgctctgctggtcctccctccagattcgatgaccgtgaccggagttccgcgctgcttccgtactctttcctctaagattgggccgccggagttctggacgagacaatcgcccccctactcctgctccactttagatcatgtcacgggagcggtcaccacctcctctgacagcgaggcagatagggggagggacacttgcattggagatgggctgccggacttggagaagatgagggggtggtctagagtgaaaccaatggtagaaatatgtggtccaaagtaaaaaccattgctaggacctagtccaaattgcaacaatggtaaaaatatgtggtccaaactataatttactcgaatatattggaaaattaaaacattggtccagtggctcgccttcaacctccacctataatgatatattccaacaataccacttctctagttctcctaactagaaatcagtcatttctatcattttacttcataattggatagttagatgtgcgcattgcccctttttacatatacattatacattaatgttttttcatgtcattaatttttagatacatgtcacagtattggtgtattacgaatcggtatttgtgtctaataagttcacccacctataattttgtgctgggtcagccactgaccagttctattaactacttttcttataactcttgtagaacatgcagttgttattagccaagccaacagcatgtggtttgggaaaccaaacatggcatacccaacaactactctagactcatggatatgcatcatatgcaattaggatgttgtgcaaacatgcatgtgcctaacccctctctatcgatatcatcttttaactagaaatatgttttaaaaaaactctaaaaattaaagctgcagagtagaggcaagaaaaaaaaactaagtagttgtaaattttagatcactttcgtattaaatgtattttgttatgtattttcatgcttaagatgaaagtataaatctagtgtacatcctggcactacaacaaaaccactgttttaagacgtttcacttaagttattctattagtaaaattaaaatagggacgatgtttgagacgctttattagttgaggacatagtttaagacgctttacaggttagcataaaattaaatcgtttagagaggaatattgagacgttttgaaacgtctcgtgtgtagaaatgagttttgagacgtttttattatatccgtgtcatcattattagataatatataattatttatatagagaaagaagaaaataaacacattgttactaatcgtcatcatcaaataccattataaaaaattagagtatctgctacaggacgcttgtttgcagagttgcaatataaaaaaaactatttatttaccttcaagattgttcacgttaatgacttggttagtgcatgaactttgcaacctgcaggtgctgtgttcgagcccagatgaaagcattaatatcaaatatattaagatgtgcgtggctatataaaagcgtctctatattttgtagagatgcaatttatacgtctctagcaacgtcttaaataatataggtacgctttaaaaagcgtctccataattttgagatggtgtaaacagagacgatcctacgatgctttataaaagcgtctcagttatctgtgggagacgaaataaaatgtctctatcttacaaataaaatgtctccgttgggttgttttgttgtagtgtgggaactagattcacataagtatgagttaagaatatttgagatgttgtacatctttagccatttttgtcaaatctcctgaatgtgtaatatatctggtcgtcgccatcgagtggtttgacggccacatctcaggctaaagttgactggcagcctaaaggcccagcaaagtctccaatattcttctctcgaaacgtcggatatttcattatgtttgtttgatgacttgaattattcacttcatccctcaaatataatggaaggtcaatataaattaaattataaaattaaaattttaccagaataaatttcattatataaaaataaaaaaaattggttggggcttataaactgaatgtacacctatggaaaaattagaacgagactcaacgttctaaactaaagaatttagataaagttgaaaagaacaaagaaaacaattgaacaaacctttcgtcgtttttaactaaatactcactccatttttatgttacttctcattttaactttgtcctaagtcaaatattttctagatttgactatcaatttattaaaattcatatagtttaacaacatactccctccgttcaaaaaaaaaagacaaccctcctaggaggggacgaatggagtatttgtattttctaagtcttgcaaatgaagttaagtttggtcttttttttcataagggttttttttttgaactcaggattttggggtgctactcagatcactgcaaccacaacactaaatgccctttcacagttaagtttggtctagaaaataatgttgcatgagtaaatattatgtctagaaattgaagattttctttcccaaattgtttcttttccctcaaacaatatttcattgggttcatacttcggttaactaaactatgacttatcattggacagcatgtttggctaccaagaacataatttggattggtggttgttggtatttcttacgaccacagataaatccgcaagcgcacggaatatcgctgtaacacttcaccttcgggtgaccccaaaaggatatcgaactcagggaacgtgtgtaatctacctaaggctaagacaatccaaggacaacaattataggtaggctaggtaggctagagaggactttctatgtgttttaattatctatgctaagcaaggtaattccctatctgttgctttggacaccgacccctgctggtctgccagcgtggttccggctatagctctatgatgtatccgaacgtggaggattactaggacgggattcagggctgtcaccacctgccgcctacctctgacaaatccgtcggatatacaacaaacaaaggtaatctctaacctagacaccacgtctaagttattaattactactctaatacttgtacaggaacttccttctctatccagagtcctagtactagagcacttaatacgaatactaaacaatgaacccgcaaagatggaaatatatcttactcagactaagtaattaaataacataagaaaggaatatgaatgcttactttatagaagaagttctctgaacccggagcagagtgtaccgacagctccggtactcctccagaattcctcctaggaagctacactcgtcgagaaagaagtcggatgagcgtcaaacttccgggcactcctccagagcttcccctcactctctacctatttctaatgtacaaatgatacaatagagcctcttataattcaactcaaagttgtgtgtgttggaatgagagtgaagacctccatatataggctccaaatgacggttaggggtatgggaaatgaccaaaacaccctgcaaccgccataggggaggaatccaagctgtccacgttaagccagatggcgggaggcgctaggattggttcggccgaaccaaaaatccctcctcccagcctttcctttgcccggtatgtagcttattgggcccccaacatcttgcacaatgttttggcccaattctaagtggttttggttgacatatggtcctccaatccgtgtaaacgcgtcctgaatgcgcagagatgcattttgtcacatgacggatgtgttttctcctcaaaatacctgcatacacatatttcaccaacactagtggaaatgattagtaacaaaccctaccactaagttggataccatattttatttcattatatgcaagtattgacggtcaaatattatgatttaaggaccgtcaacagtggttatcggtgacaccatgttaacgaccaaatttggtaagatgtgaacgaggttcaacattaggatcgaggcggattcgatgaagagatcgattcgaagaacagagtatgcatcggctgtgaaggtatcagctggagtgtacatcagctgggatggatcgaacagaggatagccgatacagccgattacgatgaagacagtttcgaggcttcttttagaatcgttcaaagtgcttcacagggattgccatgatagagataaagctctcagtttgggcaattgtatctattaattaggatattttatgtaatttctttagagatatgttttggcaaaagtttgctgcaaagacttatggtatcttagagtttgttagagataagtgtcgtgtccggcaaggacatattttgtatctcgggtataaatagagcccgaactcatgtaatcaaacaacagacgttcaatacaatctcagcgcatcgccacccttttactttcgtttactttcgacaagttcttactttcgggttgagctgcatcggtttcgattttcaactagaggtaaagcttgttatggcggcttgtgttctcgggattagtgcttccatctttatgatactcttatcttgtttatgtaattcgtcaagttatcatatattctatataatctttgacaatatcgttatttaaccttcaatcggccagcatctatcatcagaaggcaaccgattaggttaattaccaatgctgatttagattatataggatatccaccaccctatgaaatattcaacggcttgattgtctagatattgtccttcttttcatacttatagctgcatcagttgagtttgaccttataagtcgtgattagaatctaaatctctagcctgcttttggttgctgattagggtttcatcggggtttcagccgatcttacctgatttaactattttatatctcatatgcttgattgatataattaaatctgccctttatgttaagattttgttgcgtttaggtatattaagcttcccgtttgatatatttttgcttgctttaatatctcaatatagagtgatatcggagtactagccgatacatgctagatctgtctgatcggctatgctatgaatgcttataatcttcttgttaatatatattttgatctaagtaatttatactaaaaaacgacatggcgaccgatctatcccaatcacttgatttaagtatatatcgacgaaagcattatataccattgatatctacaaccgattgaatagatttagttctttcttgcctatttatgactgtcgatcgactcaaacatgacatcagctcaaagataaatgatacgtcattggggactggccgatcggctatcgtttatagatttaaccgctattttcctgtctttatttcttgttgattgcaggatcaaatcaactggcacgctcacaaacctaaaggcaagattttttggacctgcgctggagttaagcagatctcccaggcctcgtgtttttcgcatcaacacaccaacaatttacagattgctgtgtaggatcgaatcacaacaactaagccaaccagagggggggtcaatggttggtatacccaaaaaccgaaacttttagcggaaataaaagttaccctcaaattcgacggatcgcggcctaaccgaagtgtatgcgccagtctgaccgcctgatgaacgtcggtctgaccgagattaaactccgatcgaaccgccgagatcgcctgccgctccctgtcgccaccgccggtctgaccgccgtgtgcccaccggtcggaccgccgcgatgccgccagtctgaccactagtgcgccgccggttagaccgtcgaaacccgatgaaacacaaatcgaagaactcttaaaatagatgacgactttattgattctctctgtgtttacaaagtgcaccaacaacactccttacaaaaatttcgactaaactcgaaaccctaactcaactatcaactcaattgctctcaaaagcgataccgggaagtctcacgctccctctctatttatacccaaggtaggcagcctaaagccacgaaccaaactcatactagaactcctaatcaccctaggaaaccctctagtaccagaaacaaactttacataaccaatcataccaaatttggactccttccaaattcaactccacatcacatacgcacacaatacctccatcgtatgccatatggaatcttcaccaaccacgtgtattaaactctagccttagtatcccgcatgatctctgaccatcatggacgtcgtcttatccccaagccgacttccggtccatcaccgcaaaaactctcccggtatctcgagtcacctacacatagaacaaacaaagaaaccatattccgagaccaagctatccccaaattgactcattgttagcaaacaacagtattacatacgcatagtatccatctagaagccataattatgaaacaattacggatatccaaacaaacaacccaaaaccgaaaccgacacagagtcggcatgtcagaccgcgggttgtaccggtctgaccgcgtgatacacgccggtctgaccggcagcacatgtccggtctgaccggtccaacaaacagttgtacctgtagatcacctgtgaaatccaatcatatccaaaaccacttcgcaaataaattctaaataacaaaaccaataatctccaatgctaattgttcatcacagaataataataacacttttgattttacatgctgctctggtagagaggttcgatcagctagtcgagtgcaagcttccttttgttcagctgtcgcgtttctaccttctttcttcttttttatgctttctctcgggtatctcgttcctgttatcgttgacaggcattttcaagctttattgtccaccatgttcgaggatcaaggttccattccttacttttctgcaagtagctggttagcatagcttggttaatcgctctggcaaacactaacttaatacttcgttcgttctccaataattgacaatgatactatttaagtttaagctttaatctcttgtctttttcttgaaaatttatagaacttgaaaatatgttatattggtaaaatgtgcaacgccataaatattactattatacaactatcatcatcataatataattatctaaatatttttgtcaaagtgaggaggtggacgtagtcaacagcgtcaattattcgataacggtgaagtactgtcaaaaaaacacaccaccttaatattataaaattggaagtctatttcacctcaattgttaattaaaactatacaacgcaagggtttgagccaattttacattggtcactcagttttcaaaaaaaaaaaaaaaaacattggtcactccatcactgtagagagatgtacaaagaatgaaccgtacgtgtactacagtagggttatgtggcgaccgaatggtgcattagagagcggtgaatcttagaacatcaaccatttgcgtgatgatactttataaccagtggactccactgtatctctacgtgactacgtgggtcaaaccatttcctctaaaatatgtacctgtggtctttaaggccttgtaatcatttaatttagtttgttgcttatatgatgatttattttgggtctgcacccatctcaccgtctcaattcattcttctcttatccttactcaagtttgtaacaaatgttccatctgtaccatttatatacaatttgacttcaacctcaacttgttttgggataaaaagaaacacattattttactttcataaaactcacacagtaaagcctggcctcaatacaatcatttgtactattcattatacttatattatttaccatatttctttcgatagttactctcaatgtgtatgcccgcatacgggtgagagagggtgagcacccccccaaaaaaaaagttaggtgcctattttttaaagaaaaaaaatcaagatataacatgttttaggactttctcttattttcagccataagttttatattttctccaattctcctcctattatttagttggaatgagcttgtttttgtctgctccaattgtttgattataattatggtcatatttaaaaaactgtacctcaatttagatctgatttgttatgtactttggttaatattgatagtctaaagtgaaattcattcttctctctctttttattttctaaaaatgtgaggcctcactatttttttagcacatattaggtgggctctgtgtattaggtttgagttttaaatttatacctacagatgaaaattaaagggtacatcataaaattttcccggacttctttaatgctgatttggtccctaaaacagcaggactgcacgtgtaaggaggatttgacgtacgtaacgcgtcgccgatacagaggtagtatggtacttgtatatgtagcgttttgtttctagttaggtgagaatccactataggatatactactatgccaaaataaaataaaaaaaaagctctaactacgaatcaagacatatatatatatatacagcagttcaagtttttagttataattgaattttttttaacagagagggtatatcattatgtagttaattatgttgttagttggtatatattactaatacttcctctgggagtactttctctgtcccacttttaagtctagtcgtggatttttgtgttcaatattaaaccgtccgtcttatttgaaatatttataaaaaaaattaaaaaatagtcacatataaaataatatttatattttatcatctaataacaataaaaaatactaatcatattttttaaaataaaatggacgatcaaacatatggcacaaacaacgtaaaactgtattcattttgggacagagtagtatatacagtgtataaaacgcgttagcaacactggtcattaggcttgacttcctccgagatcgatccatatatttattcctccataattaatccataacatatccggtcttacttggcagcacatgtgcatgtgtttacttttttttatgagttggcagcagtctgttattttttttccccttctgcgtaatgcttatagacatgagtatgagctgggcttggaccgggccgggccaggccggtctagggtgacaaaaatcccagtgaagcctatcggaccgatgacttttatatgagaaaaacaacaaaaataaatatattataagtagcggttggttttattcggtttgatttggtgctgcatgcttagccagtgttcgataggaaagtaactcattaatgcatgattaagtaattattagcttaaaaactttaaaaataatgtaacatgatttttttaaagtattttttatttttaattttgcaaaaacacaacatttagaaagtaagaaagcgtgcatgtaaaaaacgaagtagtagaagttatattatttatccattcttctaagatataatttgtcaaaaaactttctttgactatattttacttacttagatcacttattataaattactcccttcatcccaaaatataaccattttagcatagtgacaagtcaaacaattttaactttaactattaatagaaaaaattttaaaagatcaatcatgtaaaattgatgttactagatttattattaaaaaaaactatcataatatgcaaccctttttatttaaaacatcttacttttatatagatattattggttaaagttgcatctcagagaccatgtcagagtccaaaaatgcttatattttgagatagagggagtaacattattatgtttataacatataatatttattctctataatcaagtggatagttcatcaacttttatcctcaaataattaaaaatagtgatactttaatttagtgctgccacaaagcaaagaaccggaaaataacattagactttgttccgcactacactttcttaacttctactctctcatttttccatgtgtacacttttcaaaccactaaatggtgcgtttttcataaagtttttctatagaaaagttatttttgaaatttatcttaatttattttttattttatctaataattaattaatcatccactaatttactactctattttgcgtgctgtttaccaaccccaaatgaactcatctttaggttctcattgatgtaagtggcacatgccacatattttagctagtctacacattatgctatacgagattatctaattcaataataaatgcgatgacaccgtgtagagattctctttatgttttttttgttgttttcctaataatgaaaaaaatagagcatgttcacttgtgcactcatttttgcttttgtgaaaaaaaaaggatgtttgtggtcgacataattatatgttgtgtctttcagatagatagtgagtttgtttctcttgttgtttacgttctctcatacggtacacaaggagaacaaagttacaatcatatccacaaaaggatgatgacgcatcatttcccccgttgttatttagtgtagaaacatggttgcgtacactgttttgggtatagagggttggattttaatccattttctaaataaatatttttatgagtccttttggaacatagcattaagtatttattaaacgatttggttcaaaatagaataaaaatactagttggtccaaaataaaagattcattgaaacaagtatttttaaaaatacactcatgtcctatttggggtgaatatgactaaaatacttgtagctggttgtcagtataagcccattatttatacatagaaagtacttgctaaaattaattttagggtaacattcgatataaaccctctattataaaaatggatagataagatcaaatatagtcactaactcgcattaatagtaccggtagcattatcaacaatatccatccaaaacatgaaaggaggatagtgatatagttcttcctatttggtttcctacccagcaaaaacggaagcagatcctctgacttaactgcacatgcagttgaggcactgacatgtgggtcccactttactatggcccacatgtcagtgactcaaccgcacagtagttaaatcagaggaaccctttccagcaaaaacatactcactcccccatcagcaccacaccactgctcaaactactccacttgctcctgcacactggccagccatacttgtgcagttgtgcccacaaaaaaaaaccctttgcaacactgctccactccatcactagtgctgcaccaccaccatcatcataaccaccaaacccccatatttcctagatccacattcaatcctttccccagcatttcctcccttttgttttttgatgcaaattcccctccttttcttttaaaccaaaatccctcttctcttttcttttttaagcaaaatccacctcctcttttttttaagcatcataaccaccaaacccatatttcctatatccacattcaatccttcccccagcatttcctcccttttgttttggatgcaaattcccctcctctttttttttaaaaaaaaagaaaagcaaaatccctctcctcttttcttttttaagcaaaatctccctcctctttttattttatatttgaaacaaaatccctctcctcctccccaatttactcccctatttactccctccacctccctccatttatgacctctcttccctccacctcctcctcctcctctcttctcccctttcacactctagccatactctctccaccgcattagctcgccattgccaaccagaggagagagagaggtggtgggcagcggccacttgcctcttccgagctgtctcccatgacaccaccgccgccgccggtgtcgcttgctccgtgccaacaaccggtcgagcagctggtgggtggttcttgctagcacgcgcggcgcgagcgccaagatctcaccgtacgcgtgcagcgccgcggcgggcggccatgggtgctcgggtggtgctgttcttggccctggccgtggtggcggcggtggcccaagagccgaacacggacgcctacttcgtgtcgaggttcttc

SEQ ID NO: 28758 - DNA, 34696 bp, Oryza sativa
gggccagctcctcggcaccgtcatctctggctggaccaacctctcctccatggatctctccggcaatgcgctggacggcgacttgccggacctctcgccgctactgtcactgtcctacctcaacctgtccgggaacaggctccggggctccgtcatcggagcgttccatgagcagatgaaggtgatagacctcagcaacaacagcttctcggggctaaactttagcagtggatatgcaggctcatctttggcatacctcgatttatcaggcaatgagcttaccggggaattcagtgttggcaacaggtttcagaacctgaagcatttgaatcttgcattcaaccagttgtccgtggcaaatttgctggtgtccatgggtgagatctctggattggagtttgtcaatttgtcgagcaccgggttgcatgggcaaattcctagggagttgtcttcccaattgtctagattgaaggtgctcgatttgtcgcggaacaatatcagtggagtagtgccagacttgagctcgattcgcctgcaggtgctggacttgtcggtgaacaacctcactggggagatccctgtggcattagtgaagaagttggtgtccatggagcggttcaacttctcatacaacaacctcaccgtttgcgcctccgagctctctcccgaggcgtttgccgctgcctttgctaggtccaggaatgattgtccgattgccgtgaatcctgaccgtatccagagaagtgggggcaaacgcaaggggatgaagttggcgttggccattgtgctttcgctcttcttctcggttcttggtctgctctgcgtggcagttgcatgtcggcggcggaggaagaggggtgatgtgctgcctgctgtcaagcaggtgtcattcaaggaggaaccagggatttcaggcccatttgcattccagaccgactcgacaacatgggttgccgatgtgaaggtcgcaacatctgtcccagttgtcatctttgagaagcccttgctgagtttcactttcgccgatctcttggcggcgacgtcaaattttgataggggaactctgctggcagaggggagatttgggccggtgtacaggggatttctccctggtggaattcaggttgctgtgaaggtgttggtccatggttcggcaatggctgaccaagatgctgcaagagagcttgagcggctgggacggatcaaacatcctaatttggttcctttgactggttactgcttagcaggggagcagagaatcgccatctacgagtacatggagaacggcaatctgcacaacctacttcatgacttgcctctaggagtccagaccactgaggattggagcactgacacatgggaagacaacaatggcggtgttgccaccgaaaacatcacaccagagggtaccgcgacatggatgttccggcacaagattgcattaggcgccgcgagggcactggcattcctgcaccatggctgcatccctcagatcgtccaccgtgacgtgaaggcgagcagcatctacttcgactgtgggatggagcctaggctgtctgacttcgggctgtcaatgatcgccgggaccagcacggacaacaacctgctgcaccattccccgggctacgccccaccggagttctccgactcggagaacgccatggcgacagcaaagtccgatgtctacagcttcggcgtcgtgctgttcgagctgatcactggcaagaagccactgggggacgactaccccggccagaaggaagccagcctggtgaactgggctagggcgatggtgaaggcaaacctcgggccgggcatcatcgacccaaagatccgcgacaccgggctggagaggcagatggaggaggccctgaggatcgcctacctctgcaccgccgagctcccctccaagaggccggccatgcagcagatcgttggcctgctcaaggacattgagcctaaggtagcagagcaggactgaaataatattactagtgtttttggggtattgaaaagcaagtgtaggcagtgagctccttagttgttttggcatagtggagcttcactgcattgccatgccctgctctcctctgctgggatatatctttttcttcttttttgtttcttttttgttcttccacttgttgagatgttgcaatacagctttgctacacctgctccttactaacaatgttactactaccattgagtcatgacacatggaagatagctctctctcatcaatgtgcttgttttgcaagagaaatggcaattaagcagcagcagcagtcctggtactttgctgtctctgcccactgttattgaacaatgtagtatacttaagcaaacatggaacacctttaatactgcttcctagtactacatgttcaaataagctgtcaaaaattaacaaaaagaaagacagcaatactactccctcattcattgacatgattgcagctgcaaaaccctgcactgtcctgaaagtgtgctaataatcacctgtttagaagattaaagtgtgttccataccatcattatgttccaacttttttccagtttttatcacccctgctgcacctgcactgccattgcatggcagatggctcttctttactcagctcctttgctagtagtgcttttttttcaccttttttatttttttttcttaataattttggctcttcttctccgggttacgctatctctaagtattaattatgctctcggccatgcctggctgccagtgtgatagccttttgagaggccatcactgaagagaaaattaaaaaaaaaaatcacacacaaatcaaatcgctttcttgaccaaccctgcatcgaaatcgctatcaagcatgcgctccactcctgatcattgtgctttttctgcttgtgtagagcacaagtgagtgactgatccaggcacaaacccacaacttttcagctaaaattcggacaaatttagtgccggaaattgctcgaaaatctcgtctgatgtggtctgaccggtgttgtactagtgttacctggctacaagcaaggagattagggttttttttttttttgcaacaaaaggaagagtaaccgcgtggctgatctcctgtcaacatcataaacctaggcattttgcgcggattagcgtcgtgatttatggggagatgtagtgtccgtccatcctaattaagtgcaatcatgggaagagtatgactagaacagtagtaaaagggcaattatccttaaaaaaagttagtaaaagggcaggcaggaaggcaggaactggccaaattgtgattagttaagccatcaggatcagatcaaagctactcttcgctgggtatagagttgttcaattaattaaaagtggtctcagtagtgtgcttttgtggccaactaaccagtactagtacatatggtacattgcatgttttttgtatcatactacctgtttggcacaacttgcaaattgtttttctttttctttcaccatgagaggtgagagctacttccaacacaatgtgctttcgtgtccaagctgttttggcacaccgcttgtccgtatttgtcactgtcaaccatgaattaattactgttatttatactagtcttgcctttgattattatgacaagaatggatcaaagtggttaggtaactagctaggtactaatccttgtttacaatttccccaggtaccataatccagggagagttgttcaaaaatttctggtggcctaggaactgaacttaatattttggacgtgttcaagccaattgttttaaattttcctttgtccgattcatttttaattacatggagaagatgcgtacacacaacacccggccgccaactcgaagcagccacgagggtaggatggacattttacagtcactttatctgtttaccaaaaagtaattattatagtattaatggatatgattatagtgtagtaatactaatggatatgatgttccattacaaatttgacagatcaggactgtactcctagggtaaataacggaccttgatggtcctttatggctaatgacaaccttgatctctgtcactgacaaactaattaattctacccttaattaattaatttcaaatttcaaattcggagtcattgtcactacgcaaaatgtacgtatactcacaaggtatctggagagcaaggttgtacatggtccagttgttagaatctctgcccctcaggatcccaacatctcaaatcatggcctcctgctacactccaaacatgtcaagacaaaacatgagaataacaagacgatcaaaaggaattaagcatgtctatgtgccggccaaaatctccacagaatttaattaattcaaaaggcaacactggtaaccaccaaattgaaatgtctagttcatagcaaatgagatatgcgtggccattaatttgattctcaactaacccctaggacgcatttcaaatcaatccatatagatagtaatgataatttcattgtactattatctgtacttacaaacgcatctaaccgtgaatataattcgttcctacattgccgcaacgactacggattcattaataaattaggtaatagtaggagatgataggtagacctggtccatacggtagtacaaattatttagttattaattcagatctacaaaagtgactgcttggatagatgttactacaagaaatgaattggtagatgaagctaattcacatacaggttaggtctatttacaatgtatatatttactacttgagtttcattaaattacagctcaaattctgaataaattgtaaaattctagcatcaaacatggacatccaactcctacctctctgatatatgattttttttcttttttaaaaaaataaaaacacagcacaaatacaggcgcttatacccactcttttttatgagcacattttaaagacagaccggtatactttaaaaatgacaaatgctcacttcgcctcatctatgatcactaggctaaggtcaaaaccaactcacttgtgtttttaccaaacataaacttaacgtgtactcatacatattcttttcttttctacttttgcaaatcgatactttacttgattatgctttggcacacacccaagtgcatcagtaatcataccaatgggacaatataattccttgattaacaacactaacaaacttgatggctacacatgctattatgaaagcgggacaaaaggtgtaaatagatttgtactcactagccagtatgaattttttgtgtgcaaatatgttgatataatgtgcactttataaagtaatggcgtgcattgcatatccgttctcagtgattagcctaagatgaaaaaaaaataggaggcacctttagtgtctttttttacttaaatttggttaaaaatatattggagtggtgggaatttttttatgtcatatgggaattaaattgatttattactgtgctcgattattgtttattttcgccatgcgtcgcctccctggcacagtcctcatgtgggcaggctcgagctgcatgcaccgtgcactgccatgtgtcacctcctgagaagtccttgcatgcgtagaccttagctgccccgcgcacgatcacattttggattctaagcgtcctcataatcggcccttagccgcgagcctgcagcccatagccaagcttttagtcccaagcaatccagaattccaggacgattagtgttttccagctaatcccttcatcccataatataaaaggttttagctaaacaatccgtcctttctacatggttcttgttatgtggaactccgtaacagagaggaatgggctggcgccttgtgtctcctagcctaggtgtaattttataagggtattggagcatgtacactatatctgtgaggttgacacctatgttccaaattagccttgttatacaagtgcccgataataaaaattgttgatgaacgtgaggatcacccgtagtaactagccacagaggatgagtccgaaccgacaccgtgctaggccttgacatgcaggtcagcagctccattaatctaaatggcgcttacaagggtaagaaaatggctgtgaccatagcataataagggggcaaaaaaaatactatagcatttgtgggggggaacatttgatggtgcaatggcgcggatgagtaatttatgcctgtccggctcggttggtgtgaatgtctgaaatctttgacctgctgctccttgagtgggcacgtctgcaggactgacaatttgctgccaaaacagagataatgcgtgactattctttcctcgtacggatgattattttctcctgtaagcagcgtatatttaggatctgtttggcttggacacgtttggaatgcaattttatggctatggtttgtaagttgagaacacgtaacccatggaaaaaaactaattttgagacgggactttatttttcgttttacttacaccctgtttagtttccaaacaaaacttttcatcttgtcacatcaaatgtttgggcacatgcataaagtattaaatataaaaaaaatttaattatccagattgcgtgtaaattgcgagacgaatcattatgcctaattgcgccatgatttgacaatgtggtgctacagtaaacatttgctaatgacgaattaattaggcttaataaattcgtctcgcggtttacaggcggaatctgtaatttgttttgttattagactacgtttaaactttaaatgtatgtctgtatatccgatgtgacacgtagaaacttttcacccctgaactaaacatggccttaagtgaattgcagtttctactactctcttcatcctaaaatattttttaagataatctttatcataaaatatagctaattgaaatttaaatgttatctcaaatatatatctagggtatataaaaggtgattttactccactgctaccatagggcccatcacctcaccgaccctcaacaccagcaacccctcccatacattaataagtattttattctcatcggtaccctctaccatgcattaataagtattttagacatttctttccaatccttaatatctctaaaatgcccctctgctatatttgggatagagagagtgcctttattactaaagctttatttgaaccatcctttaatatatatatatccactttatactatgtaagattattttttttgtactttagattatcctattcttttttctagtcatatctacactctcctctagcaaaaggtggcctatgcataagaggaggaagattgctgttgtatgagcatgtgctcgagaaaagatccagtatggtcaaaagtacaacaaatgaaaaataacctattccaatatgaaaaaaaaaatagctaaaagtgtagttcaagatgaaattttggtaataaaatgtaaagaaaatacaattaactcattttacttttgatattcctaataagccaacagtaacaacaataaaagaaaagagtgaatcgcatattgggccacatcttattaccagagtgtcaagttgggttaggggtaagccaatattgtcactttgcactaggtatttttgcacaagttttatattggagtggtgtttcctaattctcttctttatttgcttcattgagttgaggccgatatctattagctcgagcgtggtgcaccaatgccactgatattgtcccatgctcgagagtgatcagatagcatcagcgatgggctgtttgatttgggggaagacgagagggtggtgtaaggtgaaacaaatggcaatattatgtggtccaaagtgaaaaccttggctaagacctagtccaacccacgacaatggtcaaaatatatggcctaaactgtaatttactcaaaattatgttccctgaaactcaaagttggttgagcattataagcagtagctcaaacaagtaagtttacctatataaagtttgatatagtttaaagatttactcatagtgtttttacagtgagttaattataaatttttcacgacatgtttaacagcaatccaagtattgtgtcaaatactttgtacttacagaaaagaattatccatgcacataaatcacgtcctcaaatactttagaagctagataggttgttagggacttagggttaaggtttagttgaagctgtccataaagggagtattttatctcttatatacggcattatggctgagtcaatgaattatacctttttttctaaaatataagtatttttaaagatacatcaaaagaaggtagtggtggcgcggtattgaatcagccaccctacctacttccattataaatttcacaagttaccccttcaactttttaatattaaaaaaatatcaaacgtaaatgggtagccacatataaaattagattaagatgaatattcgctataaaaaagggtaacacattaatatattttttttatccatagcaaagagaagatatttaactagtagtcagaaaagaaatatttatagtttacagtagagggagtacataaaatccatgcatgtttatttaggaaccaaccgaaggtaaaaatttaaaatttaagcttaaatttctagctgatttatggggttttatcgtagtttatttgcattttcttttaaactacgaataatgctaatacaaaagttttactcataaatgattcttagttactttgtatttttatggcttatcagtcgtagtagtagtaccaatcagacacatgagattgcctatatatataggtttacctagccagttgtgagctatgcacaacaagttgaagtgcttatattgaaaaggaaaaagtacgaattacccctctaactatcgcggtcgtccaattcacccccctaaactcgagaaccggatatttaacaccccaaactcttaagaccggacaaattacccccctaacatggttcgaagcggttttcagtctacgtggcacacacgtggcgatacagtcagcaaaaacaaataaaaaaacagtggggcccacttgtcagctttttttctctcctccttctctgcctctctctcagtgagcagagagagcacgcggctacggcgaacacaacgcgctctgccttcgcctccaccgccgaccgcgcgaactcgctgcctccatcgccggtcgcccgagcttgctctgcgttcgctagcggacgtggttggacggccacgatgccgacgaccaggacgacggaccgttcgccgcctccaccgcgtcaacgagagaagcagagaagggaagggggaaacttgccggcttccccgacgacctctgcctcaccggctcacatggcgtgttgtgcgacgacgacgacgacgcgtcccacgtcatcggcatctcgctcggctacgtttccgacttctccgtcaacccgagcagcgtagcgccctccgcctccgcctccgccacgctcctcacgtccggcctcctcccgcctccttcccgcgcctacacagcctcttcgtctacgcgcggccgctcccgccgctcaagtggcggctccctcccacgctccaggacctcgtgctcgtcaacaaccccgcgctctccggccgcctcgccatctccgtcgcctgcctcccgctcctctgcaaacgtggtggtggagggcggagcttggtggcgagtggcggtgcgcatggctaggtcactccggccggcggcgagtagcggtgggcgcgatggccggggagggatgtgtggctccggttgaccgcgatgacggtcgatggggacgacgtggatgggtagcgaactcgtcaccgtagcgcaccacctccaatgccctcctcagcgccgcccaccatgccctccgtgccacgtgcgccgcttggctgcctgcctgagaaagagagagagagagagggggggaggccgtggatcccgttgacctctctccgccgcctccaacaccctcctggcctccttagcgccgcccgttgctgccgcgccctccccgcgttccgccgccggcccacgcgcgccaaccgcctatccgccccagcacaccgccgcccgccgcccatcgccggcccccgcgcgacaactgcccatccacccccgagcgtcgccgctcgccgtgcatatatgctctgagcccgagagagagagaggaaaaggaagaggaagaggggaagataagatatgacaggtgggtcccactatttttaaaaaataaaatgctgactggattgccacgtgtacgccacgtaggacaaaaccgctctagattcggttgagggggggtaatttgtccggtattgaaagttcagggtgagcaatgtttggttttcgagtttaggggcgtaaatcggacgaccatgatagttcaggggggtagttcgtactttttcctattgaaaatgaatatagttataacattgtaaggtttacatttttagcctggtctgatctgtttggatgtgtgctcaaggatgcactgatgagcttttcgcatgcttgtgtgatgcagtgtgtacagtatgtgcatatcttctggtttgttaaaaaaagaagtgctggtgaccacataattgggtgtttaatatagtccaaattttactgcttaaccaataaaactagatcccaacatatcagttataattttgtcaaaaagtagaatgtgattaagcagaaacaaccagacaagcactgaaattattttttctggaacactgttgaagcaacagatatatattaatttgtcatatcttttctccatcaaattagttgcgaaaatcaacagaacttttaggtttgacaatgcaacaattaattgtggtgaagattatcccatgcatgaagccatgaagggaaaacaatgtaatagagcacctaaattatgtgttattagcaatagctgccggtagatttccaggtaattaataattaaataaaaccaggctactaactctatatgataaaaataaggtagagctgtgcacatggcaagtactaataaagttgtactgacaaggatttggtgctacgaaatctagctggaggtgctacttaaaatagtaccacaccagatctcagctccttttgttattcgtataaacatttaatagcacaaataacacaaggaaatgcaacaactatgtgaccccttttggatcattgatatgagatcagcatagaaacttaattctttttttccgtttgatcagcatagaaactcccagatgcagacggatattaattaattgtagttgagattgataatggtgattgaatcaacatcatgcagctcagcaaacatccggcctctgtttccttatttttcttggcgaaatttaaattcaagatttgttcttctgatgctacaattttcttagttttagaatatcagagaatgcaaactgaggatgcatatataactgcattatgagaaccggagatgattagggcaccggcatcattcgtctttttaactagatagaatagtatatatgatacttttagttatcattatagaataaatttcacttcgggatatcttttatcatcaatatttcgctctaaaccaccctttaaccaatactttgaatcggataattttgtctttgttttattttggatcaccccgactcttttctcaaacatgagtacgccagctcctattcgtcaataaattccctcagtcgtatatgctcgtttctttgacgtatgacaaattgaatatggatggataaaattaagagttgatggtggtccaaagtaccacaagtgtaaaattactcggtccaaagtgaaaacgttagttggtgatccaaaatgaaataatgataataaaaggtgactcaaagtaaaattgactctttctactataattaaaaagagctagttttcatataaactgtggccccgttaaaacacatgaatttcacaaaaattcaaccttattttcagcagagtactggtcaaatctctacttcttaaaacggaatagcagtgatgataagtggtaaatctaccaccaaccctaccaactcgtttagtttgcggaaagaaatctatactccaaaatatagtagtggtaataatgagtgataaatctacaccatcacctcttacgattttgaaaagaaaaaaatagcagcgtggagagctagagcgccttgccaacttcactaattccctactttcttgaaaaataaaaggataatgtgagtccagagggccaacgtgccagtaaaaaaatatacataaattaaaaatggtatataagaaagagagaaataacaggttaatgacccgttgcaacaaattcaaggacaatatgctaataaaaaatatgttaaaaagtttgatgccagtcccactaatcacagtagcattagtcaaatatttccgactgtaggtagtatatactcgctccttcaaaaaaaaaatcaagttatggagtttgaattttgtccgataaaaaaccaaattctaccctcccacctattctcatcatgtaaaacgagaagttttattccttcaatacaatttacctacctattactcttactacttttttcaatgtttaaggacagtcattctcactctccactaatttttactctctactaatttctcctatgatgctaggaatggactttgtgggacggaaggagtactatggtgtcctaaatcagtccggtttctcataatgcagctaaccttagttaattagcattctgatattctaaaactagaaaattgtagcatcatcagaacgtacagatcttgaaattaaatttcgcgaacaattttctgcaggagttagatttttttttttgtctctgaacgacacagtacaaaacaattcattgactggcgcaagacacgaaaggtgatgaagtcctagagaaatatgcagggtaaaaaaaaagtactctgacaggagcgaaatcgacgagatgcacagagatccgacaaagcttgggagatcgatgtatatatgtttctttcacgatgcatcgtttcaggttattatcgtattggaagctttggaacagaagctgtaaattacggagaacgaggtcaacgaggtacactcctgtcttaatttgttgggcaacacaaatgcttcttgtttgtttggacttgatttgaatacaaaccagtaatataacaatgaactgttttgtattatgtcggtatcagttaattattgtgcttggacctcgagttagcactagtaattatcataatatttacaatcgaacaacctttatatttatttagtttgacccatgtggtcgtgtacaatcattaattttgtttcgaagcttaggttttaaaaatgattaatttggaccatataccaaggggcaagagccctttgaaaataaagaagttgagaatgcaaatgaattccaaaaatattacaaatgatggaataacatgtattgttcttttcttttgctcgagggatgactagcttgttcagtctaggggcggatccatggcccgacgatccaggtagttgttggatagtctcacattggttgtggaagggtaatggacctaatatataagtgagggagtctcttacctcattagctagcttttggggtgagaaaggctatttacgatattaaatttggtatcagagcctgactaggtcaacatttctgactcgagagacaaagtgtgtgaagctctaatggaccgtaggtgcctgagggacctgagggaccgtagggcgtgaatggttaagagacactaatgtgtgaatggggtgattgttgaatagtctcactattggttgtggaaggacaaataatgacttaatatataagtgggggacccttcacctcattggctagcttgactgtggggataacggtgaaggggcagtgaacggctgagagacaccaatgtgtgagggggagtttgttgaatagtcctatattggttgtggaagggcaagtgacctaatatataagtgaggagcccctcacctcattggctaactttttgagtgggaaataccatttacgatcctacaagaccggcggtaccatggcttttagaccggcaacaccattgcagttagaccgacagcgatgacagtaggaggtggtgacgcgactggttgggccggccgatctacaccggtcagaccaacagtacagggacggtcagaccggcgcataacctgcggttagaccgatctccaccgacttgaggataacttttaattctgctaaaagttccagtttttgggtacttcaatcattcaccctcatttggtggcttggttcttactattcgatcctatagtagtcgcttgggctcgccgacggattgcaccggatagctactaactctatagttcatatctaaaatctttttacacatgtgcttaaccaggctcttaaagatttctacatccaccgccggttcagtccttcatgacttccaaaccaaatagattgaggaaaatataagctttctatttactagcttcaaaagttgtgatcggaggtggttcacaacaaacaattcaataatttaggagagaacgcttctacaaaatcatggagagagttaaaatatgacttgttagattgagcctacgacatgacacctaaaaaatagttcagcgagatttactacgtgcaaaatgataaatcgggaaaaaaatccacattttttccctcagctatatggccttggtaatttttgtttctcaactataaacccggttgctatctatcctttaactcaacagttaacatttcattctttgccttgaaaaaggtagtttctgatgacgtgacatatcctagttaacaaattaaaataaaaaataataatatgtaggatatatgggtataggaggaaatggaggcgaggatgatatgcttgttctatattttgttattattttttattactgatcgatactcttttcatcctataaaaaaccaatctagtaccggataaaaacattctattactataattctagactaatgtatgtctataattctggactaaggaatgtctagatttatagtattaggatgtgtcatatccgataattgattttctaggtacgaaggaagtatgatagtgtcgacactctttatccatgtaagttcattgtagaggttaccttaccaaccacattagcttgaaccaagggatgtaatatgaaccatttaagagttgttggactaatagtgaaaaatggtttggttgtcgaggcaccaaaagctagactaaggatgcgttagaaatagcttattagcctagcttatttgctgtacgtaaaatgagaaagagaactagcgtataactaattaagtagtattaactatttataaattttaaaatgtatttatttgattttttaaataaacttctacataatttttttacgaagagtgcacgtttagctatttaaaagtgtgctcatgaaaaaacgatgaagtcgcacagcggaattgctgattcaaactcagccattaaatgccatagttaagtaagtcttgatttatctctttcaaaaatatccaaattcgtcagcaaaataattcttacttgaatttcatccaacaaactctttaattacgaatcctttttctcctagcttactactgtcatttaaattatacattatgctcattgtattgctacaaaatcttcagcaatgctgaaaaaaaatactttacttttctcgacacttaaggcttgacacatccaatgatccaaacgattttaagatatctttaggagtactattcgttatcttgagaagataagtaaatacatatacataaaattattcataaaaaaccaaatttcaaaactaaaaatcgctttgcggccccatcgtaagccaaacgacatatttacaaacgaaaaataatttgtgaataaaacttttatatacgtattcttagcgatctaaaaggaaagattgaaaaataaattttgataaaaaaaaccctaaaatcaactctaagtttaaggttaaaaaatctaaattttggcaaataagcataagcacaagaaaaaaagagcccttggattataaaaagaggggggtggctagctcgcgcgcacacgcgaggacgttaaggtgcgcgcatacggaccttcgctttagtagcgcttagcgcttttctcgaaagaaaacaatgcgcatgacgctacggtaaagtaaagtgattaacgaaaatgctacagtaatttatcaataaaaaaataaaaacaattgattttgaaattttgagttaaaagttttcaaatattgacttgaaaattttaaaaataagatttgaaagtttttgaattttgagttgaaagtttttgaattttgagttgaaagttttcgattttaatatgaaaagttttcaattttgagttgaaaatttttaaattttgagttgaaagttttcagatctcgagttaaaagtttcaaacctgagtcgaaacttttcaaatctgagtcaaaagttttcaaatctcaagttgaaagttttcaaatcggagttgaaagttttcaaatctgagttgaaagttttcaaatctaagttgaaaattttcaaaatttgacttcaaaatttaaatcttaagtcaaaagttttcaaatgtaatttaaaaattttctatctattagtaaaaaatctcaaagaaaaactttcattaattactatcattatccttaaacaattagttacgttaaacgcgcgctatgaaaaaaagaatctcgatcagcgctggcggcaccacgcatacgggccgtgtgggccggaagtgctcgcccacggcgcgtacgcgcgaattaggaatcctatcttactataaagttatcccccactaactccttaagcttaacatgcaaagatgccacatcatcatccactaacaagatgccacattatcatccactaattaacaagatgccacatcatcatccactaacaatcatcacatttaaacatcatgcaaacaagctatatctttatagtttttataatttaagagcgtttcaaatacaaatatgttaaattatcatccaacataattcacataatatttcaatgtatatctttattatgttttatgatatcctatatacctatatagttcatcctcacttagttagtgtttaaatgattaatctatggtctaaattattttttccttttattcttttaactaagttatatcacatcaattgtttttagcctttagatgattaatctacgatacaaactatctctctacttttcttctttcataaagtcacaccaccttactatttatgtttgaatcaccattctacatactatttaaattatccttaagcttaacatgcaaagatgccacatcatcatccactaacaatcatcacatttaaacatcatgcaaacatgctatatctttatagtttttatattttaagagcttttcaaatataaatatgttaaattattatccaacataattcacataatatttcaatgtatatctttattatgttttatgatatcctatatacttatatagttcatccttacttagttagtgtttaaatgattaatctatggtccaaattatttttccttttattcttctaactaagtcatatcacatcaattgtttttagcctttagatgattaatctacggtacaaactatctccctacttttcttttttcataaagtcataccaccttactatttatgtttgaatcaccattctacatactatttaaatttaaattatcataaaccacattaatttacttaatctgatgttatctagctatcttacatgttattattttattgttatcatactaaatttccgcagcaatgcgcggggtttcacctattcgtgtgaaaagagtgtcaaccactcctatctgcaatctcccaactccgtgggccaaggcctggcccatccaaacgagccttttgtgggccttctcgcagtccagccgggcagccggctaggcccgaatcgacgcgggcccaccaggtcgggcaaccaacggtgggggcccaccgccatccgaccgtttcgacggcttccccgtccgtaaccgctaacgccgttacgtctccgtttccgctccgtcaccccgtttcaccgctctccggacctccggtcaatcgcagtcaaaaggctccccgctcccccgtccccttccccctctcgccctctcctacccaacttctcgaactctccaaaccctagctttttcctcctccccctcctccgcgaatcttccatgcccgacggctatccggcggcgccgcccgggatggagcgccctgccccggaggcggcggctgcggcggcggagccccctggggcgaaggcggaggaggaggaggaggggccgaaggatgtgggggtgaagggtacggggaaggagaaggagacagagaaggttgaggccgagaaggagatggaggggaaggggaaggggaaggagtcgatggaggtggaggaggggaaggagaaggagggtaaggggaaggcgaaggagaaggagaaggagacgaaggtgaaggtgaaggaggagggtggggaagagaaggagaaggggaaggttgaggtggtggaggcaaagcggcggccggctggtgttggcgcggagacacccatcctagcggtgccgatggtggccgtgccatgcttcttggcgtctcctgcatttgcggtgagtggtgccatttctctttgtcactaactaggggcattttgttttaaggcgagggagagatccatgggcggagaatattagggttttgatgggttgggttcacctcggtcaggttatccgtggcatgttagtgatgattttattctggtcactagttagcccatcataactgcagctaaattgtagcgtgatgccatttctatgatacgaatcgctagaaatgggcaggtttgcaatgccgtatcccctctgtctgtttgtgatagattttgggaggccacctgcattggatttaggatattcttgatactctctatctgaagcaagcttagttgatggtaactgtgggaaattatgcactgctattgtggggggatatggtgtaacgttgttttattgaaaaataacttcctacatataattgaacaacatttacaagactgatttccattatatatatatatatatatatatattttttttttcatcatactgcctaatataatgctgtgtgatgtaatggaacatgaaattccattgaattggcataagtttacatgttaaggtatgattgaacaaattaatattgtactagtagctattctgtttatttaacactatgttatgctatctgcatgctatcttgttagtctttagttgaacacagataataaaacttgaatatagtccaatgagaatcccgtcaaatcccgtcaaacttgaatatagtccatatcaacaaagttcagattatctctcttttaactcgacatatgttctgtattttactttggtggttttcttacatgtgtgcaaataatcattatggaaactagggtcacttttcaatgagccatcaagcagctttggcgagtgtgacggctcaggcacaaatacaattgcagtcaccaaccacaccatattcagaagggctgcccagtccatttcctataacacctaaagctgtaatgcccctgcagcgatcaccttcaggaactgaagggagtgttcgcagatcagtgttagagaagtcagcctcatttcagtcaagaccacacaatcatgtgtctgtaaacatggttggtgatggcttcaactggaggaagtatggtcagaagcaagtgaaaagtagtgaaaattccaggagttactatagatgtaccaactctaattgcttggctaaaaagaaggtcgagcattgtcctgatggccgcgtggtggaaatcatttacagaggaacacataatcatgaaccgccacaaaagaccagatttgtgaaagagagagtggctcatattactgcttcctctggagatgatgaaaccttgggacttgtgaacaatgaaattatagaatccccgtcaccgggatgtaaattagagccgggtgctgtctctgaagcttctgaacagcagcttttttgctcaagtgattgtgaaggtgatgctggtaacaaatcagaagatgatcatcctagcacagagcctcagccaaaacgaaggtgaattgtagtactaggctaatttattcatattttgtcattgagttgtccctaactttgttttctacatcttattgttctatcagcagaataattgaaactagcacacctttgactccagttctcagaactgttagagagcaaaagattattgtacaggctggaaagacgagtgatgggtatagatggcgcaaatatggacagaaaattgttaagggaaatccaaaccctaggtatgaattggtatctcgtccaattgatcattcatgctgcatctttttcgttaatttgaatgttgcttctgtttttattatttgagtaccctccaattcaagtacaacagtctagagcaaatttataaattgttcactttgccttcaaataggattaattgcctaaacccacttgccatattgattgtcttgttatttctgaggatcttagcacatattcctccactgaggagtcatacctatttttcacttgctagttttttttggttattatctcctgtgatatgttattattgttattggttttttttctttttgttgttatatagtatattattagtactactagtagaggcatgcgaagaaatttgagaaaatagaaggaaggaaaaaagagaaggaaaaagaaaaggaagaggagaaaaatggaaataataatgcaaagagttaattgcatattggaccggctttctttatcatggttgcaacttgagcaagaaatgctattgttttcactttgggctagtaatttttacaaaatgttgcacttaggacctagtgttcttcttccagctctgctccctcactctctctaccttcagtttgagattcacatgcctggctgtagttggttccggtagagatggagctcaagctccgccagtacagtatatgctcgagctctactcagccttcgccacccctgccacacccacattcattcgtgctcaagatttgatgtgcattgttgattaagtgccctagccccaatcaagctagtgcagccatagatgaacttaggctagaatgggcctattgactagttggtggagcagaagtgtggagtgataaacacatggtgttagaatttcccaccgtgtcaccgtgattcattggatatgcgcttgagctcaagctagagctccgtcgtgcgccgtgtcgagctcaagccggagactaccacacactcaagctcaggcgctaacgtaggtcaagcacgtggatgggaccaaaacagaggaagaagaagagaagagtggtgagcttgaaccaaaacaggggagagagaagagaagaggagatccagaggaagaagaagaccggtccaatatgaaagtttttgcaaagatttcttgttccaacttgcaacaatggtcaataagagtggcccagtatgcaatttactaacgcaaaatacatttccccccttcctgctgcactgtagcgggaagggggttaaatgcattttgctgccacggtgtgctgcagagagccaaatgcaaaatgcttgccagcgtggagggcctcattgcctagtcctacattttggtgtgatgcacgattgcacacgtgcaccaaacaagggcattttggtcataacttccaaacaaatctcacctagttctatatcctacctccatacttgatctcgctagtgtcagtgtcatgcactgagttatcacaacaatgcccagtgcaccagagtgaccattctattgatggaaaaacagtgcgccgccagatctgatcctgtaaaatgtgatcctatatactgctctgcttccaatctatcatctccactcggccctgttcgtttctcctactagtagaggataaaattttggattatcgtggcacgcttttcaaactactaaacgatgcgtttcgtgcgaaaattttctatatgaaagttgttctaaaatatcagattagtccatttttgaagtttgtaataattaaaacttaattaatcacatgttattaccacctcgttttgcgtaaaacacttaatctctatcttcatcttcatcttcaggagattcaaacaccacctgaatgttgttgacaccagtcacaatttcacgctcaccttcatcactttacctgtgttttcataaatagatagccttcatatattttgtgtgttatgaagcattatctttctggacaaattttgctacagccatgctgcaatgaattctacttgcatagcgcaactagttgcacaaatatagtagttacaagataatgaaggtacaggttaataccacttttatctatttacttaagaaattactgtaaaatctctatgcaacaaaacctcgttaagcttgcataaatcaatttaggtctaatgctcacatgaaataaaattgattttttttttggtccttgcatcctattttccaagcttgtcaattctattccagaggtcattctggtttgctcttggatggaacattctgataacagctgatacatgtgtactgtttaataaaataacataagtttattattccaatcatacgtgtttaattgtggatatataatattccaatgaatataagtttaagaatgcatttatattataatttagattttagaagcaagtttaagtgatgcggttattaggttgtgtatttagagtgcttttgagctgaggctggagtgaagatggaatgcgatgtatgctagtcatgtacttggggtgacggcaaagttagagttgcatagtttctaaattttcactcaacgctatgtttgaagcatgtagtcctaggggcattctcatttttgcgatgtctaccagcaaataacacaaattttgagtcatgtagcaaattttgctgcgaaacaaggcaaatggtaactcaaattttggtcggtatcagtatcgccagaatggtgctggaattgataggcttttcttttctgagaaaagatagcctattattttttttaaccagacgtcctgttttgcactgtacaatttctattagtggtaggcttgctgttcttttacactgaaaaagaagttcatttcattcttttttctggtagtgtgtacaacaagttaatatgagtgattaaccaagcaggagctactgcattttttataagttcttattaatttcttttgttctatacaggagctactaccgttgtactcatgatgggtgccctgtccgtaagcatgttgagaaggcaccagacgatgataacaatattgttgtgacctatgaaggtaagcacaaccatgatcaaccgtttagaaacaacagtgagtcgaaggatgggcctgttcctatgatcattccagcagagacaacatctgagcagcccagcacaatgacctcaacatcagaacagaaacagccgatcagtctgctgaaggatggcggcgatgagcccatgaagggcaagacttcagaaatcggtggtgagaaggcagtggagtctgcgcaaacccttatcagcattaaaactaatcccgatgacatgaagaataccctcttgaaagatacttccgcggtagttcctgtccaaaataattgatcctgtgaggttagggttgattcgattaatgtattagtttgtggtatttattggttcggggagctattgttgtgttagattctgtacatgagttgagggccggcattctgtggagcaccattggatagaagcatctaggctcgggaagccatgatacttacagttgtcccccttgtatagatctccaaacccctagtgtgtataggtactgtatcgcttactgaggctaagcaacaaggagacctgagaaacttcatgtgtggggtgctctgcttggattcattgcacatctaagccgatccatgccatgatatgtttattgtatctggtgttatatcataaaaacgtgcaaggtgtatgccatttccattctataaacagagtaacacaggctgcatcgcttgtctgctcggtgagcagtagacaaggtgagtttgggcatttcatgcggttgtatgtggaacatttgtagctgaactgaacgactacaagacacattgaatcagagccaggcaaggagcttttgctgctcacttgctcaggcgagctcactgtaaccgtgcagatctatgtacagtgcaacaagaagatgatggtcttcatcatgtttgagccaatgcaacgcttggggcggccttgaactccttcaccgccttcttgacggcctcgacgtcgatgtcgatcagcttcccggtctccgacgcgacgacggtgcagcccttcttctcctccaagtacggcaggaacagcctcgccttctccttggatgagaagagagccacgctgcaaagattcaggaaaacatcaatgccatgagcagttcatcctctgaaataataaccattccaaaatctggagatgcagatcgcagctcagttgatctaaccatggcttgtccctggcgttggcgagctggacggcggcggtgttggtcgcgacgacgccgacggagtcgttgatgaggcaggtgagcttatcatggatcacaaaaagaaaacactcagtaataaagaattgtaatgttacctgtgaaagatgatctaaggtgttttcagattgcaaagtgattgtaatgaagaagcatcaaagaacctacttggccaggagtggtgatgaacaggatattggtgtccttccccacagtctcctcaacctcttccctgtgcttctgatgagggatcacaaacagaggcttcagaccattgtcttcagagctgccaagacaccaccatttttttggctttagttctaccttctcacaatcggtaccaagctggaaatgtaagtgtaagagcagccgtgcttgagtgagtgagtgaggtgaggtgaaaaacctgatctccttggcgatctcagcccaatgctcgagagggaggaggcagtcatcgtcccccctcgacctcatgttggcgaaggagtcggaggcgatgccgtggacgacgacgaacttgcccttctcgacgccggcacggctatatttgtcctccacgaacgctcggagcttcttggagatggacacccgcaacggcggtaccgggtgctccggcacacccttcgctggccgcccaatccactccaacatgtcctgatacctaatccatccagttgcacactcttcgaaatcagaaagcattttgcaagaattttataggattttgacggtaattggttcaactcttctacaagaataattgagcaagattcctaagttgcaaaagaagagctaggcaatatctgctttactataagggttataactctgcctctgcttgtttgtcttattagccgcaaccaaatattaaattttaaaatttaattttagatttgattttgagttttccttatcatagtttatttctcaatattgacttttgaaccattaagaacagttaaaagttttgccaacaaatcatattcggttgcctagttcattttgttatggcttttcaacctaaatcaaaggcaaaagatgagacagttgcccctatataaattaaatgcaactatacagcacaagaatgccaaagcagtaactttttcggatgaggaaattataacagttatgaaccaaggggaggcgaaaccgcggagaagaggaggatgatgatcttacatgttgtagccgctgtcggcgaggttggtggtcggcggccggaacatctcggtgaggaacagcccggcgccggcgctgttgacgttggggtaaacatagccgaccttgtcgcgggccgacgacatgaagaggaagagcgcgtgccctatcccggccaacttggtcgatatgatcagatcatagtacctgttctgccaacctcaacacaaaatcaagcttcagttggttgaatctttcatgataaatataatctaatcaaaatactgagcatatgtggtggggaagcaacataattaagcaggtttatctgatattattatgtttagagaatcacaataaattttgaacaaattcagcgcatatatcgaaccggctcgagatgtgcaactccaatggtttgtttgaaatttgtcgaaattaatgaaaaaccgattactcactatggctcgaaagtcgaaatctgctgaccattagagaatgtaaacctgggctgggcatgacacttctgaaggagagagaattctaatctctcgagaggatatcttctcgtgtaatttttattttctaaattcaatgtaattggttgtgaaaaattctaaaaaaaaatgacaatgcataataacatctattactccataaaaacatatttaaattcgatctatgctttgaggaaacaaaagacgaattcagacatgacactactcatatgttggatttttttttaattatttctcaatgtgtgagttgaattttgacttgatttttttttgagtactttacacgtacggtgtgtatgttgtcaattttgaaagaattcttaacaattatttagatgaagtttgaataaacgagtggacataatcccttctcgatcgagtttaaaacatatacatccccactttgagtgactatttctgtacgtagcagtgacataatttttggtttaccttgagcacgccgagctggtgggtgtactcggcgggctcgggccagtcgtcgtcggggtcgtagacgtcggcgtacctgacgttcttgcacatctcgtacacctgcttccccctcgccgacgccaccacgtccaccaccaccccggggtacctgtcccgcagcagctgcaccaccgggaagaagagcacgttctcgtacaccccgccggacaccacgcagcacgcccgccgcacgtcgcgccgcaccttggatgccaggctatccagctccgggttgtaccccgccgggaaccgcaggaacccgtacgggttcgccgggtcctccggcggccgcgggtcctcctcctgcttcccccccgagaacgcgccgcggtagtcgaactcgtcgtcgggcccgtcgtcgaacgggtccagccacgggttcttcttcttcgccgacgcccgcgccacgcccgcgccgccgcgccgccctagctgcagcaggtggcagcagcattgcctcgctatcggcagcgacggcggtgaggggagcttcgccggcgtggccatggacgtcgacatggttggcgtctgcatgcttgttgcagagtgagtgtgctgatgagttgctttggatattgctattgtttttatttatttatttctatgttttttgttttttggtgtgtggaggaggggtttggatgtggtgggttagggatgtgtggaggaggaaggataaagtgcacgatgatggtgccaattggtcctgttttcttgtgccaccattcctcgatctcctttaatttggttcatcctttttgttgatgtggcagctggcaaaatccctccgaaaattcttttggagtttggattatacttgtgagtttctacaaggatctttcagaatggagtaattgtagaagatttatctttatgacagctgaactaatcctatcttactataaaattaccccccactaactcatttaagcttaacatgcaaagatgccacatcattatccactaattaaccagatgccacatcatcatccactaacgatcatcacatttaaacatcatgcaaacatgttatattatctataattttatagtttttataatttaagagcttttaaaatacaagcatgttaaattatcatcccacataattcacacaatgtttcaatgtatatctatattttataaaatcctactccatccgtttcacaatgtaagtcattatagcatttcccacattcatattgatgttatgacttacattgtgaaacggaggaagtacatacttatatagttcatcctcacttagttagtgcttaaatgattaatctatggtccaaattatatttctccttttttcctctaattaagtcatatcacatcaattgtttttagcctttaaatgattaatctacggtccaaactaccctacttttcttcttccataaagtcataccaccttactttttacgtttgaatcaccattctacatactatttaaatttaaattatcataaatcacattaatttacttaatttgatgttatctagctatctgtcggagatatgggcccgggggtatgtaaagtgaggggaatttaccttcccatccagctacgtggccctgcagcctggccctacccccgcacctcgcgaatcgcagaagcggccggggggcctcagggtgccacgtcatgcccctcgggccctcgcgctgccctgccccgaggacctcgcccgactgccatgtggcagggggagcgagcggggaggggacccaggctgaaccgctatcaatgcgcgcggcgccccaactgcccctcaccgcatttaatgcggtaggggcagacatgcggtgccgtccgactgacgcacgtcagtcaggactaaccagtctgtcaccggcctgttgccggtcacgtctgactggacgggcggccgtgcccccacgtcgcctttttctccagcggagtggaggtaggtgtgtcctgtcacatcggagcgtcatccggagttctcccgacatgaggaggacggccaaaggtctctgcccatttataagggaatgacagggctgtcccccgtgttaggaagggggcggcgctgggtcccactcaaggacgggccgctgcttagcttccgggtgaaggcacagatcgtggcccggtcaaggtaaagtgggtccccctcccatgaaagagtaggtagaggcgatgcatgtggtatccccttgaactataaaaggaggaccttgcccaccgagaaaagggacgactctcagtaagcctaaactctagaataagaagagcgagagccctctccggagtttaggggcccttgtagcactcaaccataatcccacacacaggagtagggtgttacgctccatagcggcccaaacctgtataatcttggtgcccgcacgcgatttagtagcattcagggcggatacgtgatttctaaaggcgagctctttccctcggccgaactcacaaaaggggatctcacgatctcccgctagagaggatcactcctcgacactatcttacacattattttttcattgttatcatactaaattcctgcagcaatgcgcagggtttcagctagttctttataataatttgccttccaagggattctcactgaagcaagcccattttagaagctaagggaggtaacgtaagccatacaaagataatatagtgcatagctttttggagttaggtgaattctaagagcaaggacaataatatagggcctagtttagttctcaactttttcttcaaacttccaacttttccatcacatcaaaactttcctacatatacgaacttccaactgttccgtcacatcattctaatttcaatcaaacttccaattttggtgtgaactaaacatagatgtctatttatagtaatttttatccaactataaataaccttgtagccaataaacacaacaactaactatactactatggctcacactttgcatgaaaaaatattttaatctcccacgatggtcccttcccaggagcttgatgaaaaaaaggaaggttgggccccatagtgttgcttactttttcttgggacaagcatatagcttgtttctctaacctcgtcttctttctcttccacctaggtaggcaataatttgatgtggagaccactatcatccgctgatataggtttattgtacctgctcttacgtagtatgataatataggatctgttcagttgtctgtgctagattgtttcatactgtggatatagatatagcatgtctagttgttactcagataaaactaacgatatatgcctttcaatattcttaagataataaaaattcattctgatatttgttccaaaaaaagctacaccaaattattatagaggttactagataaaaacgactgcgagttaccaaatcttaacttgattaaaaagaacacttaaaacaccatctcaaagacaaagattttcatatgtggttagtgagaatctatgtaaccatgcgcataaccatagtttcttcacaatggcttatccttgttttcattaaactaaaaatatagtcttcaaaatcagcggccgatcactgtgttaatcaaattgcacacacatcatcatcagtgaactgaaacgaaccaaagtgcaaaataatgttggcccagataattgcaaatcgatccaacaaaaacacatctaccaagcacgccatatcaacatggagcctccgatacgacatctaggacgttttcattgctattctagccttatggaactaagttttcaatcaaagattatacttcgaagcacaaagatgaggaagggggcgtcaacgacattgccttcaatgcaagaagctatgtggcgtccacaggtgtcactgacatcaatgctctcctagtccaagatttgcattgatatgagctcaacctcctcctcagtgttgagcggcaacaacgatagtgagggaggtggttggccatgggaaggaagggggtgaggcatgcactctggtggcaccctgtcacaccatgagagtccgatgaagctattgataagatgaaggcatctcgtagccctagcaacaactctgatggtgacaaaaatagcacggttttatatatagatcaccggaagccaaatccagctagaccccaccactaccttcctcaagggtcaccatttctaacgttccccttcagcgatggtgaggaacgggaatcgccttgcttacatgattggtgacgcagaaggtggtattatttaccaacacacaatttctaacatttcaagtattatttaccaacacacaattctaacatttcaagtctcgtatgaatcaaaccacaataacaacttgattgaataaaagtagatgaaacatgtatgagcaatagtgcctcaaatctcacatattaaatgcactgataatctaagtcaaagcatgggagtgctaagtgctaagataacaaacttagagcaagtttaatagtatagccaactactagctccaatttatctatagccaatctaatagctcatttatataatagttacatactatactattattactccaatttacatgactttggtagtatacaagaaataaataaaaattaaacttaggtgcaccagccactgctgagttgcaaaaactggactcacgtgtcatccagtgaaaacatcaattcgcggactacaccacccccggacgcagtggagcatcgccgatcgccaccgacagatcttagctccatttcctcaagatacgaaacctcctacccttatctcactgactagtgggcccacgcagcatgatggtccacacgtcagtgggtgtgaaaggatacttttcccaccaccgcaacaccatcaccaaccagcctttttttcttcctcctctctgtggccgcgcacctaaccgttctcactgacgtgtgggacatgacgggcttggtggggcccacctgcctgaatttggcatgaacgcaagcaaagccccccacccacgtcgttgcgacgttcccgtctgtcttgctacacacaccaagacaaagtttacccgcaccaaacagccactcactgacatgtgggccgaccggggtgcccctctggtggaccccataggtcagccagatgtaggctctgccggattcgatttacagatgcttggtgcacccactgacacgagggcccgcacgcccgcgaaaaataccggtagaaggaagcatttccagacgcggcacggtacgtgcacagatagttcgccgacgagatgcacaaagaactcactgacatgtgggcccagatagccggtaagctcaaggtggacccacatctcagtgtgcgcgtagtggagtggctcacgtgcgcggagcgaggcgtggtttgacccctctcgtctcgctcgtcgcggccacctctctttctctctctctccattaaaacagcacctcgtcgcaacggaaaagcgcaatctcgtctcgccattctctctctcacacacacacctcgcgtcgcctccctccccgagcgagcgagcgagcgtgcgcgtgcctacgccctcctctctaccgccatggcgatctcgccggtggcggcgatggcgctggccatcgccctcgcggcgctctgcctcgcggggctggccgccgggttctacctcccaggcgtcgcgcccaacaacttcgacaaggtgtgcccactccttcctctactctcccctttatcctctttcacggcatgatctctccgctgcgtttgttttttttttgtcggatctggggttggggtggccagatctacggcccgcgctgttgcgcccgccgcgagatctgggtgtcggtggtggtggcatgtactagggggggggggggtagattaggatgcgagatcgtgcgccaatgcaggtggtgttgggaatgtatgtctggatgctgagaaacccacgctgaaatcatgttccgcgttcagagtgcgttgaatgaaaccgtgtgcgtagggagacgcgctgatcaatgtgcgcggtttgctgcatcaacaaatacctgtaaggtggcatcgtagtatgagcttgttgggtattgatgcttaattgcggttgctatcggtcatggtaggttattaagtgatgtgtagttttggaagatatgattggacattttggggctgtaaacctgggtagtacatgtccaaacaaaacttagtttttcccaattggggtcccaacttgttttaccatgtgacaaacaatagtttaggtcgtatgtttttaattgttcaccttccaaaaaaaatggttatactttttttagttgattccgtttctatgtttgtgctagttattaacatctgactgtctttgtagtagtcatgctcatagatgaaacgaagggtttaacgctttcagtatgcatcaatatgagactaccggacaaattacttgctatttctaactatagtgatatttctttgtttacagaaagatcctcttcaagtgaaagtcaacaaattgacatcaatcaagacccagcttccctactcttatgtcgacagtgctcaaaatctcggtgaagttcttcgtggtgatcgaatcgagaactctccatacacggtttgttactctatcgcgttttctttgattatttcttgatatattggtcctaaggttaatattttaacttctattctttccagtttgaaatgagagagcctcaaatgctgtcaaatagtctgcaagatttctgtcggggagaaagaagcaaagattctcaaggaaaagattgaagatgagtaccgtgtgaacatgcaagctagtgtaacttggtttcttgattctaagagcttattcatggctgccaaatattctaaacattcattttctcaacatgattcttgacaacttacctctagttgttccaattaaaagaatggaccaagaaggtgcatatttctatcagcatgtcttccatgttggagccaaaggacaatatgcaagggtaagtgtaactttgagtattgatcacatgctatgaaaatgcaaagttcttatatcgtgcactttcttccctttttctgtttgtacttggcagagcaaggatgaaaagagcttcattcacaaccatttatcatttactgtgaagtatcacagggatgcccaaaggatgtttctaggatagttgcatttgaagtgaaaccatacagttatgctgcatgtgatttattaaacaagtaggcctttgaagtatttggatgttgactgtccttcctgctgttaaatttacactaaaaactatgacatatgctgcagcgttaaacatgaatacgaaggacagtggaatgacaagaagacccgcctgaccacttgtgatcctcatgcaaaacatataattacatcatctgattctccccaggaggttgaagttggcaaagacataatatttacttatgatgtggatttcaaggtgagatatatgtgcacttttttccgatcgttctgctctaatgaaatgatcgcagtagctagaaattgttcagtgtgcactagatggagtgctaatattttgttaccatctatgcgtccttttgactattctgtcaatttgcaggagagtgatatcaagtgggcatctcgctggctgggatacctatctactgatgacggatgaccaaatccactggttttccattgtgaattccctcatgattatcctcttcctttctggaatggttgcaatgatcatgctccgaaccctttaccgggatatctccaagtataaccagcttgggactcaggaagaagcccaacaagaaacaagatggaagcttgtccatggtgatgttt

SEQ ID NO: 28759 - DNA, 2169 bp, Oryza sativa
aggggtggactgatgacagcgatgctcttgctttgggtattcatggggttgctcgctggctactcttcttcaagtctttacaagttgttcaagggcgcagaatggaagaacattgcattgaggacagccttcactttccctggcagtgtatttgctattttcttcttcctgaattctcttatttgggggcagaagtcctcaggcgcagttccattcaccacaatgtttgcccttgtcctcctttggttcggtatctcagtgcccctagtatttgttgggagtttccttggcttcaagaagcctgcaattgaggatcccgtgaaaacaaacaagatacccaggcagattcctgagcaggcctggtacatgaacccgatcttctcaattctaattggaggaatccttccatttggtgctgtattcattgagctctttatcctgacctccatctggctgcaccagttctactacatctttgggttctgatcctggtcataacttgtgctgagatctcgatcgtgctctgctacttccagctgtgcagcgaggactatctgtggtggtggaggtcatacttgacatcagggtcttctgctatctacctgttcttgtatgcaaccttctacttcttcacaaagctggagatcacaaagtttgtgtcagctgttctgtacttcggttacatgcttaccgcctcatatgccttctttgccttgactggtacgatcggattctacgcatgcttcctgttcactaggctgatgtactcttctgtcaagatcgagtaaagaggctgtcttgcctaattctttattgccacggcaagtactgatcctgcggagtgcggacagtgaatatggtctccaagcttagttgcctgtggcatcagttttgagttttcaaagctggtagttaagatgaactggtgatttgttatcccatgattcaggtatcatagctagctcagtggttttttgttttcattttcttttaccttttcttctttttatggatttagcccttggatcacggcctattaagtggttgttgcagagttaattgtatacgaatgctgagtaatccatttctctccctatcagaatgttatgtacttgttgacctataatgcgactaccattaaagatattactgcagttgaaatattcatcttcctatttcctttttggtcattcagattttgatatatgaaagcatgaggttgggtattattcagactactgtgtattctgtcgcctgaaatgtttcacggggaaaagaagccagacagtctctcgtaagacctgttcttttttatgttttatagctgatgcagctataaaatattggtaaaatttgttacaaaacatcaaaagattactccaaactcaacctaggagtttttgtctagtacaatgaatcccctcctaatacaacgaatctagaccattcccttctaatacaacgtatctagatctctcctaggttgagtttttttaatggagggagtacaatctttgcatagacaataaaataatatatagtacatctaagtgagaatccgtgtcaaatgtcagttttgctcttttcttctttcaccatcttcatttcttgtgggcattccagtcacctaggcgaccataggtgcacgctgctctacttcgctggtgtcgagttcttctccaaggcccacctcgttacgcctgtcattgactgctgccccgagaacgcagctgcgcagttgggattggatatttggatggaaaaagtacaccgaaggtctctcaatttgtcattgagttacaaaatcgttcctcaacggcaaaaccaaatattggacatcccttaactaatcagatccttcggtggttttgatccggttttatcctacatgatggctgagtcagcttgggatccacgtggatcccacatgtcaggctcccacgtcatctctctcccttcctcctctctctctctcactcttctcctgttgcaagccggccggcagcgaaaacggtggcgccgccacgccaccggagagggtggtgctgcggggggcacgcgacagaggtgggcggcgccagtgctgaagaggaggaggaggtcgtggcgctgtcgtcgtcgtcgtcctctgcgctggggaacaaggtgggcgcggcggcggagggtgct

SEQ ID NO: 28760 - DNA, 3749 bp, Oryza sativa
ttctggtactgcgaaaaattcaggaacacgacgtagtgtacgcgtcatgtgcatcctgcagctgcaaataatcgaaattcctcttccaaccttgcaattcgaacttgggatctgctgctaacactggatattgattaagagtacatgatggtagttaggctggcatgattggagcatcttttttggtgacattaaggagtcagcagaagcaatgttcaagtctgagctgatcctgctgcatgcttgcctagatccctaggttgcatgccccctttgcctttttttcccgattactgagcgagctgagctgcacgattcatgcactactgctctcaactgtggcatctgatccatgcgcagtagctgcagcagaatctagtgcatgccctcacttcattcatcgcaattttttcaaatcgtccggcaactccgcgaaccgcaccagccgcggcaaccccatagcctatgccgccgccgtgcccactttcttccccggcgccgaggacgacgacgacgacagcgccacgacctcctcctcggcaccagcgctgcccacctccgccgcgtgccccacgcagcaccaccctccctggtggcgcggcgttctctactggccggcttgcaagagagaagagtgagaaagagagagaggaagggagaaagatgatgtggcagcttgacatgtggggaccacgtgggtcccacgctgacttagtcatcacgtaggataaaaccggatcaaaaacactatgatctatcgtgaccggtttcgattagttaagggacgcccgatatctggttttacggttgagggatgatactgtaactcgacgacaagttgagggaccttcggtgtactttttcctatttggattcatcctgcgttgggcccctaaggctacttgaacgggctgggagtgggaggacgtcacgccagcgtgagctcctcagagaagccgccgccgctcggactcgtcaagggcacaccattgctgccaccttgaataggcctagtagagcacattggatacttgggcattttgacaggcattcaccgccgctttgtgcgctagatgttgccggcgcacggtgagcccacgtcgacccatgcctgcccgccttcccttttctttttctcgcgtctgttttctctctctcatgctttttttttgtctcgagaattttgtactcaaagtcaaattcaaacaaaaaattttgttcatcgatgagttgatgtctatactctctttccctcaactcaatttttaaaactttcaacctaaattatgaaaaaataataataatatgatacagacaccgatagtaagctaaaagtttgaaagaatatatatatatatttcaaaatatttgagacaagtaaaataaaaaaagagaataaaaatatcataaaaataaattatcacaaaaataaaacaaatgtacaaaaactaaggagacattatgatacattattgagtgcataaaaataatgttaaaactttgctacaattataatactactatccattcaaaattacttgaatttcctcttctcgtggcatctatctaaccaacagtttcataaaataaaattacatccatcaggctatgaataataacttggatgacatattttgcaacttgctagcttgcattgctcaagcgttctttctttgatgccaccaagttaactactagagcattcacaacttaaggtacaagatgatgcagaaatccattgcagtgctccattattcccaaccgagtaaactaagtatgatcattgctacaatatcaatggcatgcatacactatcctcatggaatggtccttttttttatttttttatttaggaagacgacggcagacctctgcaggaattcaattttgctcatggaatggcctcaatatgcaggtatttctcatttaacaaggttacctcagcaatagtagttcacggtttactttatgtactgacaattcacactgagcaagaataccaagttaccgaatacaaaaaatgaaaatattgacaatcagtcatcataataatgatcatttggaaaattgtaagtttgtaacaacattcaacaaattaaagaagcacagggcagctatcgaatctactctcatgtcaattagtcatcatggagtcagccctgaaaaacaaggactagtttactttgcaaattatggtgtacaacagaagagaagcataaagatacaatggtacatctgagtataacacctttgatgttcttataattgttaattgtgctatttctcgtatcgaattacggggttagacgtagtttatcaaaatcgagcagttacaaggttttagatccaaggtacatcaaaattatatatttgctggtggtattatgaggtacacaggtgattgtaataagaacaaaaggctatgacagtaaggtatgctgacatcttggattagatgtggttaaacacaaagcattactatatggcaacattttttttcaatttcttaaaatctaattgtaatactagattactggactattgtagtcgatccatagaagccttttctaaatacaaaaagggtctaatggactatcatctaattactctagtaattactaagactcctatatttctttttcataaaaaaagtgtcgtgtaacaaaaagaaaaattcaaaataggtggcaaacaaaatggttaaccttcacaagaaaagaaatagctacaaaatgaaaggaccttgatgtctccaggagggaggggggttgaataggtaaataggtagtcattccttatatcttaagctggcatggatgctgctcgctgattggttgagatggtgcacaattatacgttgacacgtgcccctcttactttcccccaagaggctaagagtgtggctggacaagtatttgggaacacaaaatactaaaatctagagaactctttccacacaattctagatctctagtatcttcaagtctagtctcatttcaaatgatttaggagtaaataagacaatgtcgtagtcaaactaatggaggaaaaaagttacaaaaacaacatttataggggtcgcattcacctaattaaatcaaagaaggagctgacaattgaaagaagaattgagccaagcaataagattgaacaggagcaatggtggtggcggcgactgcaatactggatcgaacaagcgatggcgctcgcacaaaatggctcttccgtgaacattgcagtgctatcgaagacttattgatcaattggacactgccactgcagtgaatgccctgcttgctgggtgttggcggctgttaagagccaattttatgccgccaatacctgcataaatcaaggaaataaaacatccaacatagtgatagaattaaattcttacgtattccacaagtgttgttgtatatttgaatgcaggtagtaaaccgccgaagttggataaaaaaatagactcaagtgaaggtgaaatcctatccatacaaagagtgggccagaaactaccaaaaaacaccgtcacatgggccttccacttgcagaaatggatagaggaagaggagagacaacaggccaaaacttggacctgttgggcctggcctgggttcggccgaaccactctcgcagccctccaattcagggtttggcagggacggtctggatgagctcctgaatggtggatggagggcaaaatggacttttcgcgttctataaccgtcagcccctatataaagacctca

SEQ ID NO: 28761 - DNA, 8015 bp, Oryza sativa
cagctccacaactatagtgcattttgtgagagagctccacccaactccactcccagttttggtggagctgaaactgtttggttaagctccagctccaggaggggtggagctagagctggagatgtgccaaacaggccccaacactgggctcacaccaccgccaccctctcgttggtcagacgtgccctgtttgtggctatgccgaaacctttatgccaccacctttaccatgatcgatgttggagttcggctagccatctccggatctgtctatcttacaccttggcaccctcagaatcaatacctcaagagtagccacctgatcgagttggcaggagcacaactgccactagatcaaatggtcctctatctccacatccctccatccacatggatctggcatttgccaacatgaccaacatcagatcgggcaacccaaggtaccaagtaccataagccttctggagacatgggaggggaaggagagggcatcaccatagcgatcgccggtgaggacagagaaggaaaatggtgccatcgacaaattgcagaagaaaaagtcttagaaagagagaaaaaggcaacacggcggactgatcgaggcacggagccgtccagcgagacaacttgaaattctcactcaattagggcaaacaagaccactcgaatgtatatcttttagaaatgttacaaaaatgtattatttttttttaaaaaatatcttataaaataaatatcgtttaaagagcttacgggtttaaagcatccagttggcacgtctagtttctagtttaaaatgaaatgcggaagctaaccaaaacagtgtcgggttgtccgataccgggttggccagtccgatgttgattggattgtccgaactgagatcggactatttgacttgtagagtagtagcacaagcaaacaacaacaactagattagcacagaacaaagcaatccaacaagaaggtaaagagatggaggatatcatcgagttttacgtgaaaatgtattttccgaagttcaaatccttgaggggattctagcctccgttgaggagctcacaaagagctgggtcttttctaaccctatcctcttgaggttacacaaatgcactccttccgctaaggatatctagggatggcaatcttttcaaatccatgcccgacccagcgcccgactttttccgcccgaaccctacccgatagggttagcacgcaaaactccatgctcgtacccatgcctgacgggtacgggtatgccccatgggtatccagtgggtatgcccggtgaccttgttccctatgctcggcgcgacggtgagaagggagcgaagcggcgacaaaagtgcgatggaggagcgatggcgctctctcgccaaatctagcaacagtggccaccagatccggtcaggtgagcgcgcgagggtgacaaagacagcggtcatgcgtgatggagacgatgaagcggctgctgcctatcatggcagccaccaccccctcctgcatgcgccgccacctgcatgcgccaccgacgccacttgttcccctgctactgctgacgcttgttggtatttcttacggtcacagataaaatccgcaagcgcacggatatacctgtgtagcacttcacccaggagtattttaaggtatcgatttccacaagaaatgagtgtgttcaactcttctctaggttcatccaaggacacaaggcagatgtaggcaaaggatagagaggatttcctagtgagagacaatgtctacagaaaacttaatttaatcatattgcaatacttcaggcactggcttgctcgctgctaccagaatgcgttctactccgtaaccggacaggaaggactgcagcgatctagaatgctatcactacctctacaccaaccgctagcgatctgtgggatacgcagcaatcactggagattaattacctagacaccgcgtctacgcaattaattactactttagtgtttataaatcaccaaagtaataatctctatgtattaataaacaatagtgaacaatgatccagtacactaataggaactaaccaacaaataattctcacaaagtaaatcttatttactcagaagatatttctattaaagtagaataattaacaaggtaaaaaagtaagaggagattactgattacttcggaattcctccgaattcttctacataaaaagttacacaagagcctcttataaatcaacttttgcttggtgtgtgttggagggagagggtgaggtctttatataggccccaaatgacagttaggcagctggaaatgtctgaaatgtcccgcaaccatcattggggagtgatcaggagcatccacatggaaagaagcatcaacagctcagatgggggttcggccaaaccctggtcagctccccagcccatgggctttctcctaggcctcagtattttcctcccttatccatttgtatattgattgggctcagtttctggtgtttcaatgagattatgagctcaattcttttatggatggaattctcttccactttagtctaaatttcctcccaactttggtagttcattacctgcatcaaatatacaccaatacttatggaatttgttagaattaaactctaccactatgttggatgtttttttaatctttgatttatgcaagtattggcggcatataatttccatttaacagccgccaacactgctctggactaaggagggaggcagccgggtgaggtggcgtggtaattagtttagggtttgattgagtgagtttacatatgtctctagtcaggcatgggttacccacgggtaaaaaataaaacctgactgctgcctactatatcttcgggtatcaggcaggtatgctcacaggcaaaatattacacacgttcgccggcggcggcgaggcctccaggctaggcggcggcagatccagccccactgccaccggatcttctccagcgatggcgacggcaggcgcgatgtggaggcggcgcgtccggcggtggctgctgcggcgcgtggtggtgtggtcattgaggttcgtggtggccggctgttcgacgctcgggtggcggctgacggtgggcggcggcttctggcttcgggtcggtggcatgtcggccggctagggggttcgtcagttcttctggctgcctcccccccaccccccaccctctgaaaccacccctcctctcttcctttctctctaccttccttctctcttcctctttgtcccgcctctcgccacaagcagttaggggaggccttgcatcatcccccttcccctcccccagttctcctctctctgcgctggtggtgaagtcgcaggtggtcgccaaagttgattggtttgtcccacgaagcccggagttcctcgccggaaacatggttgacaccgatgtgtctgagccctctcttcagaacttagttcctctccaggccgaccatgactccttggtgcctccccccttccattggtcgtttacttccagatctggtcgtgctcttttggtgcttgaggagtctgttcgtctgtggtgttgatcctgtctgtctgtagttagggctcttaggccttgccggagcttcacgtgccctatgtctgtgtgaacttgttgaagtgccgagtttggagcggtgtgcttacccccatggtgcaagagttcctttcctcttgcttcttggagatccagcacctttgagggagtccggggcgaaagccctgcctggtcatccaggattggcaatatcgatgcctgcgagtgtcgtttcctccttagaggtgttgccttgtggactctctcccccctccccccggttgaaaacccagtccagctgttgggcgtgcgtcgacagcggcttatgtcgttgttcacctccttggaggcttcgccttagggtctttctcttccctcggccttctacggttcgtagtctttttgcctcaggctttttgtgtcttctgtgtaaagtttttgccggtttcactttagcaaaccgtgtagttgtatgatttttgggcccggttttccttataaatagggtcaactctatccttctaatatattcggaaatactcttgccgcttccacttaaaaaaaaaagatcaagagaaacatacactaagctcccaaacttcaaatccacaatcacaaagatccaagttacaaagaacaatggggatttgagagagagagggtggggggggggagagaggtcaaatatccaaagcacttagcacaaagctcaaagctacaagctacaaagatttgaatgaaaggactaaccttcgaaaagggttggtggggagttaacgttgaacggtccgatattttaaacctccaaggcaacgagagacagagaacaaaggtccatgaaattttggactttctaacacgatgtatatcttggtgagagctataatttttacataaaacatgtctctatccaaggtcgtttggaaatataagaaaaacaaattcaaaaatagatataagttaaaaaaaatgaatatttgaaccactgaaggttctcaaatgaacaaactttaaactacaaagttgtagatatcatcgagtgctacaattttcatatgaagtttatcaacattcggcttcatttgaaagagttacgattttctttcatattttagtacaactctcatttttaagctaggtggttttcatacgtacaaatcgaatattctaactcataaaaaaataatctcaaatgtgaaacctttcaaaagcaaagatgcatatctcgtcgagagctataatttttatataaaatttgtcttcatccgaatttatatgaaagagttacgtttgttttcctattttagtgatgcgcctatttgtaacttgtaagggcagttttcttatatagaaccactcgcgaaaatatacatatttttacaacagatttcttatagacggcctataaaaattggtttcacaggtggcactactacagaatgggttttcgcatacgggtgaacacgatcttcgcatgcggtcggccggcccgcatgcgcgaaatggtctgcaaagatcgccatttgcgcatgcggccggcccagccgcatgcggtcacttaagacggccgcatgcgaaaatatatcttcgcatgcggcccgtttaagcagccacatgcgaagatctattttcccgtgcggtcgacttaacaagaccgcatgcgaagatctattttcgcatgcggccgtcttaagtagactgtatgcgaagttcaatttccaaatagctaaaataatatttattctatccttttggtgagatgtgtctgataattaatattaaattattgaggatttattattgtatttcggaattgtaagcatacgagatagtcgggttgttattattactgtaacaaacatctaatacataaccataaattcaatcgtaatttacatacgaaagatataatacaagtgccacaattttttcatgatatgtataagtagtgtacatgtcattgcatatgttctttctcccactctctgagaggtttgaatttgtcgtccattgcgagttcactctggttgtcgtagaagagacctcttgcgtgtaggatcaaatcacaataactaagccaaccagagaggggtgaatggtttgtatacccaaaaactgaaaacttttagcggaaataaaagttaccctcgaaatcgacggatcgcggtctgaccgaagttgtcctgccggtttgaccgcctggttgccgtcggtctgaccgagattagatctccggtctgaccgccgagatcagctgttgctcgctgtcgccgccgccggtctgaccgcccgtatgcagccggtctgaccgccgcttaccgccggtttgaccgccggtatatcactggttagactgccgaaacccggtgaaacacaaatcgaaaaactcttaaagtggatgacgactttattgattttctctgtgtttacaaagtgcaccaacaacactccttacaaaaatttcgactaaactcgaaaccctaactcaaaactcaactcaattgctctcaaaagcgataccgggaagcctcacgctccccctctatttatacccgaggtaggcagcctaaagccacgaaccaaactcatactagaagtcctaaacaccttaggaaaccctctagtacaagaaacaaactttacataaccaatcataccaaatttggactccttccaaattcgactccgcattccatacgcacacaatacctccatcgtatgccatatggaatctccatcaaccacgtgcatcaactctagccttagtatcccgtatgatttttgaccaccacggacgtcgtcttatccccaagccgactcccggtccatcaccgcaaatactctctcgaggcatcgagtcacctacatatgaaataaacaaagaaaccatattccgagaccaagctatctctaacttgactcattagtagcaaacaacaatattacatacgtatagtatccatctagaagccatactcatgaaataatcacggatatccaaacaaataacccgaaaccgaaaccgacacagagtcggccggtcagaccgcggactggctggtctgaccggtccacataaaataacatcagtatcttgtagattcacctgtgaaatccaatcatctccaaaatcacttcgtaaataaattccaaataaaaaaacaattgttcatcacagaataataatcaaaaacacctttgattttacattgcgttgcagacatcacgacagaggaatcggcagagttcagcgcccacgttccagatagtactgtcgtcgattcgttgtgcaatatatgggattttggggatctgcgcacagaaaggaaaataaaatggtactcagtgagaagtttgtgctagatgggtttctttgtagagaagagttcgccgacttactcggttactggttgttttgtacctcccgtttactctgagcatctcgcacacgtaataaccgcacaagttggttcccagtggttgtttgtaacactgcaatataattatgagggaccgatctcagtagatataatttagtatgtattgttcgataattagttgtattggtatagatttgatagtaccggtcggccagtcttgatggataactgcttctgggatggaatatgtactggtccgcctcttttgcggtagtacttgtgtgctatgtttgaagaaaacaattgttttatcagtagttagaagattgaggatcgacctaaacaatttatattaatgaaatgtttatcacttatagattcaaaacagtgaggaattccataaatgtctccttgtcatagtgtacggggtccaacgatatgatcaattggtcttttggatatacaaggaataatatgtagtgctctctgcatataaaataggcttaatggagactgaaaattccgaagaagataaattaattaaataaaaagaagataaagcttacgtcaacgcgtaggggaccattaagacatctttgtcggcgtacgccaatattgctattgccaagtatgttgctacttctagcttcttcctcttgtgcaattgcttcacatattcttccttttcttgaggggtcttgccaaccaattgctcgcagtcctctcttagctctacggtgtgttgtgttttgcatattcttgttggatcgacgtatccaaccggtgatccagttctatcagcttcgtggaattgcatattgtacaatgaacaaagaagtaatgagatttggtttctttgtttggaatgatacatgtaacatgtaataaagagttcagacttacagacaggacgccgcaattgttcaagcaaaaatttcaagttgaaaatctccccctaattattgcttgctttaggagagagaaagcttcgttttcaaatagtcaagctcgggcctggatgagcatatatggccgatcatcgcacgcggttccttgagctagccgcatgcaaagatccattatcgcat

SEQ ID NO: 28762 - DNA, 3476 bp, Oryza sativa
tgcggctgtcttaagcagccgcatgcgataatggatcttcgcatgcggctcgtcgacccgcccccgggggggcgagttttgcaggcgccgccacaagtcgcctgcatgtaaactaatgacctgaaaattggtttcacaggcggtgtatgacttgagacagcctcaactattatcgtgacgctattttttccgcccgtaaaaaaccaagaagacctcaactattttgtgatgctacttttttccgcccgtaaatacctggaattttttattagtagtgctccttacaggggtgacactgcgaataatccatttgtacccagaagctgctcacatctcaataatccaccgtttatttctctattttaccattatataccttttttacaaataaataccatgccacattatcgcgttaaattaagttgtataacatgtacaaataagatacaatataattattaaactaatatgaattttgagtcaaaaataattataattatatggttttatgggagaggaaaggagacaatttgaaccatatatattgaatccaaaggctaaaactaatagagataatgtggcttaatgagagaagagagaaatagtattaattatatttagtggggattaactatataagtattagacagattatgttgcagaaatgaaagaaaaaggtgcacattgaacctttcaacttgaacgtttatgtcctgataatttcaccatgatatatacaagaaccgtaactttcagactagtctactttatgacttcatagactagtctgttctagtttgttcttatccagcgaatctttgcgtagtttagacctgtctacacggatgatgatggcgacactactatcaagtctctatactggtgatctaccttggaccaaagctgggtgcaattaaatttgagtaaattttacataattataatatattaaccaaaccatgataaaactatatatttaacctgatataacaaatttagcaataaacttaccagaaaatatatatttaaggtaaagtattacaaaactagtggttcaacaccaatttaatcacaaaatatggacctttattacacaaactaatattagtactaaaaatttaaaccctaaagtatgtagttttgtgatacttagcttaaacctgtagttttgtgaaaaaatatttttaaatttgtagtttattgatacactaccttaaatatagagttttatcataattttgattaaagcatatgtagttttatgaaatttggcgacgtttgatgtcgcgattccagtatttgcatagtatgggaatcgttggtactagaatatatgcgagattgtaataaaagagatggggacgaggatttttatacaggttcaattcgggcccctgaattgtcaggtaataaccctactcctgttgaccgaagccggtcgttgctcttattcaccataatcacactagtacaatatttggggtagcctatctaagtgttgtcgacttggcggtctgaagtgctgactcgtagtcgacaacagggtagcctttctcttcgaatccacatccggcaagatcaaagacagcgctatgtctctcctatcagtatccgtagacactgtaggggactagccatgcttatctctgaagtcaatatccggtgtcttgtcttggcgtatgttggcttgtatattgatcttatgtcttgatctattgttccgttgtatttatacctataggtgttcccttttccaattagaactagggaaaccaatatggatacaatccgaataatccttgtcgtttccatgtagaactctatttatctttccttatccggaactccttctatacccaaatgttgtttccgtataaaacatgttatgtggtgggtcctgccgagatttagtcaactactattaggtatgtggtatccataacctgacaaaatttactcaagaaaagaaaagaaaaattggatacaaataaacttgaaatctagaacagctaccgctatatagtagaaccgtctaaaggacttaaaaaaatcaaaccatgcatatacgcatgcattttttttttcattcagtatattcatttttttaaaaaccaaaataagacagaatctacataaaaaagttgccagaatgtttactttgggcctgtttagttcgtgaaaagaattttttttgagtgtcacgtcagacgtttgaccggatgtcggaagagattttcggacacaaataaaaaaactaattttataactcgcatggaaaccgcgagatgaattttgagcctaattaatccgtcattagcacatgtgggttactgtagcacttactagttttttaatttacctatatttaatactctatgcatgtgtccaaagattcgatgcgatgtttttgagaaaaagtttttggtaactaatcaggcttttatccacgagctatttgctttcaggaaaagaaaattactctagctgctgtgtacggttacatgcactgtcatgaaaaaaagtacatgagctgcggcgcatatgcattggttatacatgccggccattttattaatctaggtttgctaaatattgtctcatgcttttttggactccaaacacggtgcttgaattcgctgcctttccaggttccaggtaacatgcccaacatgttaacatccctttttttatatgttaaaatccggtgaaaaggaaataactatatatatatatatatatatatatatatatatatatatgcaagaatgcaaatatgactcaaggtgaaaatatattagcagaattcgcccggcgattaccaatttatcatatcatcttgtgaaaaagtaaacaaaaacgcacaaaaaaattggaaaaccagaaaacacaattgcatataaaattaaggataatttttttctgaatatccttttatttcagatgaaattaagtactaaaattagatgctaacaaataacttaaaatatctgccaaacatgaagtgattgatactagctcctagcccacatgctcggccatgtggacacggtgtgcaaaataagtcgatgcatagaaacaacacatgaaacaaaacgaaatggagttcctgtggctgtgccctgcgctgacggtcttgcttttcttgacacgaaattttgtccattttgttgctctcgatttgttctgatatggcaaaggaagatcacatgtgcgctagctacttcaattgacggttttgctttgtccattatgacgcacacacaaggcacgacgtattaaattaatatggctatgtatataaaagcgggaagtaatatttgtagtatcaagggataaatccacattacacccttcccctcaactattaggtttgtcttactaagtgttagaaaccggcccccgaaatcacatcggaaaccaaacgcggaagaaacaccataggagatccaaacacgatgacgacaccgaggcacgat

SEQ ID NO: 28763 - DNA, 669 bp, Oryza sativa
ccacatgaaatgacatatataagttaaatagtacatagagatgcaatttttttatttttatttcattttttgatatttttttcacacttaggagaacataggaaccaaccgtataaaaaataaactcaaacggacaaaatatgtgacatgtagaattttccaaaactctaccgaaacggacaaaatatgccatctattaaaataggcgtaactttctcatacggactcggaatcagacaaataatatatgcacggacatctacagaaaatgttacatccgattctccccgctttgccgggttcggcgatattaaaacctccaaattccgcttgcaagattgtgttttcgaggagagaagtttttcggtggagctttggaaaattccacatgccacatatttcgtccgtttgagtttattttttacgtggttggttcctgtgaattcctaagtgtgtaaaaaatatcaacaaaataaaataaaaataaaaaagttgcacatctctctcctctgcactagttcggagagaggagaggagaggaaaaattctacatgtcacatattacgtccatttgagttcaatttttctatagttggttcttgtgtgtccctaagcatgaaaaaaatatcaaacaaataaaacaaaaataaaaaatttcggggggggggg

SEQ ID NO: 28764 - DNA, 1303 bp, Oryza sativa
caaaaaatctgacagttttaaggttgcaatcttgtcagaatttatcctttttgttattctctatgtagaatgaatttgaagatgcgactttgcacgtagatgtaatactattgaaagtacatgtatgaattttcctagaattgtttgtgataatttttagttggtgtacacggtgtatatacgcgagggcctgtgtgcataggatacgctcccatatatatatatatatatgtcgacgggggataccctagaccagatatagagggtattggggtccgttggaacgaggatctacgtagtacgacatcaagcaaacagaaagcaaggattatactggttcaggccccttgataggtaatagccctaatccagttggtatgggattatataatggaaatcacaaattataaagggaataacaaaacttgatggtaccgacgagaccgtagtcaaattggttcgactagatctcccggcgacttggctcctgtgcgctccgacttcgtaggctgtggtgaatgtgttcgcggtgagattcgatgccctaggtcctgcccagggggtccattttatactaggggtcagttgatctccaagtaggactcggagatatcggacctctcacgatatggtaaagacccggtcttgcccgagtaggactccttacatccgtggattctatttctattacatgatagatttcctaaacgtataccagaactatccgtatacgcatgggtataccatatcagtactcatcgtacgtccaaggatagagggtataccttatccgtaaccttgacagtagcccctgacttctgcttaaatgaactcatgtaatcgatcggaacttctgatgtcggaatcgttgtcattctcatctggtcgatcccggcatgagaaccgtagaggcaaagagtcatcgacaacgtcgcatgaagttcaacagttatgagtgaatttaaattgaagtatgaaaactaccgcgcgcaatggacccagaattttccggcggcaatctctctcctttcctcggaatacgcaccgtcggtagtgcacttatttaaagggattttggaaacccatttgaagtccgttcaccaaaaaactcttcagccttctagcgcccttcgtcttctccgctctccgcaaagaaaaccctagcttgcttcttccctcttgttctccggcgatcctccggcggcgatggatcttgacaagtccacctcaaccaccgcgtccatgaagaagttgcaggacgacggtgcccttcctggtcgcgggaccatgtagagggagacag

SEQ ID NO: 28765 - DNA, 4824 bp, Oryza sativa
gcatggttgtggtcgaagattacatttcttgcggttttcttcctctgccttccgagtttcttcttattgtcttgaacttctatggtctttctttgcttcacttgaacccgaattccatcgcatttcttagcatctttgctcatctttgtgaggcctacattggggtagagcccttccttgatctcttccgcttttactacaagttgcgttggatggaacccaacagggtatccggatgcgttggattccgacttcgggatcgcctgaagtcacgttacatacccttccaatgcccctcttctcgtagcaagtggcaggcgagatggttttatcttcagatagaaaattcagaccccgtccttgttgttcctgaagaacagccagacaaaatcccagagtggaccgccaaacccgccctaactccctccctccagtctttcatcgacatcatcgatgacctctgaaaacgggggttgtcggggtacgaagtcgctgccgactttgtaggtaggcggatccaaccgctgcaggctcgcgcccatccggcctttgattactctgggccagaagacatgacccgggtttctcctcggggtattttttcttgtatttcaaactttactccgagtgcgtctgtttctcctgacttatcgagttcttgttctcgatttataggtctggacagtgacaccgtgggacgccgcgtcggccaggtgatgattagtgccccctcagaggcgagcgacatcccgatccccctttgcgagaggggcccggccgaacgcactgctgcgatcaatgtgagtgtactcaatgactcctttacatctttctcctcgagatcgcgtcgtgatttcacgttatgtaggctctccctctgacggacgtcatcggaccgctcgtggatcatcaggcggcggcgtcattgaaggagggcgtcgccaaggaggcgtccgatgttgctgctgctgccgctgctaccacgagtggcagcaacattccgaagaaggggagtaaattctcctctgtactcgggacccatcggaaagcgccaaacccggcggtaagcctctctcttgttttttaacgcgtagtcggaataacttgacctgacaccatctcatcttacttaggactcagacgcgtctcctctggctcatcgaaggcaaaggcttgtgacgatcggcgagaagtaagtagacgtttttgaagtcttttcattcacggagtcttgatcgcttagctttatgaaagagaggaaaatcttcgtaggacggcgcgggcgaaggcgacgcaaggtgggaccgatgctgcctccagcgcgtcccctgcggcgacctcgacagatgtcgtggtcgctactaaggaccgggaggcggcaccgagtaaccccatcatcagcctcatgcctactcggggcccatccaccgatgacctcacctggggggagctccaagtggagatggagcatatcctccaggccggcgctcgcggcgtaggtcgtgagattgaggaggccagggtggtggcgtcgtcggcaaaccagcgtgccgaccaactggctcgcgacctggcggaggcccgcgagaacctcctaaagatgagggagctggtggtcggcaacgagaggcagcggcaaggacttgagcaccggatgtcggagctcgagaacaacctgtcaaggatccgaggctcgctgcggatatcgcacaccggcctgcaccaactcgccggcgagtgtggtgtcacgactaccatcccggcgaaccctgacgagttctcgctgacgtcctcactcgcggaactggctacggcgatggaggagatcacctccaagcatgcggccaggattggggaggagacgtccaataggatctacaccggggcgtgccatgtcctcgcatgcgtgaggctggcacaccctgatctagaccttaagaaggctttggatcagggggccgccgatgacgcgcgcaagggtgtggtggaggaagtcgatgacttgggggagtccgtcctccccctttttgaagagtaagatatttgttttcccctatacccttaatcctcatgctgtaaaacctttgttggatgcaaactgctcttatctgaacagtcgtttccctcgttttcttagcatgtgattccgagtactttgttgtcgttgtagagatatcgatattgaggatgtccagcagcgcgggcagcctaatatgccggtggtcgttccggcgcttgcactcgagccgtttgtgccgcgggaagaggtcagtcaaagcccgtccgcggaggcgaatatggcgatgacgtccctaggtttgcgtcttagtctctttcactccttgtattcggattgacttaattagctgtgtcctcgaaagagaagagtagcttgacttagtctttttcgtcccaggcagattttgagaacacgatggctgaccgagtttgtcgaatccaatattggaggacgaagctcgagatggccaaactcgaaaacaccatgatcgaggtgaagaaggatcaggctgtggaaactcttcgaggtcgcgaggtatggttcaactcgtacctcaagagctgctgtacggcgatggcgagggtctgcaaggagctccgagttcctcgcagagatctcgaggagtcggcagccggatatatctcatggttgaatggggcttgtgcacagctcgaagggatcggcaaacgtatcgacgaggccctaaagcaggagtgtcgtcgatcgagccagtacaccagaggacatgtgctggcctgcatccgagatcaccgcccgcagcagcacctcgagttccttcacgaagggttctcacgttctcggaggactcccacggagattgatggtcttgagcagtcgatggcgccgcttaccgagaaggtatttcggtccgtggattggcgttggccgtcctggtagtttttgtatcctgtaaaaaatatctcaaagaaacatgtaatatattttggagtatctatgacttgcaagaaacacttgtgaaatagaaaaggaatctatctaactaagttttcttactctgggtatgttgtgtatgagcgttttctcactttgcgacttcgatcagtcacttgagccatacactcttcctagcccctagccttgtcgtcggagaattattctcagaggataaggctcttggactcttgacttgccttggttgaaaaagcgctgaccctagcccccagccgtgaagttggaaaactcaatttccgattacacggcttggttaatacgcacggcgagaactcttacatgaccagaacttacatggtcgtttgtctctacatgatccgacaaggccttatccgctctaggcgtccccagccgaagttcccttaggttcctcagaggccttgtcaggatggcgtaaagggacatgaggataggtttcaactctaggtgtcgtcgtggtaagggatcgccgggaaggaacacttagactgtagtctttacctgaaatcaatctttattgaaatcgtaagatgtcttacaagtatggatactattgatttatacataaaattttcgtaattgatcaatgttccatgaatttgctaactcgcgaccatcgttgtctgcaatcttgaatgcacctggccgcaagaattgcgtgatcgtgtatggtccttcccacttgggtgagagcttgttacgccctgcttggctttgaacccgtcggaggacgtaatcgtcgatcaaaagtgtgcgtgctctgatgcgcttctcatggtatcggcgaagggcctgctggtagctggctgctctgacaacaactctttctcgatgttcctcgagtagattcacatcgtcacttcgctgcttctcctgttcctcgtcagagtacttctgtactcgtgtgctctgatgccgtagctccgtggggagcatagcctatgagccatacacgaggaagaagggtgtctccttattgaacgttgtcggtgtggtgcgcacggcccatagatcagaggggagttcttcgacccacttcttgtcgtgtgacatgaatctgtcgtagactcgggtcttgatcccttgtagtactatgctgtttgcccttttgacctgtccattgctctgagggtgagaaaccgaggcaaaacaaatcttgactcccaatccaatgcagtaatcctggaagtcggcattgatgaactgggagccattgtctattatgatgcggtgaggcaatctgtatctgcagaatatcctttgataaacttgatggcgtcgtcagccttgatttcccccgtgggcatcgcttcaatccacttggtgaacttgtcgatcgccacgaaaaggaacttgtagccgccctgtcctcgtgggaatggtccgagtatgtcgagcccccaacacaagaacggccatgtaagagggatagtctggagcgcttgtgccggtagtcttgtgtgtttgctatgaaattgaaaggcttcacaccgctgaaccatgtcgcaagcgtctttacgcgcggttggccagaaaaaaccttgtcggaaagcttttcctaccaacgtccgaccggcggcgtgtgacccgcacatccctttatgtatgttgaggaggagatgtttgccgtcatcgaacgagatgcatttgagaagtaccccttttggcacctttttgtacagatcgttgccgatcatacaatagatcttggcttgtcgggttattttctcggcctctgcatcgtcctcgggcaactcgtcggtactcaggaacttgatgagcggggtccgccagtcctctgtggtctcgatgtcggcaatgacgtgttctgc

SEQ ID NO: 28766 - DNA, 1192 bp, Oryza sativa
cgattatcgcttgactcctagtgcggctgctgctcttatcccgatgagtagtccttcgtactcggctgtgttgttggtcgccctgaagttgaggtgaattgcatgcttgaactgatctcccgaaggtgatgtcaagatgaaccctgtccctgctccttggctattgaatgcgccatcgaacgccattgtccatgtctcgctgtcggtctgactgtctgacctgttgtcgagcatagtccagtcagctacgaaatcggcgaggacctgggacttaatagttgttcgtggcacaaagtgaacgtcaaattggcttagctcgactacccattttgcaatgcagccgacgacgtctctgtttctcacgacttctccgagggggaaggaggaaacaactgtgactctgtgggcttggaagtagtggcgtagctttcttgatgtcatgattactgcataaagcagcttttgaatctgtgagtatcttgtctttgcgtcgtggagagcttcgctgacatagtaaactggtctttgcaccttctctctcttgacaacaatgacggtactcacagaatatggtgtggcgacaatatagaggaataattcttcattaggttggggagcaacaagtacagggggatttgacaggtagcatttgagcgcgatgaacacgtcttcggcttcctgtgtccacacaaatttgtcttgtttcttcagcagagcgaagaaaggttgtcctcgctctcccatcctagcgacgaatctgctcagtgccgccatgcatccagttagcttctggacttccttgagtcttgtgggcgactttatgttctcgattgccttgatcttctcgggatttgcttcgatccctcttccggagacgaggaatccgaggagcttgcccgatggtcctccgaacatgcacttctccgggttgagcatgaggcgatattgtcagaggttgtcgaacgtttcctggaggtcatcaatcaatgagtcgcttgtctttgtcttcacaacaatgtcgtcaacgtaggcctcgacattgtgtccaagttggtcattaagtgccccttggaccgtgcgctggaaggtatttcccgcggttatcagccccaaacggcattttgatgtagcagaatacaccgaatggcatgatgaatgttgtcttctcctcgtcctcttttaccatgctgat

SEQ ID NO: 28767 - DNA, 625 bp, Oryza sativa; identical to SEQ ID NO: 21434

SEQ ID NO: 28768 - DNA, 910 bp, Oryza sativa
gatggcgaagaccaccgaatccgcgagaacggcttgccaaacgctccgcctcgcccttactgacatgggcgcgaaagtgcggggggtctctgctgaggatcggtttcggactgcgccaccgcgtacggcgattgctgtgagcatgtatcggcggccttcaccttagacttttgcaacagttcggctgcgagcacgtcgccgagttccctacctatgcgaagggggactgggagattagtgcgcagaacatttcgcccgctcttcgcgcgtggcgaaaacagttctggcagaaagatggccggtccgctgccaaagtgcgccttctagagcaactagcgaaggcggaggcggcagatcagggtgaaggaaagggcacgacaggcgaagaggttggaggcgatgcccaggatcacccagaggttttcctccctcttctgcgtttgcctggagaggcgaatgatgtacattcggcaggctgccgccaaaccttaaaaaaggcttttttgtacaattggaatatatgacacaatcttaattactttttgatgatcgaagtctttggcatattattatttcgctcatctcgcattatgccatacctcccccttcttcctcctattcttactatgtaagctgtgttttgctttttctgcactgtccatcagggggttcgccaaaagtcatgcatccggccccctttcgggagctggcgaagtcaaaacaagaaatttgtggcagtgaagggtctgcgaaggtgcgatgtccatttcggcatatttatcgcgaaatggagataaacggtagcagtataaggttttcatggttgctgactggctgcgggcgcaccccgggcgaaccttagaagattacgatcttgttcattcaagacgtttggaggatatggctcgct

SEQ ID NO: 28769 - DNA, 5577 bp, Oryza sativa
  unsure (1)..(5577): unsure at all n locations
cttgtgtttgatgaggtatgatccttcccactttgattcaagcttgccaaccgctactgggttcgccttcttccttaggacgagatgaccaggcatcagctccgtgggtcgaactttttgttgtaagttgccgaagtgcttgtggtgtacttgtgcatgtgctcgagtgcttcgactcttactccttccaagagttcgagcgatacttcgcatccctcttcgcccccagagaacatcacccttggtgagttagcccctagctttactggggtcattgcctcatcgccataaaaaagcataaacgggctaaacttggttggtcttgtgggggtcgttcgaagggcccagagaactgatagcaattcctctggccatttgcctttcgctgccccctcgagtcttttctttagtgcttctaggatcttgccatttgtacgttcggccgccccatttgactgcgggtgtgcgaccgacgagaacctgatttccaggttaagcccttcgcacatttctctgaacttatcatagtcaaactgcttgccgttgtcagtaataaactcttttggcactccgaaacggtaaacaatgtttttccatacaaacttctgtactgctgccgaagtgattgccccaaggggttcggcttcaatccatcgagagaaatattccacagctacaattgcgaatttatacccgtttcgcgccaccgggaatggcccaatgatgtccagtctccatctggcgaagggccatactggtgcaatgggctgcagatcatactggggcgcggcttggcttcggccatgacgctggcaactttcgcacttcttgatttgctcaacacagactttcaacacagtgggccaataaactccttgtctaaatactttggaggccattgttcttgcagcctagtgcacgccacatagaccctggtgtatctcctttgccatttcttcgccttcggcaaaagagatgcaacgaagtaaaggttgaagtaccccaaagcggtaaagctgacccgagaccatcttatacttcgtggctctgagttgcaaatgcttcgcttctgcttcgtctaccggaagccagccagtttcaaggtgtttcacaaatgaggttcgccagtcatatgggtcttcgcccagtttctcctggtcgattgccatgacttccaagctgtccatgggcacacttggagcatgtaggactttgaaaaagatgccaggcgaatgtgggccaccacaagcagcagatttcgccaaggcgtctgcttcctcgttctggtctctaggcaagtgttcgaccgttatgccggtgaagcatttttccatggaccgaacagcctccagatacctcttcattccctctttttttacctcgaaggatttgtcaacatggcctgctaccaacttggagtcagttcgaattagcaggcgccggactcccagtgctttcgcctttcttaggcccaggagaacggcttcgtattctgctgcattgttggttgtgtcgaactgcagtcttgctacgtaccgaatcggcacaccattcggcaaaaataggactgccgcaatgcctgctcccctgtgcgaccacgagccgtctgagcacatcacccagaattgttcatcgggctcggggtcgggggcaagtaccggtgtccattcagctacgaagtcggctagcatttaagacttgatagcagagcgtgcaacaaaatttaagtcgaacggggatagctctgtcgcccacttgctgagccggccagtgacttccttgcctcggagtatttcgcccaagggatactgtgatggcactatgactttgtgggcctggaagtagtgcttaagcttgcgcgatgccatcactagggcgtcagtgagcttttccatttcaatgtaccttgtcttcgctccttgcagtgcttcggagacgaactacaccggtttttgtccgaactctgtttcttggacgagggcagcactgactgccaccggcgaagctgctaagtataatancagttcgcttcctgggggtgggcttatcagaactggcgggctttgcaagtattgctttagcacgtcgaatgctgcttggcactctggtatccaattaaactttcctgcgcctcggagggtcttgaagaagggcaaacctctttcggctgcctttgagaggaatcgactgagtgccacaattcggcctgcaagcttttgtacttcatgtacgcttgacggaggcttcatttgctggatggcatcgattttctcgggatttgcctcgatgcctctttcggaaacaaggaaacccaacaacttgcctgcgcggacgccgaaaacgcacttctccggattcaaccttgtgcctgctgtgcgcaagctgtcgaatgtctcctgcaggtcgatcgcatggtcgaaagccttgcggctttttacgatgatgtcgtcgacataagcttccacattctgccccaactgcttgccaaggaccttgtacaccagcctggcaaaagttgctcctgcgttcgttaagccgaaaggcatcctgaggtgacaaaatgtgccgaatggagtgatgaaggatgttttggggatgtcgagcgggttcatgtggatctggtggtaaccggaatatgcatccaggaaactcatgagctcgcatccagctgttgaatccacgagctggtcgattcgcggcaaggggaagtcgtcatttgccgttcaggtctgtgaaatcgacacacatgcgccatttgccgtttgacttccgcaccagcactggattcaccaaccactccggatggtcaatctcttggataacccccgccctgagcaatttttgtacttcggctttcgccgcttcttggcgatcggcagacatcttgcgcaacttttgttttcttggcttaatgtccggcttgactgctaggtgatgcatgataagatccaccgggacaccccccacctcgttagggctccaggcgaagatatcgatgttctttttgagcacctctaggatactctcaacttcttcttcgcccatgtcgcccccaagtgatacgagctttgtggggtcggcatcatcaatctacacttttgttatcttgccgtgaggggtgggctttggtgtgtgcttcggccgttcatgcggttcggtctcaacactgtgcactgctctgttgattatggctagatcgcctttcgaagcggccgaaggctgaagccccttgactactatcacccctgtcgggccgggcatcttgagcttgagataattgtggtgggaaatggcttcgaacttgttcagggttgcacggccgaagatggcgttgtagttgtacgggatgtcgacgacgtcgaacagtatttgctcttcgcgtctattctcccccgagccaaaggctatcagcaaaagtgtttggccgagaacttgaactgcttctctgctgaaaccgcggagcgatgctggtgctggggtaagggcttgggtaggcaaccccatcttggcatatgcttcagcgaagataacatcggccgaactccctccgtcgaccaggattcgtcggacttcgaaaccagctatctcagctgagattaccaggggatcttgatgcgggaaaataactccttctgcgtcttccggcccaaaagaaattagctggttcagatactgcggcgccccttcacccgccgaagtgatgctgtggaccatacggatctgcatcatcttctgccgtttggacaactggcttggcgggtcagcccttgtaatcacttggattacccttcgctgtacatcttggcgttgttcggttgggggtgtttgctcctgaactgcttcgcggggtgcttcgacaattgttccctgctgcggccttaggtcttgcgcattgccacattgcctaatgtttcgacattgctccgtggtgtgcgaagagcatccgtgaaaggcgtagtagaggtcttttcggaccttcttgtgggctggctgctgatggttgctcgcttgctgggcatcgaactccttgcggagggcttgcacttcttcgaccgccatcacagctttgctcgcatggtctgttctgaactttctccaagttatgggggcttggctttgccttggcggctgtccttggatcgccggctgagactggcgaacgaagaggggaggtggttcgacaacttgaacttgtgcttgagcttgagcagcggcgatggaggctttgtcatactcagcttgtatagcttgctgtcgcttggaattctcctcgccccttgcgaacccgtcaatgatgcgaagtaggtgctcgagcgtctgaggctccttgttggtgatttttcttgtgagttcgtcctcgagcagaccggccgaagtggcatttataaccgacgcctcggttatgtcttgaacttggcaccgggcttgcaagaagcgacgcatgtactcccttatcgactccccctgcctttggcgaatgccaagtagatgttgttgcgtcttcggctcctcgttggtgcctcgaaagttaaggacaaaaacatcgtgcaattgctcccatgagtaaatgctattggctggtaaattgaaataccaagaacgggcgatgccgtctagagcgagatgtattaccttcgctttggtatttttgtcaccatgagctgcttcgatcgctgactcgtagatggagaggaactccttcgggtcagtttcgcctgaatagcgcgggacgggtgggaacttaaactggggtgggattggacgagtcttgattcccccacacagcggtagccctttttcgcctcccgccctgtttaccgcaccctactgcgggtacggtgtggcgaagggcgaaatcgcagcttgtgcgtgtggttgggccatggcattcggctgcccggctccaactggaggtacttgctgagccgccatggatgggtcaaaaattggctgtgaccacatcatggcagcttggattggtgcttggtttgttccgaagcctggagttggagcttgctgccgaacggttggcgcctgagcagcgttgatgaagtcgaactgcggtccctgattccacagcgaaactctcaggcccggctgaatcggtggcaaccaattaggcgcactttgacttgtatttgtcgcgaccgagaaaaatacattttcccgaacggtagtgtattaatccccatcccagtaaaagccagggtacaccacacaaacatgatataaaagacacatctttattatatcgataatatttacattattacaaaggcccttaaggcctgacaatcaaaaataaacagcagcgggactagcgggcttacggctccatctttcacaggcgctcaagtggggtataagccaggactccaccataagattccttctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28770 - DNA, 897 bp, Oryza sativa; identical to SEQ ID NO: 21440

SEQ ID NO: 28771 - DNA, 12405 bp, Oryza sativa
  unsure (1)..(12405): unsure at all n locations
ggaaaggagttgtgacaataccccttgcacaacataatccattacagcgcacctttcctggatcataatcacccccttataaacaaggcatggactccccagcgacccccgtggacttctcgccacttctcagtctggcgcactataatgaatcacgctatacaaaagataaagccgttgcccatgctggcttgtggttggcacggtaaaggtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatataaccatcattaataatgtagtatataagattcatcccattagtgagctaatgtttctaagcattgctaagcaattatatatatatatatataacatttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggatcgtgtttaggatctgtgtgacttgccttgcaataatcggttttcaattaatcttcttgaatacttccggcgcactcacgaaccttcgcaacgacggaaacgacaagctaacacgcaaaacgaagaaaaagactaataaaaaccaaataaacaatacataaaaagtaaacaaacatgtagatcatgattttagatgaatttagcaacttgaaccactcaaaaccgagttacgatgatttagttatgaatttctgaagatttaatctattagaaaaacaggaaaaagaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacgaggtctagcggcggcgcggcttcggtcgacggcggcgacggggctccggtgatcagcggcttcggtggtcaggcggccgggcttctccaccctcccgcgcacctaacggtggtgacggcgaccggcggcgacgacggaggcggcggcgcgacgcggatggagctcggccggcgacgacggcggggtggagcacgtggcggcggcgctacgaggcacgggagaccacgggggagggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttggggtaaagatagaggaggataagaggaatatttcccctcaactaattttagaaaaacacaaggggaaaggtcagatttggaggagaaaaaccgagccaaatcggtctcagttcggctgctagaggtagaagaaggagcactgtagcgacagggacgaaaaacagacttctatgcgggctgagaggaaggaagagagaaggggacgcaaattagacttttcgtcttgggctggctgaaaacaaagaaaagaaagaaagagaagggggaagctcggctgggccgactagggctgcacggccgtgcacacaaaagagggagatgggccggaaagggcccaagactaggaagaggattattattacttttccaattaaattaatcaatgaaatgatctttgaattgttaaaaatacttccaatgctcaaataattccaagaaaaatcttgaacatacttggacacccaaagtatttaacaatattaaaaccagaccatttaatgattaatttaatatgtgggtaattactgaaatgctctttgtatgattaaaaattaggaattgagctccgaaaaatccgagaatattccagagagtataattaaccatggagaatttaataaaaaattaaatccatccatgctttatatttaggaaattttatttcccacatttaacttcacttgtaaattaatgaacatttaatataaattctaataataatttattaaataatttataaatcctgaaacaaaaatcaggatgtgacattccactacagaacggtcatcgaccatcttgtagtcatagaacttctccatgacatatagctcgctgctggcgtcagaaactccgaacttggcctcaagtgcatcccacatgtcgttccctgaagccattgtgcatatacatgtccactatgttgtcagcgagtacattgatcaatgctccacggaacaggcaatccgaagcctcgaacttaacctcctcctcaggagagagaggtggttcacttcggttaccccatgaaacatagaaacattgcatcgctgtcaaccacagtagtgcacgtgctttccatcttttataattagaaccatcaaaagtatgtggttttagtgcagcaacaaagacaactaccgaaaatgatatatcaggtttttggattgttggaaatatagtcatatatcggcatattttaatccaaaatattaagacaataatcatgacatgaacaatgtgaggtgatctagtgataaaattaaacataaccaggagcatgcttaagatagaataagcatcatcatcatgtagagaacgcaataacattgcaactaacagaagtaacaaaaacagagatagcgacaaaatgttataccctgtgaaagtcccttcgctggattgtgaggtagaactgtctctgttggtgttgtcgatcggtgcgccagctccagctccaggtgcgccagctttgcctccgggtgcgccatctccagaagacatggtgatgcagacgaatggacgatgaacagaagaagaggagcagtcaggtgatgcagacgaacggacaacgaacagaagaagaggagcagtcgtgcggaagcactccccaaaagccttgctcgttccgatctctcgtgcgcgcaagcgatcagaaccggggaaacagaaatgggaaggaaagcgtggagatctaatcgggatcagaaccggggaaacagaaatgggagagaaagcatggagatctgatcgggggtctctgtttcctaatagcgcaagagaggaatccgcccgttgccatagtaacgacgcgatcaatgcgtattgaatcgcctgcccgttacagaggcaatctcgcggggttggattccggtccattgcaaaaggatcgagagagagacgcaacgcaacccaacccaatgcaacgcacgccacgcctcgcccatggctcggcccggccggctcggctcggcgcgcgcgtggctttccgatccccacctcgaccggtcaacagggagcctccaataactccctatttaagttgagatactccacttttaattcctaagctggtattattatccttaacattattattggcccttgagattttaatagaaaaatcgggcctagcccatttattctaacatcccttactcaattcttgaatttaagccattcgctgctagaggaacctatttgaatgctttaatttttcactatggaacttgatcccactgcagtgaaaatctgcgacgaaaattcatattctgatcatgataaatcattcagttcactttttttagcacatgaagtaaaaactaataatattggatatgtaattatccaaagatttaattgcagcttgtgcagatctttactcatttcttctattttatctatttttacaagctgtttttttttctcattttgttgtatacaattgatacatagttgtgggttgtggccatgtgcattccccaatgtgctacctcaagctcatgcaaatgcatatggagtcaaactaacatgtgctgtgatttcattcatttgaaaatcgtaatgatcaaaaggtctttatatttaattttcttcgctctcatagtgatttcttgcatcattgatgtcaaatgtttttacgctttctgagcaaggtaggagtactcaacttcgatgcttgatgatgaggatcagtagatttttttaaaaaaatctactatgtaaatcaagttatgcccgcaacaacgcgcggggtgtcatttagttctacataaatcataggaggcaagtcatcaagctgcaatgggtggatgtgctgctaaaccaagtcacaaatgaaatcttgtaaacaagttatggttggcacccaggaaggatattagagtgaacacaatgcgagtgacacannnnnnnnnnnnnnnnnnnnnnnnnnnnacttggagcttgtgtgtagttcgagttctgcttttcctgctggaattaaaccctaccactatgttggatgttttatatttttagatttatgcatgtattgacggtttaaatttggtatttaataactgtcaacaaagagcaacggggactgactttgtagcctttttgagttttctattgtcgatagacatcctccagcccgtgacggtacgttgtgggatcaactcgtttttttgagtttttaacgattgtcattccacctttcttagacactacctgaattgggctaacccactctcacatcctgattttcgtttcagaatttataaattatttttagaatttatattaaatgtttattaatttacaaatgaagttaaatgtgggaaaataaaatttcctaaatataaagcatggctggatttaatttgtattaaattatccattattaattacactcaacgatgcatatcatagaggatattcaaggaatggttaaaggttctttttgtgtaaagctcattttgtaattcttttcataagcctaagacctagcatagactgatcaggttttaataccattattcattaaacagtaacgcttctgtccaccatccgttgtgatcccaaggatagcttccggccactggaccatcatggttttctagggtctaccctttctcgcttttcgagaagttcatccaccagtacaaaatcatcatgcatatcccacccatcattttaagaatttagattctaggcaagtgtaacacatgtcccggtgctcaatatccacgcgcacagctattcgaatatgttggtttactcacactgtagtggatatacactccacctgtacgccgtgacttgcccaacacatgagccaaagtccgaacgaatgagatgcgtcatggcaaagcctttcaataacctcactttggcagtacccgctccatgaacttgagccctcatgcactctaggcatacatggtttctagtagtgagaggagttctggcgttcccgaggagggaaaaactcacacatgcgttaagttatagttaagttaggttttaatttggttgcccacagatggttacccaccgtaggctccccgcctattcacacacctagatgaaaaccagtgcacttgggtaccacctctgctcggctatttactccgctaggtctatacccatacgagaagtatggttgtactagggtcatttcatgcttagcttcaaggcacggtccttaacagaccaaggacggcactagcctttaccggacaccacccaagtcatccagccactagtctaaaaacatttgtttagtttagatttcctttcacaaaccattttgttcatgttatatcaaagtggcgctcatgtctccacatgccgtatatcaactagcttccccaaagtagatgcccaagcatttaggggctgtttggatgggactaaaaatttagttcctatcatatcggatgcttggatactaattagaagtattaaatgtagattattgacaaaacctattccataaccctagactaattcgtgaaacgaatctattgagcctaattaatccatgacagtaaacttgtgctaattatggattaattagacttaaaaaatttgtcatgtgaattagatctcatttttgtaattagttttgtaagtagtctatgtttaatactccaaattaatgtctaaacatccgataagtccctggatccaaacaccaccatagcatttgataaacatggatgtgcatgaatctaagtggcattgactaagcagttattagatttacgagacacaatattgcggatacaaataattgcagggaatcaacatcaaagtatggtgtgtgtgtatatatatatagcatgcaaattttacttaaatcaacataacttcacaataggtttaacatgctcaaagattagagatgacttgccttgctcacagccttgctgaccctggtcttcactcaactcatcaacttcctagggatctagatttagacacgaaagattttatttgaattcgaatagaattcaaataaaatcaccataaattcatataatacaaaataaatgataaaagtgataccatcagatagatcttgatcttagataaatttaggtttaagtttcattcaaatccaagctatgctagtttaaagattcaactttgaattaattcgaataattgtgaaatggcatttgacggagctcggggctcctcaccgggagaccgcgcaggcccccctttgccagttcggccgggggcttagggtgagatctcaagccctcgctgtgtgtggaaagatcgcgtgccaggaagaaacgcgagacacggacgatgtatacaggttcgggccgctgggaagcgtaataccctactcctgtgtttttggtggatctgtgtaagagcaagttacaaaaaatcaaccagccctctcctctctcgggaaaatccagccccctctctttgtgggcatggtcctccttttatatcttaaggggataccacatgtaccctttcctttccaaactggacttttcttctctttatggacggagattggtatggttgccgtccgaatgacatttcgatgggacaacccacacctacctccactcccggcggagacaggcgcaacgtgggatcgtggctgtctgttgctgacgcgaccagtgtcagaccggtcacagatcggtcattcttgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctaaaggctctcgtcttgacgggacggggcgaggcgtgcctcagaccaccagtcgccacctaaccgttgatccgaccggtctgtgactggtcacagaccggataaaagagcgcgctgcattgcgctgcatgcaacgtgacacgcttgaccagaccgcaataaatgcggttaggtgagccctaccgtgttcacccaacctatgtacatagtgcaaaccccacagggggtcggggcacctcggccctcggggtcggggcaggagcaacccgaccccccctcggggaaatcaggaggagggcggacacctcaccctcgggcccgacgttcccgaaggtgccaggccacgtgggcgattccatctgcctcaagcctccgggcgcaatactcccggtcccatatcaccgacagtagcccccggcgttatgtcagggcaatcatccttctcaaggaaggcggtcgggcatgacgccactcataaagcctggtgacaggtgggaccggtctccgtgattgggcagaaacccaacggtctcaaaccacgcatatcggtaacggtgtcttgaccgtcagtcatgggcggtctctccaagactgccacatcacttgagcagcgctcgaatctgggcgtgtagattcgtttcgtctgaagatatggtaacgtcgcttcggtcagcgagcgtaattaacgcacgcacgatacgatctatctgggctgccacagccgcatatctaccttatgcgccgcaagcgggcgaatggaatttagtggaagcgtgggcgcgagaaacgagggagcgagatagcgagtaacgagggagcgagatagtgggcacgagaaacgagggagcccggctcagcgatggcaagggtataaagctatcgaggaaaggacttgctcccttccttttcgccactattcccctttccttcgccgtttgcgcccctaactctctctttgctgcgcctcaccttcgccacacacactcgttctcaaccctctctttctccgacgacatggcacggggctccgctctgctcgacggtagcgtactaccgccttcccgcattgtgagcgagaggcaggctgggctgccgcgccgcttcatgccagaatccgccaccggccgtgagatagtaatgctgggtgagggacgcccggcgccagactacccggggcggtccgtcttctttctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggcggctgctatttcctgccgcgggggccggtgttgaaccgctacatcccctgcgtcctccgcaaaaagtgggatgactggaagagcgactggttctacacccccctcgccgacgaagcgcatctccgacttccgagccagcccccggtgcaggcctccagctggcgggcgccggtagatctgggggatggctatgacgccgtcctcgaccgcctcgcgggcctgcgatcccaggggctcaccggggccatggtgtacggcgactacctccgtcgtcggattgcgccgctccagcggcgcgctcgggccgcctgggagtacatcgggcccgaagactatatgcggacccaccagggggtcagatgggattgggcccccgaggacttcaagatactgatccaacgggtgctaaatctcaactccgtggaggcgtccctcatccctcacggtatcctccccctctgcagcgacccagatcgcgtctccatcttgaccattatgacggcggtcggggcctcagaggagcaggctcctaagggccatggcggcgcaggtgggagccgccggggggatcaatctacccccggagggggtcgtgcttctgggccccgcgtcgggggctcggggagcaaccgccctaccgacgcccgggggaagaggaaactgggaggaatacctcccccatctcctccccgagggggcggggcggcgcgtgccagcagcaggcgcccggagggggccgcgccaacatcgcagcccgagggggagcgcaagaagaaacggctgcgcaagatgggggagacagaaccatcccagggaaacctaatttcccctccaaggtggtcatttaaccgaccccctcgcaggttcgtcccgctctctttgcgaccgtcttttcttctatcccaaaagcaagttttaccttacccatcttgtttgccttctggttttttcttctgcttcagcgatgtcccgtcgcgtccctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagctgaagaagccgctcgggaggaggccgcccgggcttgtcaggctgaagaagccacccgggaggaaaccgcccgggctcgccaggcagaggcgatggcgtcttccgaggcggtttacgacaagaccgccggcgcgtcgctcgggcccactccctcgggtgacgctcaggcgacaacctccggggcggcttgcgacagggccgcgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccaccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgccctcgtcgccaccaccgcgatgattgaggcgcaggactccctccgccttcaacacgggagctgggaggcggagctaaagaaaaagctcgacgccgcccagggggtcctcgacgccgccactgcccgagagcagcgagcaacggaggctgaagcggcgtcccggcggcgcgaagaggcccttgaagcccgtgccatggcgctggaggatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccgcgacacaacggctggcggacagcctgtccctccgcgaggcagcgcaggaggagcaggcgcgccgcaatctggaatgcatccgcgccgagagagccgcgctggagcaacaggctgctaacctcgagacgcgagaaaaggagctggatgcgaggaagcgcagcggcggggcggctacgggcgaaagcgacttagtcgcccgcctcgcagctgccgaacacaacgtcgcggacatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaatttcgcgctccaccaatctggaaggcctcgccccgcaccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggatggcgctggaggagttccctcccgggaccgaggacgatgcgcgcgcgcgggtccgggatgccgccaaccacatcgtccaaagcttcgaggggtcggcccctcggctcgcgttcgcccccagctccgacgaggagggcgacgccagcggcgaggacgacggtggcgacgaggccagcgacccgggcgcattggaatgagcccccaggcccccgccaatctccaattttttctttttctttcttctttttgtatagatcaacttaatctgcaatcaaaaatgatgaaaaatttctatgttaactttgttttgttatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattctttagaaggaaaaacggcacagacacaacctttaggaaattgaaactgcttttattgaaatgctaaaataagaaaagtaaggttgtgcatgtgtggtagcccccggctaaccctgcacacccgaggggggtgcgtggttagcccgagcccgaaacctgacacccgaccccccccctcaggggtagaagcgacgaaggtgttcaatgttccacgggtttcgcagctcagtgccgcccccgtggccagccttacggaacccggccgggggaccccgatcactcgatacggaccctcccacattggtgaaagcttg

SEQ ID NO: 28772 - DNA, 2069 bp, Oryza sativa
agttcactagtgaattgggtgccattatccgtaataatacggttaggcactccaaaacgggccgtgatgcttttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcgatcaatctaagggagcttggagcgctcccttcgggtcccgaggcctggactccgacgggcctcgggggtcggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctattccgtcaaaatggcgctccatacgccgcacttggcgtacataggcgtccatttgcgggtcggagcaccggtactccttacagacctggttaacgaccagctgggaatcgcctaacaccaggagacggcggatccccagtccggctgccaccctgagtccggcaaggagtccctcatactctgccatattattggtcgctcgaaagtcaaggcggaccagatatctaaggacgtctcctgtcggggaggtcaacgtgacccccgcaccggcaccctgaagggacagagaaccatcgaactgcatcacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaactcagaaagctcgattgcccattttaccacccgtcctgtaccctctcgattatgcaagatttgaccgaggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccactgcacctttcggtggggccgatcctctctgctaggggccgtatccccggggcgttcttcgttcaagtggcctttcggggcgcacttgtcttctgtgccgatgacctcggggtcggaggatgaaaggggcggccttccctcagtggcctcggggccgtcctgggggtcgggggctcctggcatcgtcggacaagcgggcaaagggccaactccggtcgtcaggggcctctggcctccgttcgactcgggggcctcttctccctgctctttcccgggtcgagtcagcacagggttagcctcggggtcagagggcgttaagtgcggccttcccgcagtggccttggggccctcctgagggtcgggggcacctagcaccgtctgacaagcgggcagagggccgactccggtcgtcaggggccgtaagccaccgtccgactcgggggcttctcctccccgctcgctcccgggccaagttagcacagaatgggggtgcacgaaatgaggattgttttcatcgcgctccacaccaacgctgcactaactacttggggggtcgccgcta

SEQ ID NO: 28773 - DNA, 1907 bp, Oryza sativa
caacgcgggcctccccaggaccgcgttgtagggcagactgaggtccgccacataaaagttcacccgctccgtgcggaaagttggctgatccaccaaaggtgaccggtaggtcgatgtgacctaacggccatgtgtgccccggcgtcacaccaatgatcggttgagacggctggagcaccatccccgggcctttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgaccgacgcgtcgcctcatgagtaggggccgcggcgagaagctctcgcctcatggccttgaaactccggcgagaaacgtgagcacacgctcccccgtcgacagtggcaatggtggccccaggttcttggaaacctaggtcatcatcaccgtcatcgatgtcaacggcgggggccttctgtctggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcatcgatcccggtcgtatagacctggagaaactcggtggggttgacgctctcatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgccttgatgacacagagccggtggtggcggcgccggaggtcctggtagtggcggaccgtccaccagcacccaggcgctgctgtgccgtcatgaccaagttggccacgtcgtccagccatcgctgggctggagactccgggtcagggacgacgggcgggtgacgtatgagcgcgccagcagcctgaagcactccctggggcatgctg

SEQ ID NO: 28774 - DNA, 2204 bp, Oryza sativa
accccccctcggggaaatcaggaggagggcggacacctcaccctcgggcccgacgtccccgaaggtgccaggccacgtgggcgattccatctgcctcaagcctccgggcgcaatactcccggtcccatatcaccgacagcattgttcctaattgatttatttttttaatcgaactctatccttaagtctcagtggctgacatgtgaggccatccctatttcctttttctgtctttatttctctaaggaaaaatttgtcgtgtcactgactggtgggcctggcctcttttgaccgaggtcaaaccggtattattaatcccggtgggacccacatgccataggggtaccatataaattgtttttttaattagattcctgattgctcgggcccacatgtcattgtttcaactaaccatcattagcatggtaattactatgcgctaatagaaagtagggcttacatctctccaactctccctctctatctctttcatacccttcttcttcctcacgctcacagcggagcagaggagcggcatgcggccagtgcggccgacccgagccgggacggctcggcgcgcggtcggtgaacggcggcgcgcaccgctggggacccacggctggcgacggcgaagcgcggcggcctcccagcacacggcgcaacggcgcgcggtggcagccggttatgcgtgtacggcgatggcacaaatggcgacgagttgaactcggccgagcacgatttcaccatctaggatcagtagggttgccatttaatcaaaaatgtagcctaggttgcatttgaattcgccctctccacggggagctcgacggcggcgcggtggcggccggaggtggtacggctacggcggcacatagcccaaattgggagggccgccggcttctaggtcactaggaggtgctcggtgcgtgagggcttaccaaatgatggagtaaggcgaaggtcaacgacgcgcggtccgggccgggtaaagcagaggcgaacggcgtcagcggcgctcgaaggtgttcgacgcccgttcctcggcttccgatagcctccggctcgttctaacaacagcagcagcagcgcctcgaggccaactccacaccccgccagtccgccaccagctctagccaagtggcaaggtagcggcagcgcagtccccgcccaccaggtgttcgacactcgtcaccttgggttggagagagaggtttgagtgagaaactgtttgagaggttgtggaaggatgggagaacgctttatatcgcacgtccgacgaatcggaaatatcggacgcctcatctaccccactggaaatgctgcaaatcggcagatcggatgaaccctatcactgtaacatgtatgcctagctatttcttttcattctttcctcatctctttaaatatttggtcttctaaattacttatccaatctacaaactgattacgctgttgtattcgttccaatgaaatatttacatcaagatatcatatgattatattatgtcgaaagaaaaatatgtgtttcaaaccgttaaaactaaatatttcatacgtgatagtgatatgtttcaatgtgcgtcttcagtgtgtttcattacattcctgaaactgcccgctacttctctctctcctctctctccatctcatccatgcacacgtgcatgtattttagtaagcttcaaaataatttttctcttaaattatttatccaatatatgatccaatcacaccattgtattcgttttaattaaatatttacaacaagatatcacatgattatattttgataaaagaaaacacatgtttcaatccgttaatacttgttgtttatacgtggcagcgacatgtttcaacgtgtatcttcatcatgtttcataaaataattaaatgtttcacttgctaatttttttgtttcacaatatataacttaatgtttcatttgttggtcaactgcaatatttgaccgtccgatttttttttagcatcagacatccgatgggtagcttcctccggaaggatgaggccgactagagggaagcttaagaagctcaaacaacactcgaataagggcaatgaggtggccgacgcagataagagtggatttccttctccattaaggttttgtaggtaatcatcacatctaggacctatggaatgggtgttctagtactagctgagggagagggctctgttttatccat

SEQ ID NO: 28775 - DNA, 3672 bp, Oryza sativa
  unsure (1)..(3672): unsure at all n locations
actcatatattttggaaacactctattaaaggaattcgtttcatttgttgtttcacaaaaatgtttcacctagtatactcacaatgcttcactatatatagatctaatgttacagtgaattaaaatattcttttgcaataaatcacccacatattatagaaaccctctattaagagaattcgttttatttttttccaccaaaaatgtttcatctagtgtacttataatgtttcactatgtatggatatatcaaatatgcagtgaactgaaatattctttcgctatttactgaaacattgtttttatatgaggtgaaacagcgcacgatttaaatgattgaaacattttcgatctacttagttaaacaattccgatatacttggtggaacatcgtacaacatttaaaaataattcaatactaagctaattttttttcgtcggaatatatccatgtgtggtatgttttaaagatttaattgcaacgaatttaatggtgcgatcggatcatgatttggataaataatttaagagaaaaactagtttaaagtggtattgcacccatgtatcgtgctgacgtcatgccagcatgacgtgggcgcccaaattacccaccccgggatcaggcgccggacgggtagtcgcctccaagattttcctaattgacatgtagtggcttataagcatttgtgagaatatttaatggatattttatattgatatgaaaaatacaaaccgtgattaaagtatatttaataagaaaaatccactagtacagatccttctatctatgacggcctctaacatgcctggaaatagcgggccatcacaaggaagtcatctcaatcaagccgaaaaagtgtccgattgagatatgatcgcacagacatattagaagggcataaaacttaagcccgtcatggatgacacctatcagtgacgggctatagtttaggcccgattgagataacattccatatctcaaacgggccttaagttggggtccgtcacatatgaccatcatccgtaacgtgcaccaacttgaggcccgtcacatatgactcatcagtgacgggctatatactaatccccggttgacatgacttaatctctatcgggcattaattaaagcccgtcactgatgagtatttttccatttttcataagaaatgtttatatttgtaagttgaactatagcaaaataaataacttgcagtataataattcaatttataagtcaaaataattttacgcgtagtaaatgatatcaaatagaaaagtcatcaacaacaaagttgtataactcatcaagatctataacttttattttggtcatttttctatataacaatttttgaacagtttgaatttgaatttgaaaatatgacaacttcaaacaatattttcaaatactaaatgatttcaactaaaaacgttatcaacaacaaagttgactaactcatcaaaatctataacttttattttggtcatttttctatataacattttttcaaccgtttaaatttgaatttaaaaatatgacaacttcaaacaacattttcaaacactaaatgatttcaactgaaaaagtaatcaacaacaaagttgaataactcatcaagatctaaaacttttattttggtcatttcttcatctgataaaatgttagtaacattgttcacaaattttacatatatgtattatagtttataaaaaccagacaagagatatgtaaattttgtgaacaatgttacaatcactttatcagataaagaaatgaccaaaataaaagtcttagatcttgatgagttgnttcaactttgttggttgataactttttcatttgaaatcatttagtatttgaaaatattgtttgaaattgtcatattttaaaattcaaattcaaacggttcaaaaaatgttatatagaaaaatgaccaaaataaaagttataaaatcttgatgagttatacaaatttgttattgatgacattttcagttgaagtcgttcactaacaaaaaattctgtttgaatttctcaaactttgaacttcaaatttcaaattgtttaaatagagtcggatggagaaatgaccaaaataaaaattgttttaaattgtttgcacctcgataagctctacaactttggttttggtgacttttccatttgaaattatttattaaccctaatttttgttcgaagttgtcaaattttgaaaattcaaaatttgaattgttcaaatgaacttatttgtacaaaggaccgatacaatagttgtggatctcggtgagttatacaattttattgtttaggatttttgatggttgtgtatgtgaatgaatgtatatgaatgagagatgttaggattaatagaatactcataccaacaagttacaactactctttcgtaagccgatgcttggcctatagcaatttcgggatgggtgactgattgggaagttcttctcaggtgcacatgagtaaagacaaaaaagactagcctgagagatgctagacggcatgcctaaaaataaaatttattttttttgggattatactcatctgtgacagacattaacttagacccgattgagatgactcatctgtgacgggcattaacttatgcccaattgagatgactcatctgtgatgggctatatttaatgcccgtcacagataagggtcatctgtgatgggctatagtttaaacccgattgagataggtcatccgtgacgggctatagtttgactgatcgtctgggtcaaagctatcggtgacgggctttaattatggccagattgagataggttcatctattacggccgtttgcccgattgagataacttttcatatcagtggcttctagcctgtgacggacgccatgcccgattgagatgggggttaccgcccgattgagatgatggtatccgttctagtgatcgtaacaaaacaaatacatatacaatatttttataagtcagttgcttcgtatatgtaaaatagatggtacacatatagaatttgcactgataaatggactatatgtacgaggaagacgaaaaatgcaagtaataatacagctaattatccaaccagttgcctcatgcaaaacaaaaaccgtggcagctcatgcaccagtaatcctacctactacgaccatgcaatcgttctcagccaattacatcctcagctatggcccgaaaaaagttgttggtctatcaattcataatgttgttagtcacagataaaatcagcaaacgtacgaatatattgctgtagcacttcaccggaagtattccaaggtatcgaattttcacaagaaacgtgtgtgcttaactcttctccagattcacccaagggacacaaggcataaattgggaaaaaaatagagatgattttctagtaaggaacagggtcttaagaaagcttaaatttaacattatcacactacttcatgcactagctttctcgttgctacccaaacgcgctctaatccgtacccaaacaggatggactcaagtgatctcgagagctgtcaccacctctacatcagcctcaaacgaactgttgaatacgcagcaaatataggtattcaacagtatagacatcacgtaggctcaaccgcacaaagtaaatctcaattactcgataaagatattatcaatttaagtag

SEQ ID NO: 28776 - DNA, 2637 bp, Oryza sativa
ccactatacaatcgtgcaagttaaaagaaaaaccaaaatgtatcttcgttgtacaggtgatatccaccgcttgatttaattatttttgtttgtcgagttgtaaatcaaatttaatcttacatgtttgtctatagacatatagcatcccaaatgtttagcaccgaagaacattaacctatgccacatcgtgtcaagagcattcttagaaatgttgatgtagatataggcaccttatgggcctcactatttaattaaaaaaaatatgttgcactcaacttgtcatgttgttccatcagataaacgtggtatcgtttatgtttggacaattacttgacagttatttatttgactttattatgtacttagctataaacactcatgtattattttttgttaacttcgttaaaaatatcaaaccagtgctccataaaccagttcaacgccagctggcagctgcattactactattgcatgtgttagctagctgtttcgcttcggaaaaatattttctacacttggtatcatgtcacccagatgtatgcatgtagattatatagtataaagcactatacaattgtgcaagttaaaagaaaaaccaaattttatctacgttgtacaagtaaatatccactgcctgattttattatgtttgtttctcgagttgtagatcaaatttaatcttacatgtttgtctatagactcatagcatcccaatagatgttacttttttttaactttttataactatttaagtcgtatagaaataatggttgccatgatatctagataaaaaacctatccgccctctacttctactttgctgctcgctagctctttcatatttttttccctcaataattcagaggcgttatggtgctcttgctctatataaaccctccaagcctctggccgacgatcaagaaccactttgcccacgtacatacaccgacagccatggacaccccggcgttgctcccgttggcgcttgcccttgttgccatcccgatcaccatccttcttgatcttcaatcggatccgcctcggcaggctgtcccccgggccccgggcgtggccggtggtaacctgttcgacatcacgctggtgcggtgccggtgcttcatggagtgggcaggcaagtacggacccatcatgacggtctggctgggcacgtcgccgacgatcgtggtgtcgacgtcggagctagccagagaggtgttcaagaacgtacaatgatcagcagctcgccgaccgcccgcggaaccactcggcggagcggttaagccgcggcggcacggacctcatctgggcggactatggcccgcactacgtcaaggtgcggaagctgtgcaacctggagctctttgcgccgcgtcggatggaggctctcaggcccatcagcgaggacgaggtcaatgccatggtagagtccatctacagagccgtcactgctcctggtaggttgtacagcacgatgaatgaatttaatgtgttttgcacgcaacatcatgtgtcttaacaaacgctattattagattgattcataattacatagttgagtgtggcccgtgtaattgcgcggcaagcatccgtataaaatattttgtttacatatatttttctttaaaatttgttaagtagccatatagttatattaggatttcaaaagatcaaattttatcattgtcaagttttttattttataatttttaaatgtcacgttagccgccaatccttttctcctgcccgacctgccacagcttttattatactttaaaaattggatagtttgtctagttcattgtcttgtcgaattttgatttgtagttttggaagtccctttaaacgtcaacattgtactcctctacggtgtactaactttcaacctctttattatcattaggatttatgaaatggaacatgattatagttggattttcgttttctttttacttccaagaagtcctgtcaaccatcaccaccgttctcttttaatttacagcctacccaaaatctttccttctaatcatcctttggtttctaaatattgaatctagtaatcattaggagttttggtttttatttttaatatcccatcaacctctaccaaccctatctttatggtttgtctgatgtcccttttgcatttatggtcacttaccaccgttatgttatagatgtaatatgttctattaaaatatcttatctgttatttataatttatattcctactcaaccctcattttagtttttctaatcacataatttaatttatttttatttctaactttagttaattccgtattgtagtctatatgaattgttatttcatctatttcctatttaagttatttgtaaataatattcattctcaaactctcatttttatttgtcaactttcagaatttataaaatttttatcccggtttttcattaatcttgtgttgttttaatagtttttatttttatgatgaatttagttgttgataaattgtatacatgaactcatattttgatttttctaatttcgaaatttatttatttattattctaattttaattaatctcgtattttgtactacgattgactattcttttcatattacactttttaattttcaaatttcagttatttctaaa

SEQ ID NO: 28777 - DNA, 20397 bp, Oryza sativa
taaaaggaggaccttgcccactgagaggggggactggacttttccagattagaaacccagaacaagggagaggctggctgatactttgtagctccttcatacacagatgtcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggtgagatggggagcgtcgcctcctcgtctacggcgacggcagcacgcccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagacgaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcctctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatgatgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccgctgcatccaagcccaagggtggcgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacatcaatgcccttcgggttaaagaatgcaggtcctacttttcaacgtactactcgaatttctttgggtagccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagaaggcgttaccccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggggagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcaaggcgccggtgcgggggtcacgttgacctctccgagcggagacgtacctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagatggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgagaacaaggcgttgtgcttcttgccgatatccatgaaggcgaatgcggagcccactccgcctcgcgcaccttggttggtaaagcttttcgccagggtttctattggccgacagctcttaatgatgcagtcgacctggtccggcgatgtagagcgtgtcaattccacaccaagcaaatccatcagccggcccaggccctgcagaccataccactttcgtggccatttgctgtctggggactcgatatcctgggaccatttaggcgggccccgggcgggtttgagtatctgtatgtcgcgatcgacaggttcactaagtggcccgaggcttatccggttgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaatattctcaagaagcacggcgattcatggatcgaggagttgccagcggtgctctgggcaaaccgaactacaccaagccgagcgaccggggaaacgcctttcttcctcgtctacggcgcggaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctttcaccaatgtgggagggtccgtatcgagtgatcggcgtcccccggccgggctccatacggctggccacgggcgacggcactgagctgccgaacccgtggaacatcgaacaccttcgtcgcttctacccctgagggggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaaacccttattcaagctaagacacaaaaggaccacggcacagatcatcctcatctcatactcacagcaagatgaaattaacacaaaaatttcttcatttttgattacagattaagttgatatatacaaaaaagaggcccgaaggccttagaagaaagaaaagaagaaaaaactaaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcaacgatatggtcggcggcatcccggacctacgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagatggcgtcccaaagcatgccaggccctacctcgcctgccaagcggagggcttcgacctccccggcggacgagtccagcgcgccctgcagatcggcgatggtgcgttcggtagctgtgaggcgggcggctaagtcgctttcgcccgtggccgccccgccgctgcgcgccctcgcgtccagctccttcgcccgtgcctcgagctcagctggcccgttggttcagtacggccctctcggcgcgggcaccttccagattgcggcgcgcctgctcctcctgcgctgcctcgcggagtgacaggttgaccgccagctgttgcgccgcggcctcggccccctcgagagctcgctcccgttcggtgagcgcgtcctcgcggaggcggagcgtgaactcttcttcggcgcaggcagcctcgtgcgccaccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagaatgaatacagccacgatgggtgagagacgaacctgtgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcacccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctgctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaaaattaagagcgagcgcgtgtggcgaaggtagggcacaggaaagaaggagttagggcgcaagcggcgaagacaaggggaataatggcgaaaggaaggaaacagatcccttcctcagtgcctttatacttttgccaacgctgtgcccggctcctcgcttctcgcgcccactatttcgccccctcatttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatctccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcaccccctcggccccaagggccgaggcgccccgacccctcgtgggtctttgctccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcagatcgtgggttaggtggcgacaggcgatctgacgcacgccttgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaatctccgtccatttatgaaaggggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcaatgtcaatgcttgtcaacatgagattatgtaacattatgtattatatgtaatactatgtgatgtgatgtctctgtatacatttgcaatgctaattacatataaatttgttcaaatttataactcggttttgtaggttttgatgcttagctcttgaagacgctgatacaaatgaatttgacgttgtgaatgtacatatatgctgttgtgaatgtatggctttatagatggcatgtgatggatttgtgaaaaatgttgggatgtgggtttgctgggatgaaggaaatatataaacatgtgtttctttcttattttgcagtgaacatagctagtaaaggactgaggctagcgaaaaaaacaatatttatttttttggtaaattactcattggtgacgggttataaaaaaacccgatactaattaataccaaaggcaacgagtgtaccttagaatccgttaccgatcagtcatccgtgatggtcaccatactatactgacaaaggtgacataatcatctttgccggtttcaagtgcgcgcacgtcacggatgactcatcaatgacgggccctagtttgactcctctgctaggtcgaactcatcggtgacggggtttaacattggcctgataaagataactgtaatccgtgacagcaaggggcccgatacagatgacctttcacatcagtgaccttttgttcgtgacggtaccctatcccgacacagatgtggcttcccgcccgttacagatgagccatcccgtgctagtgtaaactcgaacactagttgatatgaataaaaaaccaccagacatggcatggatcaagtggtagctgacaacgaggacccccttgcaatgaaatgtaacacaccaggtgtcaagtgaaaaattggatctagcctcttatctgttgttggataacttcgttctatatgtatattctcatattggaacacactcttttggttatttgtttcaataaaaaaaatgccgtttttcttcttccttgtcgcagtatgcctatgttggtttattaaatgagttaataaaatttaataaatttataacaatacttttcatgattaatctaccttttttatgttttcaaactaagtatttataaagatctattaatattcactagtgcggatctgtatcaggcgtgaatcctcatctgtggtggcggacggtctggtcacggatgcggacggtctggtcacggattagtgatcagttatgtgaaaactcatctttatcgggagagctaccgtcaccgataaggcttgatcacctttctcggggtaccgtcacagataactaatcggtgacggtttcttgtttagaaacgacaaagttgttcgccgtcgtgactcgtgacatgattttttttctaacctgacaccgatgagtttatttataaaaaaaaatagatccattttattggctagtgttaggcatttgctagccatgcttgctgcaattaacagaaacatagatatatactagaaaggagagcgcggcgcacgccgcgcgatagcaaatagttctgcataaaatggttagatagtagataatattttgataaatacggtctacatttgtttaataaacagagtacaataaagtataagtagtccttgtgaatccattaggtggcttaatagaagacaacacaccaacaaagatgaacaataaaaaagtgaattgggctataattttcatcaacaaaaaggacaaacactttcaaatgggtcatttagtggatgctatgattggcattcttctccaccataaaggactacaagtggaaagagctcattacaaaccacaattctgtctgcaaacatcttcaaaccagttcagcgcagctgcaagatgcaaatggttcgctattcaagcgtgtaaacatgttttatctttcagaaggtcactgaaacatagggcatacgtgagttagaacaaaacagatgattgcttaataccttaggaggcataatatatccatttcaacttttctttcgattacctgcatgctcagtattcaacatgtcttcccaagcacttttacattttgtctgcaggattatccaagaatatgaattagaaatgaagattgctttataatcgatgaacagtttcagataacaatggtcgatagcatttgttctgaaatcacaacattgtaccaagaaatcaccagtttcggctgaccatttctgccaccagtagttgtgacaattatgtggccggtttctgctcccttgccgttaatattagtcacttgaacttcctgtatttaccatttagcttaacatgttacaatgaagtcaaattcacatggcacatagaagaaattgcacttctcgtcataataaaacttacattgtcatcccttatcttcagatcatgcatctgatcaggcaacttctcagcacccattgtggtgaagctgctgttctttaacccagatagcgcagcccctattgaagccatctgttataaaagctaaacaatgttgagtcagctttgcatccacacagaattccgcaatgcatctatcagtcgacctgcgagatcgtcaacaacaaaacatcagttaaaagtgaaaccgcaaggtttacaatgcaagcagcaaacgagaaggattactccttcacactgctagcaactcggtgcatctaacacgcattgttaatacgagtatatgaccaccagcatgaaacactcatgggagagctatatgtgcattggctacagagaccatactgcttgcagcagtcaactgacttggtgtttgtaagtttcatgagcagaagagttggatcagagactcggagtattattcctgcatggttcaggaaatgatcaaatggaatctttttattatgtcaaaatggcaatacatatacaacacaacaatttgctaagtacatataattaatgaatagaacgaaataatcggaaagattaactttttttccctaaggagaaaaacagagagcaagtgacatgaacgatccccactacctatttaccttatcttgtactcctatttggttgtcattatgatgctggcagctccattcatgaagatccacgagctgagtatagtgggttgcccctcccaacattaacatgagtaatgaagggaatctattccttgaatattgagctaggatcttcggcctaacaagaacgactaagacgacattagccacaaatcataagcatctcagatgaaagaactttttttttgctaactcctcttcaggggaaaactaaatatttaccgttaaaacataaacagctacttgcacagagcctgtaaaactgcaattgccttaaattgtgccatatttgttattcatgtatacaaagagaagaacacagggagactatagtagcagttcgtaatggcattgcatatatacactcacgtgtcatataaatttaatacatatagaattatagacagcatcacagaatgaacacatctaaaattcctcatgattctgtgttgacaaaacagaacgaaactaacctgctgtagatatatatgttgtaccgatccatgaatacctcttgttataggtaatttgggaatgctaggattgattttgatagatcaactatctagtaaaccatagaacaatacatcaactccatagaacatagaaatagaaagaaagataattcttgtacgcaacatgccatgttaattctggaaggcaacaatggtgagaaagcctaattttgtagggaattttttttacatgataagatagaagcaaggaaatattaactattatgcaattactggattgagtagctgatgtatacacatgtcaattacaaacaatggcaatatatagcggaccgtttgcaaggttacacaaaaatatagttgaatttcagaaccatctgtagccatcagacatgcaaagaaccttagggaaaatggcagatcctagaaaatgcaaatagtcgaagccaaatgcttaatggtggggtaaaaagagaaattcctgcagcttacctttttccgttgactttgcctggatgtcttattctgaatggctacataagagcatgaatcagagattgagggaagtagctcaagaagctcctgcgatggccgatggaggcctagtcgacagcgttgacctctagcagctacaggagtggctgttgatgaaggccagacagctagaagccggaggggccagagacgctgagggtctgacatgctggagtggacgcaagcgggatggtggggggactcacctagcatgctgagtcgaggaggtgtcagatccggcaggaggaggctgcagtggaggttgatctggtgaggagaaatcgctaggcgcatccgcacctatccgagcacggatgtcatccgttggtcatggcgtggaggtgggggttgtgaagaagtagaacgaagggacggggaggaaggaggcggcgtgagacgaagagaggaagctggggctggcggccgagcgtaccggccggcttagaggaggaggtatggcgccgtccgtgaggaggagggagcggctaggggtggagcgagcctgctatggcggcggcggcggtggggggacgacatccgcgtcagatctggaaaggagggccgccccgcatccaccctccgcgccgcctccacccttcacctccgcctccaccggatctgggaggaaggaggggagccgccgctggctccacccctcgcgcagccaccgcctgaagccgccgccgccaccgccagtaactgccgccgccatggcagctcgagccggaatctgagctgagagaggagagatgggagagaaggggaggggaggagaggagagggagagaatgaggggagggtttcaggattggggtgttagtctaggacgttttgcggaaaaccccctatagttttcatgtttacagcgttacccctagaaggggaattttctcttcttcgttcgtattgtattttcctggaatacgagagattatacattaaaaaatacaatgggacgtaaggcatatatgatattccgtgcaaacacgaggacttttttgcaaaatagcctactaatgcaaccggctctaacccgccgtcaagaccggcgcgtgcacacgccccacagcgccaaaaaaaacgttggaccggtgaccgcttacgagcagtcacgcaggcacgcgcgaggagccgggaggaggaggaacgacgtgtaaagtaacgagatagcccaaaaataattcaaaaatcggagaaaaacggtggggttaggggagttattgattgatgattcccagcatccccataatcccagatcccatacatttcacaacaacatatacataaatacattcatatgcattttacaatcacgtttccattcacatccatttcacagttacatttccattcacatccatttcacattgttgtagtaatttaaaatttgtcaaaaaattcagagaacttacacaaaaccatcgatgcatcttgaagagttaaccatcaaacctatcaccgaggtacgatttgcaagaaataatgtacttagcaatacaaacatatacacaagcatcgaagattgtactacatatagcatgtataacaagcttcgttggggctcgatggaggccggcggtggagaggacggcagcctcgtcagtgcttggaggaggctagcagtggagaggacggtggcctcaacggggctcgatggaggccgacaagggagcaaaggacacccatagtagatctgaactggttgaagagtgaagagtgtacagtgaatttaaaccctagaccgtgatcttaactagaccattaggcgcgctttgcagcgccctatcatgagtaaaggtgttattatttagtcatatgaagtaagcattgaaatataaagcaatagaatgataggaaaagcacattatcactatgctatgaacagttcaaacgaacagaacaaatcattacgcatagagatatgtaactaatctagcacatttgcaaagcttatcataagtagtgtagcgattaatacattaagtgatgctccaaagcagtagttagatagcatagcatggtacataggaagccattgtccagattcgtagtcctagaatgggtctaatcccatcctaggttgtaatatattgggatggagggagtaacacatatcgaaaataatcgaggcaatgagaatctattatgtttatttaaatggcgttgtattgcagtttacctttatcctcctttaacaagttcacggtcagttcccttagaatcaatggttccttgtacccattgaaagtccatggtcagttacctcgaaatcaatggttggcttgtacccattgaaagcttttgatggtcggctttcttggcactacaataagtacaataagtatataggaaacgaaacatgtaacaatatcatggcatcgaaaatagtatatcagtgagcaccatgtgtagctaaaccaacaaaaatacctacatgaaaatcaaacaaattgaaataagttttaggagcacatataaggcaaaaatattcctttccatttcctctttagaatcaatcttcatagtcagcagaactgcatccctttgatcatcgtctatcacctgagacagttttaaagtaagaattttatataaattacaacacatttagctaaatgagttgcctgtgactacgggagttaccacagtagataatccactgaaatgagtctctggagatttaaatgaattcttactttgactttagatttttcagcatgtgcttggataaggacaatctgcaataacaacacataaatcagttagaagaaattctatagcacatcagcacctcactatttagaattgtaggtgtttcggttcatggcaagaggattttatgccactattttagctgacatgggacagtctcaatgggatgtgaacatggaggaggatatagctgctagcaaccatgagatacaataaatggacagtccctaaagcttgcatgtctgctctcgttgtaacaataagtcatttacagtgagcgtctaaacatatggtccttttaccagtgtagaaccctttatggtagagatgtattttaataatcgtcataaacaaaatcagtatgtcaggaaacacaaagaacatacaaatcgacatatttcacattttctcaaataaaaaaaatgctaagatgcaaatgtcacgtcaaagacatcttatccaatagttcggcgtgaggcatagctaattccaaaccaaaccaaatctagaacctcgggtactgtcacaaacaaattcagtatgtaattgctagggaatctaccttgatgctgagggaaaaaacaaaacatacacacaaacaagaaggaatgaaaataatctctctttttacagaacagcacaaggcatatatcacattgtcagggattacatcttataccgtcataaatacaacaatctttagttaacaaaaaaatcagtactccttgtaatgatacagaaataaagggaaagaactcacatgtctgtgattgtgactcggtgtggcattgtcctgctcgttgagcaatcagtgcctgttgtatacattgaggtgtgagcagttcggggcagcacggttgggcagcggctgcaaccatggcctgaggcccgagcgatggattcaagggagatcatattgtaaggaggaggcaaagcatgcagatagctgcaccacagcgctgtcacaaatagacttcaataccagcaggatgaatgagctacttgtacttccggtcgcaaaataaggtcaattgggtctgcatctaagtgctcgattaatcactgcagtgactcgttcctccaggttgcaacatcgattccttccagtgtgctcgtatcagttgaaccaccaaattattattatgaatcgaagccatcaaacctggatacgcaaaccagggagaggagtgcgtaccggcagtggcttaggcctggagtagtctacatcagggtagtcaatctccgccgtagcaacaagatcccacccagcgcatcagaggaggccggcgagtgagcgggtgaagccggtggagcgatgcggagcgcgtgccagaggacggagttcgaagacgccatcggaaaggagtgggccgagggcgtcgtcgccgcccacacaaggttcgacgcgtgggcgcgatctagcctcgccccgagccgcgtgttgccgtcgtcgagcgccgtgtggtccctcaacagggacgccgccgcggcgtccgtggcgtcaagcgcagcctagaggcggttcaccacggcatcgaacgatcgtagcagcgcctgggc

SEQ ID NO: 28778 - DNA, 1156 bp, Oryza sativa
ttacaccgatttggtcaacccatacccgtgaagggcaatataattaacgtcgccacagatgatagctatcagtgataggctagaaagggacaccgtcatggagagtcatccttgacggattggaaagaagcattgttgcagatggcatccgtgatggctattcataaaggcccattagagatgtcatctcaaatggttattactaaaagctcgtcatagatgactttttattttttttaaaaaagtaacatgttagtttttttggttccttttggttccttgaggatagaccactgttgacttatttttcttttctaacttagagatgtcacatatttaataaggtacgccgaagatgagatgactaagatgaacaaaatgttttattgaaactccagattacatggcaatagtagaaactgatgatggcatacaatgtttctattataaggataggccttcggcatgatctcaacatacatgcaccacctcctcttcggtgccattgtctaggtctatgtgcagactgacatgaaggttttggttctaatcgtcctcatcgacgacattgtcaaccctaacaattcttctgccatccctaacgacgtgcaacttcttgtttgtcgggtaatgtatgtagaaaattttcataacctattttgcaagtacaaatggttcatccatgtatccaaccttgcttagatctatagttgtgaaaccttccttatctacttttactccagtgcgtaaattgacccaatggcaacgaaacaacagtactttgaatttggtactgttcagttcccaggtctgctctatacgactgtagtatgagctagacccaagttgatcaataaaagcatctatatggacctcgctgttttgtactgtactcttgtcatcttgtttgacggtataaaacaatcccatgattgtcattcccacgatctaaaacaactatggcatttcagatccatgctgaatagaccgaaagaacttttatatctttcaagcaggataacatttggattttctcattcttcgataaggtgtggcaagttgaagggaggtacactcttcctgtgtccggattagttgctggtgcgaattcacttcgaatatttatctcctgtaaatctagacacatgtttaatcc

SEQ ID NO: 28779 - DNA, 4453 bp, Oryza sativa
gcattgttttggtaaatatatatatgtaggtcactaaaggagaaaatacacccgacatgcaacgaaaataagcctccgaccaatcatgcgcgagtagagagcccacaagtcagttgaaacatacttaaaatggggccaaactgtaacaccccaggtagccacgtacctagaatgccacaccaaaatacactcaaaaaccactaactccaaaaattattagaaatttcggcagagtctcccctaaaaatacggatatccacgacaggcaattataagataactcaataacaatataatccacgcaatccaaaccatcctagctccacaaattctacgtgaaagtaaggaccataactttaaatgacagttacaagttctacggaaaacttatgctaagcaaaaacatagtctaaaactaaatttcaatagtgtgcaataatagtgtgtagttcaagggtgctactcccgtcccatgccgatcaataccattaggtacctaaaaaccaaattaaatacaagaatgagtaaagaatactaagcaagtacaatattgaactagtaaaacatacataggtttaatgcaataagaaaccaatatgaaacatttgactttctttaatataaaacgaaggaggcaaaaagtagtagttccctcccgggcagatgtgaatatcctcttagcattaccgataagccgagcaagcgtgatcagcgcttctcaaggattatgaataaagatccaaattgcactcccatgactacacatggtacttgaataatgtaaacaaaaacttccagaagaatgaaacatgaataacgttgtgaacttgaacatgaagtgaaatatgaatatgtagcataataccaaaaccacacaattgataataggaagcttcgaataataattgggtaaatgaaaccaacaaagcaatacagtttatccatcacacaagtccatcttgtacttgccttaacttcttcgatactccgactcaactccaacgttggaaccctccacacctgtggagcaaaactatgcataaaccactatatccaaccaatgatagttacaagggataattactaaaatcgataacctagaacatataaactttttaccgatttgtattaaataacctatagcggttccattactgttttatacgtaacttgcaaaccgtctaccagaatctagcaaataatacaacttcggacatctatacaaaattgtctacaactttcatgttgggcacaaaatcagattatgcctatgaaaatcccagattaaggaaaacgaattgctgtcctgatttccggacccggtcagcagtactgtttttgttgtttctcccaaactgtttatcagaatcgaacgaaactagcagtgttagaaagatatcgacgataactacaaactttatttaggacaactaacctgaatcccgatggtttaataccagaattgaaaatacggtttcagcctagcgttctataaaaataaattcaagctaccagaaacggaacgtcttatatataaattagaaacaactagggaataaaacggattacctagaagtactaattttgtaagaaaaacaaagaatttggaaatatccaccaaactccccaaatttcccttcttctaactttttttcccttctcttcctccttcctgttcttctgcagcaacaagcagtagcagccaatagcagcagtagcagcagcaacgcacaagcagcagcaacggcagatcggcagcagccgcagcagcacatgcagcaatcctagcggcagcagcagcaacacgagacaaaaatcagatcgacagcagcaactcaccaaggagacgatggctgtggtaaccggcgtcgtacgcacagcggcggcggcgccgaggtgaagaggcggacgtcggcggctagggctagctgctagcgatgccttcttttttttccccttctattggttaaaaagggagaggctaatgaagatcaaacagcccacattaaatcgataaccggaaataactcgggactccgattaccacaaacttatagtctatttcgccctactcgacgagctctacgcatccacggttcctgatcgcctattcaaacaatagtttaaaagttaaacttttgcacgttcgctctaatattccccgaaatatattaattcaaaacccggggcattacattcttccccccttcaatcgaattcgccctcgaattcgtccagccatactataggcctaaccgccataacggcccaccagtcagtctcctagccaaaggagaggccaggaggtggagcccagggttcggccaaaccgcctctggcgcctcccatcctggccttccacgtgaatgtcccagattactccctaatgatgtttaaggggtgttaccgatatttccaactgtcaacaactgtcattactcactataaaaggaggagcttatacacacttcaacacacaaaacgtagagctcaagtagagtacatctcacttgtacattcatatttcttcatgctatattcacgaatgccttgtttgatgttgttattattgtttaaatgggttctatcctagtggtttgattattattttttcattatacacaattgctcatatgtggtgttctgctgtatggtttgatgtttgatgcaccatcatgttctttttatctgtattggagtggttttgttttagatatattttagatcctaatgtggtccttaggatgacaaaagttaggagcctctagagtgagcaccgactagtgatgcagatgggctaaatgaagggctgtcacaatttttttttcttcattgctgagtgacgctgcccaagtgttaggttgatgactcaagtgtccttatttgaagcaaatagtgtgtgatagatcaattggccacaatgttgtgcatctctcgatgcaaagaaagggtggattattgtgtgtttctccacataggttggggcgttaactttcaccatgaccctagaaaatcttagtatagaacaggtttttttttcccaaaggattgggccaatattatcgccactagtgagttatgatggcatagaacctatgtagaatcttgtgaggtccccatggctggatgcatctttgttgttggggacatttttggcatgttgctttgggacctagtgtctaagttggattgttgctttttccacattgtttttggttgctgaaagctttccttggatgttgagacgctctgttacttttgtgaacatgtggaatgtttgtgtggcccaaaggcatgtttttatctacattggttatttgttatcctggttaagtgtttgatacgctcttgaagttgtgttaaatcgacgtagtcggtgggttcatagtagggtttcttgtgattgcttggctagttgtcctctctagcatgccatcaagttttaaaaatagtatttttctcgatctagctctccattgtgtttgttgattatgcagacctcaagttgtggcccatggtgtcttgtttgtgtgtgtgattgtttgtgtattggttgtcgagcctattggtttagtcctttgagtgaatcctatggtagaaaaaacgtcacggttattctacctaggtggctaatggtgtttctcatatgaatgttcacctttgagtaaaatgttagcttgtgatgttgcaatatgttgtgtgtttgagcatgttttgccttaggttttgttgcatcagccaaacgaaatattttcgtgtagtttcggtgtcacaataggtgtttattccagcagtacatgcatgcatgagtgtacaaagggataatgccccatgtttggctatgtcttattttagaagagccatatagttttctctggtctttgcctcttttgggaagtgggaaggaggttggatggcctagcaatgttcttttggtagtaagaaaaatagttttgacaagggacccaagaagttcaattgtaatagaaagtggagtgttttgtggggctttgatggttatgggtgtgggtacgagaaaagtttgaccttcctaaaatagaattagttgtcgaagggagtgggagctagagcttcatacaaccttattgaagtttaggagaactagagtttgggatcgagcatcaaccaaatgggacagagcaggacctcgaagttgattgtgcctaaggcataacttcggtttctaaatgtgtctctttctaaagaatttctctaatgtatttctttatatgtgaatcattggcataagtagcaagtgttttttttccttgatgggattttttttccctttcatcacctagaggtaagtgtgtgtgatgcttaaggtgtctatctctttggactgttttgttttgaaggtagaattcggggacgaattccttaaaggaggggagaatgtaatgccctagaaaaaatagaatactgtagagga

SEQ ID NO: 28780 - DNA, 7547 bp, Oryza sativa
  unsure (1)..(7547): unsure at all n locations
tgccctactgcagacctgggaagaagggaagaagaagaaagggaaagaaggatgcggagggaattgaggtgaagaaggaaatgaggggttttggttgccgctgcccatggaggcctaggtatctaatacatgatcttttccccctgttttggttttctattagggtttagatcaagtgttggaagcgagtaagtttgggatcaaccgatttattcctcagccaggtttttgctgatctgtcccctgcacagttctggtttggatgccttttcggccatcataatgggatttcctgcgaaacgtctctatacaaaagttgtagataacgtgtagatctatcttctgaccaaatggcatgagtttatatcaagtggtttaggagatatcaatttctgaagttgactgtctgaatatcgatgcattttttctgtagtcgaggttcagagggattttagaggatcttaatgatggaatcagagaatcttgtttttacagaagttgtagcatatgttgtgatctacctcctacataaaaattgttagcttttatcttgtagtttgttgtcagtgctctcttgaatggttgttgcacagttttctgggcagatgcacttctctgttttgtgccatgttttaggccagctaaatggaagaattcaattttgttatctaaatgaaagttgtaattcttgttctgtagatgtcagaaatgacatatttttctgtgttatgtgatgtagaattggaggtatcaaattgttaatctatgctgcttttataggaagattatcagtgatttgctttatgttgtttggggtgggatcccagcgtaggaagcgtatgtgtgattcttgaatgattatgcatgttgtttgagtctgagccggtgtttatttaggtgatgccacttcggaatgcaactagagttcatctcatcatcggtgaaggcaagtaaacgtagcggtggtttgctacagccttgacttgttatttgattctacctccacgttgaaattatatatcatcaaccaagattattatatattacaccgaggatttacctatctgaatcatacttattgattttacactgtttatggttatactttatgctcttggttataataaccttatactgatctccatcgaaggaatgtggttccgatgttatactctggaattcatactgcatttgcatcacttgcattgcatttgaagttatgtcgtgaacctatggttgcgaccgtaccggtacagcatcgtatattgccgtaatacgatgcagcttcacaccttgttgggtgtgaaggcaggagtacatatcattgcattgtatatgcacatattgcaggacgttatgaaaattattgatcgaagatgtctttgagaagtgttttcttctctaggatttgtgagtatatggatttgattggtgacgctatgatgttttagttccttggattttgaacttgtctttatgtgaatcataacttggtatttaaattagttatataataaacatgtggtttaaatagcttgttaaagccatttgcttgctgagatttattctcacccccttatagtcttttcaggtacttgctgtgacatgtttgcatgaagggataggattagctacacagtcgcacgacatgatctcacttagtcatgattattgtaatatcttgataagaatacttgtgtttagacataatgggttaattaaatactagagttgttgaccattgattagccactttttcaagcctatccctacatgtcagtcaattgttgtatcataaccttaatctatatgttgatgcttccgcgatgttttcttgtctaagatagttgttgccgaaatttgcttgttttggcacttatgtgtggttgtttagtggcatcccaggcttatgtggttttctggggtgttacattctctctggtcagcaacaaatttaaggtattttttattaatatttctccattaaaatgaatctgcagggttcttaagcataccattaacccttcgatccgtggcatgctgttcatgtgaaaacacggcggcctaggggatcttcttaactccagtgcaagtccaaggctagcctcaagtgtatcaagggcgtgccaactgatttgatcctgcaatcagcaagaaagagaaaagcagagttagtcagccgatagccgatcggccgatagcgtatcgttggtggtctctaccgatggagttagaccaaatcggctatagactggatatattaaagaatattaaaccctaaatatgcctcattggttgtaacattgtctatcaagattgataaagaagcttaagataatattattaaaatagccgatgtaacaatatttagtgtaagaaagataatatactggctaatactctagtacagatctatataggcaaatcaatctatagtaatataccaaatagaggtcaatagtcaatgttgatagcccagccgatatgacctctacttgatatattactataaagtgatctgtctatatagatggcaaatatacatgaaacagataaagaagcatgtatattaggtaagagcggctgaaaccctgatgttatccctgttagaaatcaagaagcagggtagagatcaacacgacttagtaggtcgaatgtactaatgcaacactaagtatgaaaagaaacacaatgtctagacaatcaagccgttgattgattttcaaggtggtatatgtctaagctaatctaatctagcaagacgatttagccgataacggcagaaaccctaaagcgagaagcagccgatagagctaaatcgatttgttaaaactagattaacatagacatatgatatcgatggtcatgatacaaggactaagatatctaaaacgacataatagccccaatagcataggccatcgagatgagttacctcttgcgaagcgaactcgtcgaaaagtaaaaacgaaagggtcgcgatgcgccgaagttgtattggattgtccctcgtattacaatgctaagggattcatatttataccccgaatacagacttagtccattatggacacgactcaaacctttctaaatataagatacaaacaagaccatatatgacggtctcttgccaaatctaacacaaaccgacgtaaccaaactatttaatagatacaattgccttacctgagctctatctctaattggcaatgacgattatcccaatacaggcccatgcgagcccaagtcataccatatcggctgtatcggccatcggttccatcaaccttgatcaactcacactttatttccagctgatatggtatcagccgatacgcagaccgactccaaattcaactagattccacactaaatctgcttcgatcttcttcnctcttcgaatctgatgcaaaattccgttgttaacacatgccaacgtaataactctgttgcctaggatttggcaaagattctcctaagatgataggcaagtactacacaaccttcgtcacaatttctctttggtttgtatcaagaagccttacacacaggacaagactctaagtcggtgtattccttttagtacaatatgcagtcatttggacaatcatgaattctacgaaccactaaccccacacaaaaaatgtttgcttcatgtgtcgctttgggctgtgtgttctctcttctagaagcagatccttcaatatatccaacagttctgtaaaactcttgtttgtccatccacgacatgcttttagcttcattagatctagggtagcaactaactttgtatgttttgccttgcatccatcgtatagaggtgtctctgaatcactaaccaacctggtgaactcatggtatcttgcattgtaagttgtctcctcaacatcatgcaacattgcttgcaatcttgcattgtaagttgtctcctcaacatcatgcaacattgcttgcagaagattgtgattgacatcaaccatttcactgcccaacggataagaaacaaacatgtcaacttcattttcttcctaattttatctaccactcccttcatctataatatcgattgattcattttctccatgctttgtccaacatgtatagcccttcatgaatcctcgatatatcaaatgagagtgtatatctactcttctggtaaacatcttttcatttttacaatcaacacatggacaagttatataatcattgttccttcttttcctctccttcctcgctatgtttataaaatttgaaatgccacttttatactctttgctatgtcgatcatgaaagttcaagtaccattaatttggttttggtaattaattataaatccaattatgtgagactaatgtttttataaccatttctttgcctagtctcatgtggatatgaaagtgtagtgtgtgagaggtgattcctgaacttcatattagttgagatagaaacattcattgatggtggacctaaatcacaatgataaaatgcatggagatcaatctatatatatcactatttctcaccatgtacatattgacatgttcatatataatatttccacgtgaataacaatatacatgtgagactaatgttttgtttgagccttttcttttgtttagtctctttacattaagaacatgaagatgatgaaggtatacatttattttaatgcctatatttgataaatgccttctattcttgtataggataagttcctaatgtttcattcattttatgcatactcttgcttcacacaaatattttgtatgcatgcatttagggggagcaaatcctataccttatttatgcatgtaattgatgcaagttgttcactttcatttaattgggatcttaacatttaagcatatatttgagtatatgacacttgtactgttgattaatacttatcatttattcatatctttttatacatgcgattggttggtcaacaagtaaaggttgacaaccagattattgaggctaataattttattgtgttgaatgagagaaataggtcccaaggattgcaaaggtgttgatgctcaagtgatattattacacctaaagatatcaaggatggcagaatgaatatattgtagatgtggaatacaaagtggctactatggcaagacagtgaagggcaagcaatgctaggccgcgatggaccatgtggtggtgaagggcaagcaaggggcttggtgctgaagaaccaaatccaatggtgaaggacgagtgacgactttgtcatgatggaccatgcggagccatttgaagctacaagtaaccacatcaatcatttcaagaatatatggtgaaacggtttcgacgttggcattccttaagacaaagaaaagatggaaagaaggcattcctattggtataattctcttcctatttacatttgagtataggaatgctgtactattaagagggatgcaacgtcgatatgtttgcgtatgtctcggtgctcagagtgacctatcatagtgctaccataggagaaacccaagctttaacctatcctttgagtagttttagactttgtttttggttaagttggtgctaacaatggaattttacaccaaactcagagaaaaaggaagcagatcgaagcggatttgatgcaagatcgagttagatttgaagtcggactgcgcatcggctggacatcgtgtcagctggaatgaagcttgatttagccgatatggcaagtggcctatatgatatggcttcggctcggtatgagcctagattgagataaccgccattgccaattagacatagagctcgattaaggcaattatatctattaattaggatatttatgttggtttttgttagagatatggtaagagacctccgtatggtcttgtttgtattttatctttaggaaagtttgagtccatgtttataatggactaagtttgtacttgaggtataaatataaaccccagatcatctatactaatataaaaaggaggagttgtgcctatccaatcctatggtgaaatcattagtaggaaactaggcccacatgcgaatgcaccaaatcctcgtccccaccaccataaattcctccacgcgctaacctagcgtagcaaattcctcaccccactcctttcgtcaccgcatcgtagttttcccctcatcggtcatcatgccgccgatagcgtcctcctctccttagctctccctccacaaaatcgctcagcctagacatgattcgccatccacaaaatcgctcaatctcttcctccacttgacttgctggtcatctccttcaccacaactgcacacagcctcgccggagatctgcctgacggtggggtttgaggcggcgcgacggagatccgccgtgagcgaagaccagtccctgctcccgcaagcacggcctcaacatcacttcctccttcccacctgaccccgactgtgctcccgtgggcgacgagagagtgggggcgttgttcgccctcgcttagattggcactgttgccagccactcactcgccgtcaccaagatcagtgcacccactgccaccatcatcgttattgtccaccccaagttgctaccgatgcctgcggacatcaagccgctgccctccacccctctcctttcatggccgtgactagaccaccgctagacgtgcaccctaggtcaccgactaccgcgcgactccagcggccccgcttgcgcgtccccttggctgccggtgcttgctgttagagtatatggtagttagagtcatattaggataggattgatttatgtggactacttccatatctgtaatccttccttatctcctccccatgtactcctatatataccggcccccgaggctcaatataatgtgtccaatattcgcagtatcctctctcctcctatactatccaacacttgcgcccactccgccgacacccgacctccaagacaaccgccattcccatgggtgcagaagcagtagaagaagcagcgcaagcaggaggagaagaagaagcagcggggaaggaggcacctgatcaggctgaaccggccaccaccgaggagtaagtgcgagtaggccttttcccttgatcttgttcatgtactatttcttcatttagttcagcaagcaaatatgtgattcatggatgacttatgttgctgtgtcttagaaaatatacgtattgaattaattgtgaatttatggtttgcaaatcttatatatagataattgatttatgtttgtgatctaaattgatgttagatgcttctttgttgggaatggtccgctctcccgcaggcgtggctgctccgcctccatcacactttgcttggggttgccctccagccgtgcccacgcgtgtcgtgctgtccctgatggacaaaaccctcctaacccacgaccggctctccactccatctcgcagtcttcgagatcatttccaccccgcccatgcctccagcctccctggggcagactgtgcttgtctcatgcccaaacaactgaggcagggatggatcagagaatcggagatggaggccaactggtgatggcaacccggga

SEQ ID NO: 28781 - DNA, 2772 bp, Oryza sativa
aaagcagtgtcagtgcatttctgttttttctcttactattgaaagtaaggaatatattctacaatttattatttgattggagataagcttttgtttgttagtctgctaatggaaacaatatatagtttttagatccatcctctcttgctccactggtcggtggtgtcagctccactgaaggagatgcagcaggatacaagtttcatttcatgtatacatgttggaggttgatttcctataagtatgttaattacatggttgatggaatcttcatggcatcacgttctactttgcaaatttacaaattatcttttcctttatagttctgcccctatggactgacaggtattttgtatctgaaaatgcaattggggcttgatgtggccatgcggattcttgggtgaaatatgcagcaagttccatgggtgctttaaatttgaatataccatggcatccacaaaagggcttcaggaattacgaggaagccaattaggataagggcctcctgacctgatgttgtgtattgcaagtacttctttgtatctcaatttggacaattgttgtatcaaaaaattttgttaatgaagctgatatctcaattgttgtgacttcttcctatgaatacatgtgcttcagcattaaagaaacaaatgtctttaggtatgcactttcaggaattatgggagaagatatgggcctccctctgctatctatggagcaacatgcacaatttagacaatatgtcagagtgcctggggagacaagttgaattattataccatttctacatctcggtaaagtttgtacttgatgatgttttatggccattgtagttgtaggttagttattcactgctatctctcctttctttagagaatgggctacatggtgcaatggttgcagttgttggttttgagaaaacttttagtatttttgcagttcattgtacttattcagctataatagccctcaagacaagcatatatcctaaggtaactcactgtctactaaagttgaaaaaataatttagttcatacttacggtacttattatgttataatagccctcaagacaagcatatgttctaaggtaactcactgtctactgaagttgaaatattaatttagttcatacttgaactagtttatcataaataaggttttgttatgtatatataacatgtccagtggcgcaaaaggtgcgtgattgttcaaaggtctttttgcttaggcttatgcttattagccaaaatttgaattttcaaccttaaatttgaagtagattttgggggtttttcatcgaagtttatttttcagccttttacttttagatagcttatgcttatgcttttcttttctttttgttcgacagtggagttaccttcaatcccactgaaagacaaatcttttttattccagcttttcaagtgttcgtcaagcaattttctctaacgttgcactattttcatggcaagtgtgtaacagggacctataaaaataggccatatcattattgctgatattattcttaaaatttgaagtgttgatatatttattgcgacaaatgctgttaaactacgtgcattgcacgtgcacaattactagttgtaaaaaaaaggacgacaaaatccaatacaacttcggcgcatcaccacccttttgttcttctcttcggcgagttctctcgacaagaggtatacttgattcgatgacttgtactatcggggctattatgtccctttagatgtttagcccttttatcatgaccatctgctattatatgtcttagttaatctagtcttagtatctcgatttagccctattggccagttctccctttagggttctcgccgatatcagctaaattgttttgctagattatattagctaaggcatgtaccatcctaaaaaatggttaattacttgattgtttatacttttaagtttctttacataatttgcgatacatcatccctagtcatgtcttgaaccctaaaaactaacttggaattaatcataattaaggatagtatcaaagttttagccgatcttacctaatatacatgcttctttactggatttatgtatatttgccacttatatagatagatcaccctatataaatatatcaagtctagatcagtatcagtcgggttatcaaacttggtaacttatcagtatttgatatatttctatagattgatttgtttatataagtttgtactagagtattattatctttatttatctatcttgctctgaatattgttccatcggttatttctatagtattgtctaaaatagatttgataaaccaaatagatgatatcacggccgatgaggcatatttagggtttgtgcttaatttatatatcaatccatagccgatttggtctaactatatcggctaggatcgccaacgatacgtcatcggcctatcggctgatcggctatctgttgacttactctgtttgttgtttttcttgttggttgaatcaaaccagttggcacgcccttaacacactcgaggctagccttggacctgcactagagttaagcagatgttctaggccgccatgtttcctgtcaacagttcggtaatcctctgagtgagctttccatagagtcctagatcatcaaaaacggactcctgagtaaaaagttatggtcattttactctgtgcctttcagcaattctaaaaaaaatatcagatattcttccccattttcctaccattatggtggcctgtttgtgagtgggatttgagaaggg

SEQ ID NO: 28782 - DNA, 1954 bp, Oryza sativa
  unsure (1)..(1954): unsure at all n locations
accttatatattgcttagataccttgtttgtgaccttttgattcatatacattttgtttgttcaagctacaagttcatagctagcgttttattcctttaggaggagcccttggaggtcgtcgccgactgcctcctccaccttggcggtgttcgtctccacgcccttcccaaccccatttagaaccccaccatgcagaccttggctgcgcgcacaaatcaggcctcaaaatccaatcaatcaccaagaaaagaagtgtagaagagaaaaggtgggatgtgtaattacctttgcactgctgctggaggaagaccagatgaggagctgttgccgtggtgctgctgccggaagaaggccggaggaggagctgctgctgcacgtggtggccggatccggcgtgacgcanaggaggaggggcgctgctgccgcgcgtggtggctggatctggcggccccgacctccaagcggccggatccggtgtgacgcggaggagcagaagcaggagtggtgccgggggttgagggaggagaggaggagcagtgcggctcggattggcgccgccgggtagagaagaagtggtggtggggagagagggagaagggaaaaaaggaggaggcggagtagtgcatgtgcttggcaatcgaaaagataaagagtagtgcgctcggtcaatcaatctgacgtccggacagttttgttaataggtgttggttttttcaaagaaccgacacccaagttcatattttagaggtcggttcttttaaaaatctggtacctacagtattggtaccggttcttttctttacgacgaacatctcataatataagtatatgtgcatgttcttttaaaaaaccggtacctatattattagtaccggttttcctctagaatcggcacctataatatttaaatgtgccggttctgtatattttcatcgtgcggagttggttaaatgattataggtgcccggtttatttgtaagccggtccttatgtggtgtttgtagtactctatgagtgcttatgtgtcggggattattacggccggtcaaaggtgaggcttacgtgatgggctacacgctcccatcacacagactggtcgggttgtgtaccagtgagttaaaaattttagaagtttgaaaagaactattactttgtatattctttactggagagagtagtatttgtaagtatacgagaccaggtttttgtttagtacggaggcctgaaattatgggtgcatctagcacggcactggtgtggttaggccttaaaattgtactgcgtacaacaaagaaaagttaacaagaatgcctccatacatttcattccagtacagacctatgcgtggggacttctatggatgcatgattgcattttactaccaccgatcacagtacacatgtactactatatgagtagtacttccgaaagggttacatacgcgttatcactttcgtggcaacagttaattacatcttccaaatttcaaattaacaactcccaataattcattgactattacagagagtctgtatgtatggaacgtcttattgcatatatgttgtagaatgtatagcaggcttaatttgtccttctctacttttcttacgactagcaaagtactcgtgccttgcaatggatttcaaaagatatatatgaaattcttgacttgaaaattgtatttgtcaaacataagttacaagcaaaaatgtagcaaaagactaagccacacacacaatgatatacttatttagccttacaaggtaccaccaactcttaagtaatggcatattatatgtctatatgtattccccattaagtgtaaggagtgctatttctctaagtcacatcatctcaattatttgtagcttttgaatcatttgtcagggtgcaaattgcatcccttctcctgaaaactttataaaatcatataactcaattatttataacctt

SEQ ID NO: 28783 - DNA, 820 bp, Oryza sativa
ctgggggagagcttagatacgccttcaactgggtgagggcattttcggcttcctccgtccaggtaaacggtccggagcgtttgagaagcttaaataagggtaacgccttctcttccagcctcgatatgaaccgacttagggcggccatgcaaccggtgacgcattgcacatccctaagtttgctgggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggtttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacattcgaagcttgccgtgtcgcttgggaacgaccaccgcgttcgccagccactccggatggaatgacctcacggatgaatccggcttccagaagtcgcgccaccttctcgcggatgaag

SEQ ID NO: 28784 - DNA, 735 bp, Oryza sativa
tcaccaatgattactcctttcctttagtagattcggcttgctccggccgaatcaacaccttcttatcattgaaattaatcgtattcaccggaaaaggatcatgatcaagattcatcttggagccatcagtgaacttcaatcgtccttcatctatggccgattgaacctatcgtcgaaacacattgcaatcattagtagaatgagaatgagaatcatgccatttacaatatgctcgatgtaatcattagtagaccggaaataacccaacgggcattccttacgtgcgtgcattaatccttgtcccaggaggcaaggtacaccaaaagttgatacaattcagagtttaacaagcggaagcgtaaatagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggagttataccataaagggtttagggttgcagtaaacagcatttaaagatatttagttgctcagggctattttgtaaacacgattctagaactaaacaatattatttatcaaggtcgtgaacccacacgaacctg

SEQ ID NO: 28785 - DNA, 834 bp, Oryza sativa
agaaaccccacacagcacaacagggaccacggattacacccacaccaaagcgacggtgggaccaggacaaaccctattttcacttcacttattcttctcttcaggcggaaggaactatatattttatatagagcaagggtgagtactttcgtactcagcaatcaccggaatttaggtgtttgatgcaagcttgaaagagagcaaaggttgttttggtaaatcttttgtttgaaatcattttgaaatcactaagtgatttatttctttttaagttcgggtcaaaaagagacttgcgtatcaaatttcaacaactcaattgataatgtaccaacctcccgggtcagatcattacttctcggctcccagagccatttcacttgattaaatcggctcccagagcctttttcattttcttggactcccagagtccagctgcccagcagcacaacaatccgcttccactcgggaaagcctagtctatgatgcccgcagacatcccgaatcacatagattcgtttctgaccactcaggtcatccatctgccacataggctgattctggttacgattcccacaccacaacaacttttcaccaagcacaagcaaacaaatctacgcaacgggaaccaccttacatccgcccattaccgtgggcacgctgttcgaacagtaagttaacctctgcagaggggtacactttacccataagatacgaacttattccaaacacccatcggtatcggaggttcgcaaaaagcctttcccaagccgacccagggttacctcatgccacatagaagaatcaaatcctcacataaatataggccattttagt

SEQ ID NO: 28786 - DNA, 2338 bp, Oryza sativa
attcaaaatatatatatatatatatatatatatatatatatatatatatatatatatatatatatatatatatatatgtaaattaactggtgctacatggagtatgggctccaagattcaaattgcgtatatacccaatttgaatgtttaaatgttttttttaaatgtttagattatgaatattaacttctttactaacaagttcaaacaagtttgaactgagtttgcaacttttttttttagattttggctctagatatataacatctaaacatataattcgcgtatgtatgtaataatgaattgtgaaatgaagttgagtttgagttggtttgttgttaggtatttgtatgaattaaattcatatacctagatatctacttacaatttgtaaatttttaaaaattgagagaattgtggttttataccttagagcccggacaccataaagtcccctatggatatcatatatatatatatatatatatatatatatatatatatatatatatataacacgatcatgctacgtagcgcgacacacagacgtagcacgctaggaaactacgtagcgcctctcacaggagcgatctcctcctgtttttccgtttctccttcctccctttctgtttctgggtttttcgtatttttcctcccaccaagagtgttttccgtttttttcctgcacaactgccacccggtctccacgtgccctcctcaagccccttttctcactccatcagttcacacggtgagtaaaaatattcttgagagaaatcaggttcccataatcagtaaaaaaattccttaacaaaatcaaaccctctttctatgggcaataaaatttttactcctagagtctccataatcagtaaaaaaattccttagcgaaatcaaacactctttagaccgacagtaaaattttaactccccaaatcccaataatcagtaaaaccctctttggacgggcagtaaaatttttactccccacaagttcagatactcatcaagatcacactctttcgaccgatattaaaatttttactcccaaatccccataataactagtaaaagaagcgaaatcaaaccctctttagactggcagtaaaatttttactcccacaagttcggggctggataatactcatcaagaccaaggttagtgaaatttttactccagcatatttcttacatcattggcgttcatagtaatatttttatcacatatattttggtaattcttttactcaatctgttcgtatggagaagagaaagagaatttttttcaggcattaacatatgagaaccattatcatttttacgggacatattaacacatacaatcaaaattagggagtattacattcaatcatgcatatgaaattatcaatcacacaaaatcttctgtgcgtaaaaaactacagaaacaacaggaggaaaaaataacatctccatccaagggaggagaggagacacagcagagatgttgatggcatgaggtgctgacgtgctgcagcagttggcggcgactactcgagacagatagactagcagctccaatcccatcccagccaccagcagctgttggcatcgaagcaggagcaaggcgacagggctccagtttagccccgcacaaagcatggtcggggttggactcgggttcatctgccagccagactacgccgctgtggcctagagcaccgccgcgcgacgtccaccatctccccgtcacctactccttcgccgttcctgtcgggataggacaaggcgctggatcccacaccggggaggagtttggcctgcaaatccggcgcagccaaagctcaccagcaccttcatcggcctcctcaccatcctcatcgacagcggcctagtccgcctgtaagctggtcaccggggctgacgtccattggcgcaacattttcctcctcttctggcttgaacgcagcctacgcacggtgagcaagaagaaggcgacctaacaccaaggtcctccctgacgattgatccagtgccctgcttcaggaccaccaccacagatcaaggagcgcgtcctcctgatccgccctcctccacgctgcagacggctgctcatcgtttgaagagctgttggagtagttcgtcgtctcctcacccgccgcccgtcgaccggtggcctaagccacacagagggcgagcaccgcccgtcaccctctagcacggacagaaccactgggcaacctcgtcggtgcgcgtgctggtcaccgaccgccgtcaccgaattgctgccatggccagccacgcgctcagatccgaaatacccggagagagtaagaaaaaataggatcggatatgtgat

SEQ ID NO: 28787 - DNA, 2950 bp, Oryza sativa
tgttataaaagtttaatacactctctgtcatggtcatggatatcacatacctaatagtagttgactaaacttggcaggagcccaccacatacgatatcttatacgaaaacaaatcccgtatatataaggagttccggataagaaaggataaatagagttctatatagaaacgataaggactactcggattgtatccatatttatctccctagttttacttggacaaggaggcatctatgggtataaatacaagccctctaaggaggagaggagatacatcataaagccacaagacacacccaccataggcgcacaatacacaagccaatatacgccaagacaagtcgtcgcatatcaacatcagagataagcctagacatatcccatccggtgcctacggaagccgacaagagggatcaagtgccatctctgatctcgacgtgttcgtacttcaggaggaagactaccctgtcgtcgactacgagatggttatctagccgccaaatcgacgacaactagataggttatcccaaatactgtatttgtgtgatccagatgaataaagagcaacaccggcttcggctaacaggatgtagggctattacttgtcagataaggggcccgaacatgtataaaaatccttgtctctatctcttttacctcaatctcgcacataccctagtaccaacgatctccataccatcaaataacgtagtcgcggtaccaaccgttgacagcggtgcgccaggtaggggaatttttggtgcttcaaggtttcaacgacatgggttcaagagatggattctccaatgacaaattactcgacgacttcggctgtagggaaatctaacccgaccggagtatgtcccccgacgagatcgggaccatcgccaaatattcgatccgtcgagatcgaccaatatttaagatttcgtcacagcggaaaaccaacagtatcgacgacatgagagattgatccaatatgtgtcggtcttattcctaacagggtgtcctcggacacgttggcccgattcgtaccgagatcaaacgtcgcgctgctagctggtgcaaggcattggcccgctgagtccaagctggacatgacatccactatcatcgaccgagtacgccgacggacatgaggatacaaaccaagagcatgcatgcatgcgtggaccagccaacatgcatccacacagtgcatgtgaaaattgcttcgttaagacatgtctatactactcggacacgtgcacacaaggtaattagtgagattgattttttttaaaaattaatctactaaattcgtagatatatccagcatatatctacaaagatacgcaatattttatatacaatttaccgtacctatttttcagatatatatacaatattatcagatcaataatttattatgtttacctagaccgtgttttttatacaatatttattgtgcgagtgtttccaatattaagccaaccacggtttaatactggggctcgccctacttttttcaagtataaatcatgcttgtttacggtttacataatgcccgatatttaatttgcttgttatatcctgataatactataactctagaagattcatgcagttttttgagtaaatactcgatattgtctactatattgtcttctagaaaatatttttcaggaacaattgagcactcgagtacgatgtggtcgagtacaccgcattatcgagaacgttctcgaaaaatgctgagttgtcgcacccaacctaccaacaaagaccgacgacttatctcatatatagcgttggctacggctagactatttgagaaaatattgttaacagataattcccccgcgaacgttgtcggcttgatcatccgacatgattgcgaacagacatccggatatgctataagttgggtatgtgagtcatgctggccacatgagatgcacatgtaataaccaactctagcgcccctataggtgattaagagatgcctaatcctagttatcgaccagacagttgtagcgacatctcatcgcctatcaatttaaattcacttgtggaccgttgaactccatctatcgttgtccaagactccatgcctctacggtcttacaccaggatcgaccaagtgagtacggcaaatattgataaaggggggtcgtggataacaagagaagtttcatcttcaggtgatcgagatacgcctacacctggtcctcgaccagtacatcgtagtgatctctcaccacctaaaaattcatcttcaggtgatcgagatacgcctacacctggtcctcgaccagtagatcttagcgatcttcaggtgaccagtagattgttgaccagttggttacaacaatctctcgacatctaacgcgacaatcaacattgccgtgatagcgacaaccaagaccgactagatcgccgttgtcaccaggacgacaacgtccaggactaatgacatcggaacgacaacggacaaggttaacgacatcacgacatcacacgacgacgacaaaacttgagatccccatacttctagagggctcgaggatgaggtagtaggtccaggaacggaacctccgactacggtaattcctcattgccttcgtcgtcatcaggaggcagttctcgcaggtcacgagaatgtcatccatctattactctggattcccttcaagtggtcgaggtactactacaactggttctctactagcaacgtagcgatcctcgtaccatgacttctaatggtcgaggtgcgactatgactggtcttccaccagtagcgtagtggtcctcgtaccatgtcttccaaaggtcgagttacgattacaactggtcctcaattagcagtgtagcggtcctcgcacctcaatttcaaacggttgagagactcctactcctggttctcgaaccagtaggtcatagcgatctctcatacctccacttcaag

SEQ ID NO: 28788 - DNA, 1411 bp, Oryza sativa
ctagaaatggtaccaaactccgattgctaagggtgactctagcgagagtactcttttatcgtcacatgcagattcaatttattttcgatttttctatacatattatatcatgttacccttgagtgttcgctcgagggctatttctatttaatattctattttgagtattgattttaggaaagttctattcaatattgtcgaagactccgtgtctctacggttctacaccgggattgactaagcgagtatggcaaatgttctgagtattgatttcaggaaaattagacatcaaaataatcaagtcagatttcaaggctctatcgtagattctatgcctactcgattactcgagaacggttgattgggctcgacaaggaatatggaatgaagcgatggtctacccaccgagatggaatttcttgacttcaatccaaattctcgattacagcaagacaagaaacttagtcgcatgctctgtatcttctcggtcgacatcggagattaacctagacaaacctaatatagtgcctacaaaggccgataagaggaatctagctagccttatttctgatcacaccgagaacggtcaagcgatcacgacaatagttgttccaaagtcttcgattgagaaccttaactcgttcatttgcaatgaagtcgggggttactgtcatggttatggataccacatacctaataatagttgactaaactcggcagggtccaccacataccatgtcttatacggaaacaaacctcgtatatagaaggagttccggataaggaagtataaatagagttctatatggaaacgacaaggactactcggattgtatccatatttatctccctagttttacttggataatggggcatctatgggtataaatacaagacccctaggaggagaggggatacaccacaaagccacaagacacacctaccatagacgcacaatacataagccaatatacgccaagacaagtcgccggatatcaacatcagagataagcctagacataccacatcccgtgcctacggaagccggcaagagggatcaagtgccatctctgagctcgatgagttcgtatttcagaaggaagactaccctgtcgtcgactacgagatggttatctagctgccaaatcgacgacaattagataggttatcccaaatattgtatttgtgtgatccagatgaataaagagcaacaccgacttcggccaacaggatgtagggctattacctgtcagataaggagctcgaacctgtataaaaatccttgtctccatctcttttacctcaatctcgcacataccctggtaccaacgatccccaaaccatcaaatactgtagtcgcggtatcaactgtcgatactctccataaaaatatatagtagcaatatagtat

SEQ ID NO: 28789 - DNA, 11309 bp, Oryza sativa
atcggacactcctactggaactccttttcttttttctttttaataacgctcaaagatgagttggattattctcctctccgttcaaaaggccgtagtttcgttcgaattagctgtttggctcagcttattagcgccatgcgaatcagcagagtactaataaattattacgtactattataagtctgaaaacatttattttttcaagggaaaagcctgaattaccctgaattattaggtgactaagaattaccctaaacttgaaaactaaatatctttcactctcaactagtaatatcagataaaaacccctctgagcactgttttggatagttttaacttgaaattgcacacgtaacgccaacgtggcaatccagttagtaaaaaaaatataagagaaatccatggacacacttgtcatctctccctcaagccatcctctcatgtgctctctctctctctgcaatagctgcaatggaggtggcattgtccacggccttggttcgtcgtcgcctcgacggcaccaggggcgcagcggaggtcgagctagctctgggatggcctcaggtgcggttggtctcggcgacggcaaccagctcacaaagcggcggatctattgttcctagccccgggacgaatctgccgttcccagcctcaggtgcggcaggtctcggcggtggtagatctggtgccctcggccctaggaggggtggatccgctgccccaactttgggtgcgacagttctcaatagcggcgacgacgacgttgagtggcatggaaccggcaaggtggcgaagtcggatgcctactcctagctttccgcctctatcgccatcgtcaccaccttgtcaagttgctttctccctccgactcttggtttgcaagtggccgacgatgaccgagatgcgacggaaagtatggagacgacgacctccgccggagtgcgcatgtgatggctaagagagctactgcccgcaacatcctcttcacgcgtcacaactgtcgtcggagtgtgcctccgtctcccaccatgtgccggagtgcgccggcggaggccgaggagaagttatgcggtcgtagaggaggcgcatgccggcggaggctgaggaggacccgcctcccccgctagtcgcccccagctgccttcgccgctctagctcatccgccctgctgttgtgtagtgtcgtcccctgccgatggacagactaggagggaagggtgaagagagagggggtgagagggagagaatatgacatgagggtcccaccatttttataaaaaaaaagtgctgactagattaccacatatagagctaaaaccaactaccacatatagagctaaaaccactccgtattgagttaaaagggttctgcatctagtattaatacttgacggtgaaaattgtctagttttcgtgtttagaaggtaattcgtacttacccaatagttcaggggtaattcagacttttccttttttaaaaaatgaacttctatatacatatatttttaaaaatacatttaaaaatacattgtttagcagtatgagaaatatgcttatgataaacgagaaaataggtgagaaaataatctgtttagaattcagcctcagagaaaaaaaatcatttggtcaggagatcttatttcatgattgataaatgtttttaatgaaataaacacctgtatatatgaatattcgtggatataaagttgatgctttagatttgtcctaccttatgttcttatgttttcttgttgctatgtcatgtgtatcttttaaacgaagttttcaactttcttgtgttcttaatttctatagaaatttaatgagtatgacactttattcttgtgttttttgtttttacaatcttgtgcttcaaaggagctgtatacgagattaggtgtagaaaaaaaatgatgcaacactataaattgtactacgtagcaactactaatatggcatttctacacaaacatgccagcaaactcacgataaaagcatgtgcctactcttcaccagattccgccattaaatttagcgtaaatattatacgaacccacttacatgacgcgcgagtgtgcaagcaatagttcaaaaggaaaaagaaaacttcaaaagttttaaaacatactgtaggagtattaatcattctaaaagcatttcaaatcaaacaacaaacaaaatatttttcatccttatcaagagaacgcaaggacaaataaattagattcctctcatattgccaaattgtccaaaatctggaccatgcatgatgcgaccaccaccccatcagcccatctgatagcgagcgacaagcaggacagatccgcgcggaaaatcccaaactcgcccgcccgcatgggatccaacccccaacctgtgatctcctctactctcttctactccgttctataaaaaattcaatctacataaaaacttattaggatttattattgtacgaagtattccatcatgttattaaccttttatgggtctaatagaaaccaatctagataaagactcatttaaacaattacatttattgtgttagaaagtattttatcatattattgattttctatagatggaggaagtactcccatccagggtttcccaaaccgtcgaggccagggttaccgtgtaaaatttatcaaaaattcaaattattttttaaatttatttaaatttcaggaggttattatggtatttatattaccgtactctatgataaacccgataactatggtaaccgcgcggcagtaaaggaaacctgctcccatctactccacggcctcactcactgctctgctctctctccccgcggttaaacttaaagctactatcgctagcgctttgccttggctaccgtgcctcttgacaaaaaccaaagcccaactactccccagtccccactgctgcaatgtctgctcgtgttctgcggctgttacggtagtttaagagcaagtttaatattatagcctattactggcttcaatttatctatagctaatctaatagctaattgatataatagttgtttactatactattaatatatggtcccacctattatacacactgtgttttgaaatccgtgctgcagctggctacagatctctagcccatttctcttctctctcatcttttatctaattaaaatatatttatagctgactaatagtctgctattatacctgctctaataactttgttttactgctaattataatcaccagtagagagaggggggaggaaactgtgatctctggtctccatcttttagcaatagtacgcataatttataagtaaatattttatatgtatgttatgatttaaatatcaatattgaaaattaattttatataaatccctttttaaaatccaaatttgacagcagctgattctaaacgaagcaaatcattggggcctctgaacagagtgacaatagtgtgcacctgttgacgtactagtagaagaagagtagtaccactaccgtggtagcagctgcttaactttgcccaccgccaaccgtcaagggccattaatggcgtgcagggccgctgctgctgctgcttgctcttgctcttgctgctgggtggagtgagcgagagatcccatgtggcattggagcgctgtctcctgctgctgcacagtctactctcacttgctccgcctctcccctcgttaattcttggcggctgtgtggcgaggaagaagaagcggtgatggcatgctgatgggctgcgggttcttggatgcatttgggtggatatgcggacatggtggtgagttcgctgcctctcgcgcttctctgagcctgtattgattttagaaatttcttgtatttcgttctaactctagatggcattgatgctctgcttgcttggttcttgttatcttcttgtactctgtgtatgtgtgtgtgtgagagagatatttgaactgaagattctgcagtttcagattttctttggcctgtttctctctctcccccgagcggtagccattctctctttcttgttcttctgccaatttccagctgtttccagtagctggaaacttcgaattgcttaaagttcagttgtttgcttgctatgacttcgtttccccttcaagtttcactgcatttcctttccagtttttccttcaaagctcggatttgtttcttgcctcttcagcattcttttttccggcctcgattttgtataaagccgtttgtttgtgtcaaaatgttcaccaatatgcctttctcatgagcctcatctgttcggtttactgtacatatgctcttaatggtctgtcaatagtctgtccagaatgtcattttctatgtcgggaccgtacagatttttaaggctgcagcttccatattttttaattcgaacaactgacaactactgccttgttttttctgttcaatctggagtaaaacttgttcgcgatgttcttgcatccggtctccaaattgtttttttttttttggtttttggaaataagtatgattcagtcccgtggcattcacatcttgcttctccttagtttcttcattgataaaggctgtaaatttaatctttttcctttgcagaagctgtaatttgagagcgatgggagcatcttcttagggatcctcttccactggctagcctacagctgtttttctccttcattggtactccaatcttggctggaattttgaatcttttgtccgggaagtgataaaatttagaaagacaacacaaccattggcacttcttacagttgtgagcgctaagctgagcctccaatggcgtggcattttactgcggctttcatgatcgcaacctgtttgatgttattcccaagaagcgagcagtcctcgcagggtgaggtgctgcagcagctaaggaagcagctggagtacccaaggcagctggatgtatggaataacccaaacagtgacccctgctacacccagcctacttcggtggtcaccgtggcatgcgaggggaacgccattacagagcttaagattatcggtgacaggatcaccaagccaccaaagttcagtggctatcctgtctccaatatcaccctctctgaagcctttgttctcgattcgtttgttactacattggcaaggttacctgccttgcacgttgttatcctagtatccttggggctatggggtcctcttcctgacaagattcaccggctgtcatctcttcaagtgcttgatttgagctccaatttcctttatggatcgattcctccgaagctgtcagccatgccaaagttgcacaccttgacattggatgggaacttcttcaatggtaccatgccggactggttcaacttgtactcgaacctcacggttcttcgcttgcagcgtaaccggttgaaggggcccataccagcatcaattggtaaagctaccatgcttagtgagcttgctcttgctggcaacagcatcgctggcgaggttccacaattaggcagcttgaataagcttgagatgctggacttgagggacaatgagttggatggggagctcccagaggtgcctacagcattggtaacaatcctactcagcaaaaactcactcaagggcgaaatccctgagcagtttggtcagttgaaccgacttcagcacctcgatctctcattcaactttctcgtggggaagcctcctgaaaagctcttcgctcttccaagcatcagctatctcaacctagctgcgaatatgctcagtggatcattttctactagtttaacatgcagcagtacccttggctttgtggatttgtctacaaaccaactcacaggtgacctgcctgtctgtcttaatgttaatgtcaataacagggtagttaagtttgatggtaattgcttcagtgacgaccctgaacaccagcatgaaactaagtattgtcaacaacctcacaaggggagaggatcaaacaatgatgttggacttgtggtcactgttgttggggtggtgcttattgcgcttgtgctttctcttatattaatggcttcaaacagcaagaagctgtcatagagttttagcagaacaacagttacttcaaaagcaattgcaagataattcgacatcaggaatgtcttctgaactgctagtaaatgcaagtaagtcttcttctgaagaaattttgctagtaaatgcctagtttcttatgatatatggaatgatgtgctagatgtggatcatgtgtgcatcactgcatcccatgttttgagatccatccagccgattgtttgtcatagtcacagatagataccatcatacatgtagactatccctaatggtagatgatggtattggaatgaactccaaaatttatttccctgaataataaacaagagataattgtatttcctcctattgaaattctcctctccctcacttcattgcagggtacatatctcaagctgtaaaattagggacacaaataatgcccatgtatcgagcattttctttggaagagctcaaggaagcaacaaaaagctttgagaggtcggcatttttaggcgaggggtcaattggaaaggtctgttgccatcttcaacatctgtctgatactccgatttagttaggaatttaccgtatacatgagataataattgtactgcttttaacctgttaacagtattataattactccattttattagctctgcaagctagatagtttctgacaatttttcctcatactattttaatgtggcattttccttactcctttcctttgttttcagctgtacaagggaaaactagagaatggaaccctgattgccataagatgtttggcattgcaccaacgatactcaataaggaatctaaaacttcgattagatctactggcgaagcttcgtcacccaaatttggtttgcctcttggggcactgtattgatggcgaagttgatgaatcaagtgtgaaaagggttttccttgtctatgaatatgtacctagtggaacgtttccttcatatctttctggtaaggaactaaaaataaaatgaggaattaaagtcgtacgaagtgatagcaatcgaatttgtaacttgtggttcgtgaatgcctttgctgtggtaggctctagtccagagaagactctgaactggtgtgagaggctccaagtgctgatgaacattgctaaggctgtgcatttcttacatactggaataattcctggttccttatataaccggttaaagccttctagtattttacttgatgaacaccttgtggcaaaactgagtgactatgggctatccataattacggaggagatatacaaacatgaggttggtttgccatatcatagaatgatcctactcctcttcccctgtatttaaaggagtctcaattatagaccattctttattttaatgcccttattcctattggtttacactttacaggcagcaggagaagggcagagatgtgtagaagacaatggtggagaattgtaagtacctgcagaacttgtagcaaagtatttcttacacaaagttgcatacaactaataaatgatcagacatgctgaaagtctaatataatatatgtttttagggaaaatttggaggatgatgtgctttcctttggaggtattttacttgaagtacttatggggccaaaacgtcataggaaagatctctctgtgctaagtgagctggtatgttccattttgtcttttgcgtaaagataattaatcaaatatccagatgatagttataataatgatacttcgatcaatatcacggtgatacatagctcgagcgctgtctggactgggctaatttcatgttgtattaagctatctatcaactcaatacagatattttgttggttgggtatgaccgtataactttcgtcctcattgtgctctgcaatccatgatatcataagctgaattatgacaccacacactaataagttctgagtatgaaatgtatgtttcaagcacttctgcttccctgcattagcccaacaaagagcattacatgcacaaatattaggagcaatgttgcttgcagagtaagaactacaaattttaatatccggattaatttggcatgataaaacttcaactgataggatccttagctctctaaaaccctacatgactcatatgctctgatcataccagaacaatcaaaattttacctgtatctgcaggttctgtcaatatcaaaacaggaagagcgcgagcaagttcttgatccggttgtgctgagcacctcttcgcaagattctttgtcgatggtgatttccattactgtcaaatgtttatcagttgaatcttcagccaggccttcgatcgaagaggttctctggaatctgcagtacgctgcacaagtccaggcaatatctgatggggaccagagatcagaagtttcctcgcagacctgttaggctaactgaacataaaacaccttggaggttattgtccatatctgggaaaagacggcgccgcacgtgcaagctaatttgatcttggtgtgcagaagagaatgaccaaactgactgatctcttcctgggagtaatcctgcatttgctgctacttcaacagcatttctgacacatcaacaagttaattaacatgtcaaatgctgtatgctaaacacagatatggtcacgttacgtcctgtaaagagttttttttttctcgattctagcttcccattgctgtgaaagcatccctatgagcagttcttgatttccaaacttccaatcgttgtattagggcattctcatataattaagtagtaggacgagtgatgtgatagcaaaattgatgagttgatagagaagggtatcccatgttagtgtagtaatgagaagatgtaattcatttgccacatgactcgtgctagtgcagaccaaagtgaatatgctccaaaactaaatttgggtaataaaatatggcctaaattctaatttactttaggattcaatgatgcaataatattaattccatttgttataaaactggtccgaaatcactatcgaaaaccaaacacgaaagaaacgtcataggtaattcaaacacgatgatcgcattgaagtacgatatttgttaacgagatttaaccgaagcctacatccctggagtgcttcttcccatccagcatttacagcgtattagagttataacaactatcgatcgaacgccgttggcagccgctccctctcactatgcgaactctaacaaactcctccttagcgaatatgccacgccaacatgaatttgttatttgctcgaacctccgtgtgccagaacttgagttggttcttccaccgctcatgctgagttggcccgacaagccttcaccaggatcaccacaacaagagactcccgctatccctgtaacttcttcctcttgattgcacctgcaacagtgttccaccctctcttatatcaccacaatcgtcttgctaagtgaaattgaatttctttctacctgttacatcatagactcctcaaaaatcatgttcaactacatctactgttttaaatttgacttgttctaatccatggccagataacacgcattgttaccaaatagaaaaatcaaactcactagcacatgaagagaaccttttcttctttgatgtcttacgaaccgagctaattaacaaatccaatatccacgcttctacatagaaagtctcatgtaatatgttgccagaagttgtttctattgaaatctggagtcactgactccaaatcaacaaaacatcttatgttgaatcccatatgagtactaacatcctttcgtgtgagatagtattccgtcccgaagaatcggaacgtaataccttcccacacgtatcgcaacatacagagaggtggtatttgtagaaaacgtgaaccagagtcatctactagcgcgaaatcatcccaacatattgctttccacacagtagcagaatcaacattcatacctattttagcaagcagctccgggtcgtatgctcgcgtatgagcgaacacttgatccctgagaaggttgtaggcctgcatcaactgatctttttacaagtacagctcggagtcgggacaaaacgtcaagccttgatcctcatgcattgacacttggccataagattctgcatgtccttcactcggcacatcctctttggacgagcacgcactcgagctgtaggaatggtggtgtgagctcgatactgataggaactataaaatggaaggtggactgctgaagtataaaggaaggatatatgcaggtaaaacatcttaaaccaactactaagggcataccactcctcctttggggccattatggaatgagggccacttgccatagaatcaaaatgtttttttactagcctggtctcaagagggatgctgacaaaatggttagggaatatcgtatgccaagcgactaaagaagaacacaagttcatattccaggactcctcaatccttttgatatagttgacatggcttggtcacacattaccatgaatttcattataggctaccaaaatccagaggaaaggatgtgatatcggtggtggttaacagattgactaagtatgctcactttttggccttgtttcatcattattcagtggagcaggtggtggatatctttatatggatatataacatccacaaactacatgggatgccaatgggtatcataattgatggtgacaagatattcactagctgtatatttcaggaagtatttcaaatcaatgaatatgcagctgagattcaacgaaaaaaatttggaaaaatattcttctttttaaaaatttgtgtttatatacctgtatgggagggtttagcacaaatatacctaatttgcagattggaaacgcgggaccacaaagcaagcgcgacatggacatgcgggaacggcggatgcttcggtgccgcggagtgaaaacgcggaatagcctcggtcccgtggagcagaagagcggaaccacattgctccggcggccctgtcctgcggcagcgtggtagagagcggcgtcgtgcgggatagcctcgctcccgcggaaccgtggtgcgccaccgacgcggttcagcgtcccgaatgcgcgccatctttccggtcccgctgctccgcacctcggaagagcagcgccgctttggccggcatcgttaattagctcacaaattttttttcattgcttgttggagataaatccggaaacaaaatattaaactaaccttaggctctgtttgtttcaacttaagattattgtaatccagattattaaatcagattactctaagctggattataataagctgatatagaataagttgcga

SEQ ID NO: 28790 - DNA, 8982 bp, Oryza sativa
ttagccactcaataatctagaaaaagctcctccataggagataattagattatactaatactggcttatagattataataatctactggtttgtttcggcttactcataataatccagattataataattttaagctgaatcaaacagggttaatcacatcaacaaattaagttaccaacggaggttcattagccagtataatattttcttattagttgttggagattaatccggaagcagaagagtaaaaaaaaaagcctaatcacatcaacaaagtaagttgcttttttttacggttgtgacctctaatccagaacgcaatgccgctcgtgctggtgcgttcccgcactactatgccgcgggaccgacgacctgccggccaattgcgtagagattgattcacggtcccgcatgatggttatgcgggaaagggagcggtgcctcacgacgggaccagatcggtgccgcatatccgggatgcagaaccgcgtcggtagcgcaccacggttccgtgggagcaaatcggtcccactctccgccacgttgccacaggatagggccgcgggaacgatacggtcccgctcttctgctctgcaggatcgggcctattccgcgtttccgctgcgcggcaccgaagcagccgccgttcctgcatgtccacgccgcacttgctttgcggtcccgtgtttccgaaccgcggattagatatatttctgctaaactctccaatgtagatatataaacacaaattattaaaaaaagagtgtatttccaaaatttttttcgagattcaatacaggtcacctccatgaaacaaattgttagacagaaagagtgaatcaatgtctttgagtcctatatgagaaatatgaccttccaagagccccaacattggtatttatggtcggcgttggctgagtggtaatataccacatatcatacaactatcgagatgaccctattcaaagcattatataggtacacccattcaattgggtgggtttaatatattttaatgagtctagtgtcttgcatcaaattacgatatttttagagtgtcctcaagaaaatttctttgtggtgtcccacagctaattacgcatttgagtgtcttggagcaaatttggtgtaatatataatatccacccaactgatgagagataaatcacataaaatggcagttttgcccttatcttcttctcccttctcatagtcttcttccgacgctcactcgcagtgagctccattggcttgtccattgtgaacaaccgctcggtgcagtcgatggcgcggttgcacatcatgccacaggcgccagtgagattgggcatcgccaagccggcgtgcatggtgaggtggtgcgctatggtgctgccgtccgagtcaccggtgacgaacacgcggccgaagtcagcagcctcggtgagccagccatcagcattgtccaaggtgtgttccctaatccagtggaggaaacccgtcgcatcgtcaactgcggtgggaggcggtgcttgagggcgaggcggtacctgatggagaacacgacggcactggcatccctcacgtggtcgtctggccggggcacggccaccacggtggtgcgagtgcaagtggctccggcagctgcgccgcctccgcggtcgcctatggtgttcggcgtccggtagcggtggcctcgacatgttgcatgaccatgctgagcaactatctaccatgggcaagccggtggagctcactgcgagtgagagtcagaagaagaccgagagaagggagaagataaagggaaatttgtcattttatatggtttctctctcatcaaattggtggatactatattttaatgcgtccactatactacagaaaattaccacacttttagagtgtccttggcaaattgatgtctttgtgatgtcccatagctaattgcaatttttttaaatgttttataccaaattttgcctacctaaaattgcagccctacaggcgtacatcatttggtatcaggggctctcttaagctgagattaaaattttatggccctttcacaattactaggaagattggacaggctgcttagagactccaacttcaaagggctccaatatacatcctatttttcatgtcagccaactgaaaaacacttgggagctcatgcagttccaatggccaatctgctatctgttagaccagacggctggatcaaaactgaaccagttgttgtattgcaaaggaggatggtgctagaaggggagaagctgtgactcaatggttgaatctttggtaaatttatcaccggctgaaccaccctgggaagataccactgtgatccgaagtatgtttctacctttcaatccttgaggacaaggattgtctcgaggggaaggtaatgtcggaatctggagatgagaaatggactgaatatgttctgaatttatgaatctctgaggatgcttaagccaattgaagagaagaggataaggaaacaattcaggagcggattatgaagatcggacgactggtaatagacgaggcatattagttttgcatctgggagcttgctcgttgtcaggaaccactgtttacatttcattttgtcgcttctctgttttcctctgcttttaagctagctctcgtgtggaaccaagggtagatactgaatgtactataaattgagatgccttatggccaaggaatggatatgaacaaacttatgattatcttttatttcaaagtaacttagcttttgagccttttgtgtcttgcgtcatacactaaatttcatgcagtgggggatggcaagcagcagcggacggacgtgggtgacaacgagccatggtggacaattggagctggatctgaactgagggttgctagacgttgagccggcggcggctagctaggatttttaggattttactcccttgctcttgctccggtacaatatcaatatacagggaggagaaattgggaatttaacttttcctggagtttaatcctaaatggcatatcaattatatacactagtgatagaaagttactttaatacttttcatacaaactatctcatatatacccttaacatacacaatgctagacaactgcagtcttgtttctacgtgtggattgaatagaagccgtgatgcccaaaatatatgaaaccctaaaccatttgcaattttgatcatcatatacatctttgcaacattttctgcaaaacgtttatataaataaataaataaataaataaatgcaatagaacaaatcaattcctgatgttcccattcaacaagaaaatataaagccgtgatggtcagaacatgtgcaaaatcttacaaagagggaaagttaaacttgatacaaaactgagagcacacatgcatgcccagaaaggtgagtcgaccatgagtgtgtatataatcccttttgttcgcatcaatggcgcgataggtgaaagcgaggacggttcgtgaacttccgtccgttagctttgacataacgcgtgatgccaaagcaaaaaccagaccatagtagtgacagcaccaaatggaaaacatcattacgtgctgcaaggaaatgaatcaagttagtatgacaaagcatgaagaaggatcaaattaaacttgttggagtgaatttggcctagtgacttggttatgtatttgtttccacatagtaatatgttggctgcaaacaactcgtcaagtttacaacagttgagtgcctctaatctgcataaattaacttaaatcattgccatttcggtaggatgaaatagtacctcttctcagtgacattatcaagaatatcacggcagccaaaagcagagcaaaagcaaggcggaaggactgcaaatgaaaactcaagtaagttctccactaaaatatcctaatttaaatatggaaaaatattgtaggatcgtaaagggcctttcccaccccaaaagctagccattgaggtgaggggctcccccacttatatcttaagtccctcagcctttcaccgtgtatagaccccacagaacaggcccacggtccattaggtatacgggccccgcaggcacccacggtccatcaaaccttcacatactgtgtccatcgggccagagatgttaacctagccaggctctgataccaattgtaagaccgtaaagggcctttcccaccccaaaagctagccattgaggtgaggggctcccccacttatatcttaggtccttccacaaccaatgtgggactattcaacaaatatctccactaagatatgcataacgacattcaaatgcccatgtaactctatcaacacgaaagaactaaattgagggaatacatcaggggtggaaatcttcgcaggtaattacactgctggttaccggccaggagctccaaaccagttactggtatttccggtcagaacattatgagctgtatattttttgcagcattaagtgtgataaatactaagtcattaaaaaaaagcacgcattatccatgccataagttttaatacaaaattttccatcaaaaactggttcatggtcggttacggctggtaaatggtttgtgaattaaaaaaaatggatatagtggttttccagaaagactggtattcaaaaccttggtatggatcatagcatcaccgctgtcaacttatcctagtaagtagatggaaacatcaaaattatgcatagaaattcattgtaaattgcaatccttttaagcatgagaattcagaaccaagagtaagaacaataaatgcaattcacggtatgcaacttaaggattattcatctgtaaaaaaaaatctcaagtaatagaaagaaaataaccaaccgcgtgattctctataagtcctttggttggagttggcatatcccgactaactgaggatatgtgatgtccttgaagaagatccatggcatcctatacaagacaataaacaaataatgagttatcactatgccttgatccatcattaccaacgtaagggatcttttcttcactcgtccatgatgtcttggataaaatagcaaacctaaaatagcaaaatccaactcactccagcccatcaatggtgagaccaagtaagcaacatacctgtttagtaccatctgcaaagttgttcaggtaatatctagccattgcattccacagatcatttaaaattccctgtgtagttcgctttccgtacctaataaataaataagatatagttaggttaagaacaacaaataactaattaatcattatttgtttctaaagatccaacaaccaaaagaagaaatagatcatagacagcggattaatagaggaaaaagtgaaaacatgtggcaatgccattggcagaacgatagtattattttgcaccttatgtgatcatgtagtttgtcagtaatttaattataatactgcactctcatgcattagaactgtgtcaacatcttaggtgtcagctcagtcctgatactgggaagtaagcaactaaacataatccaacaagtaatttttctgatggtgacgagaagataacttttcacagcgagcaagaaataaatcagtttaaaagttgccattataaaggtttaactattgaggagattcacaacatgaaactagagaaaatgtttagcaggctaggtgttaaaggatcttacaagttacaaaacctttgcttcataaggaaacattagcaactcagcttaaacgtgcttatggttgcaatcaaatcattacttctttttctgaaattagtaggtccaaattgtgcaaaggaaaaggggctaaataagagaattcacaaaaacttgaaaacacaaattaccgcacaaagtctcccttcaaggcaggagttccagagtactgagtgcttattgcatcgccatggttggcccacactgaaaaagaagtcagcaattgtttaggaccagcaacattgtgagacaaatgtgggggacatactaacaaacatgtttagtgaatatcatatgcaacacttacaaactttgtaatctgcatcaaatgccggataatcgctgattgtattgttgtcaccaagaacactgattttttgcagttggctttccaatatttttctcccgatcatgctctgttttgtgtattaaggagactattgtagttacatacacattaaaaaaatggagaaggccaaagaaacaaagtaattgctcgagaaagacataaggatccccacacaactacaaatactttgaatgtaatattctagcccagtagttgctacttgctagtgatgtaacccatggtgtggtttggtgagattagttccacatggagcattgttgacgcccgtaaaatgctaaaagtgatattttgtactccttaaatacttatgaataaatgaggtattgataaatgctgtatttattttggcactaaccttaatgtatccacgagttttggtgtgtcaacaagtttttggcggtaagccggtaataagtgcatcaacatattcaagcaaaatcaggaagttcaaaaaaaatgcaagaacaatgccaggcaacgtatgcaacggcccaaccagcctagccaaccaagggatgcagtccggccggtcccaaaccaagcatgcagcctggccagcccaagcttacagcccagccggtccactccgtagcccagtcgatcccacaccgacataagttggctagccccacaagatgccttagctgctactccacctccttgtatgctccatgcagtgtgggagaaatgcctcatgccacttcattcctccatgcctggtggagatgaaacccatatgcccaaggcacttctaatataaatagggggctccactctcacttcactcgcccctcttctcgagagggtggaaacagctaggaaaagatagttgacaaggaaagaaatctcagagaccagaaaaatactataggccggaatgctaacactccaaatttgtaccacttcgatgattttttctccccgatggaataaaactcctatcccttcaatccggtaaaattctgatgtgatcttattatttctttctagtttactatttgttatctgttggtacctcgtctattcacactttatgtttatattatgcatgtctagttactctatgtttagacttcaatgtggactatttaacctattgtctggacatggtgcatggctatacatttacaaggaatgtgggtgacctagtactgccaacaacccttctctcaaatggatccaaactgaagttatccaatgacaaggatgaaacaacatatcatttattttttgaatgtccaatgacaagatcaatctagaatgtggtgatctgctcgcacattcttgtgtaacgaaggtttatgctctactaccaaccaaagtccatatcgactaaactcctcacgttgtgtagaagtgttaaacgaagatactatggtcagaaatccctcagtttgtacctacctaaactctatatgtgggactaatcgcaccaaaaccacagtccgggctacaagagccactattattgggcctagtattaaattcaccccgtgaaggtttgacaccatggcagtgcataactaatgtctagaaccacccctaggtacataaccaagttttatgacctccatgagccaatgcatataaccccatcaatcccattgtttgattgaagaaattaaattggaacaggattggttaagaaaaccttctctttaggaggtgagaattatgttctattttcaactttccattctccccgcatttttcctctacttctctacatggcaaacacatcaatctcattcaaggcagccacatcgaaaaatctcatccatggcagagtgcttcttctaggatcgcctcctctctattttctgtgttggttggatgaatgatgccttgcgcccttcccccacgcggtcagaagtctatcatatcacctttaaggcagttggatgatttcgcctccccagactgctccattgttctagctgcctccacctctggcacacgcaatgacgtcggcctccttgtccaactctaggacagggcactacggcctctccccatctggcgcagcgtgcggcatcctcttcactagcttcaacgtctcctcatagaccagagtcatgcatgcaccatcgcttttctctcaccggctgatatccacgcagcgaccagacatagcaaaagctatcacgtgcgaggtgggaagagctcatctagcaaaatttctggtacaacaccgttttgcatcttggtcgaatattctatcatgttggatgaactcgtcccggctcattccacttcgtcctaccaaccaaattcagggtgagggcctcgtccaaactaaacactatctagaagaacctaggagcgattatgtgatgttctgtatcttttgaaaactgcacttagattacaatactgtactaaagtacatcccattctttcaaaaaaaaattaaagcgatagttaccacatcagcaattattttgttagtatctagaattacatttcaaaatatcatgaaaaagctgtccttggaagtatgtacctgagttacattagtacgatccagacaatcgacacaatttgttctaacggttccggtctgctcttccattttctcacctttactatttaaaaggaagtacctatgccatacaattaaaaagactatgagaacaaagaaataatatgagtttggatgaaagggattcttttgggacattccttgggttttaatccaaattcctcaccaaatttcagctaggaggttttatataacatatgtgaccaaaagtgtcagatgcagctaccattttgccatttgttttcttgttgtgtgggaaaggtagatgtgaaatgttttttttttctcgccatgtagagatggcaacataagaacatagaaaaagaagcaaaatagtttgactaatgtacgataaatttgctttccctttgacaggaacaggg

SEQ ID NO: 28791 - DNA, 1296 bp, Oryza sativa
tcttctagcaacatacctatgctacttaagataatcctcaatttgatcatacagttgagaaaggcgttcaaagtgaatatgaccacagatttgatggaagtcaaaatgcacaaatctgcaataattaggtttaatgcaattataaacagtaaaccacaatagaataactctagagtggagcaaaacttaccttatatcttcactcaagataggctcaattgattttgcatatctttcatacaggcgaccttcgccaccatgctgaatatattaacaaggtatatgataggtgaaaaatatcacacaggagtagaacaaactagtaccaccaccgcatattactagcatgttaaaaataagaagaggcaaaactcctaaacatttaactaattctagagcaaacaattatcgttatgtaatataagctgaaatgaactagttaattctatttcaaggaacagaatatacaaaatcggagataaaaatgcaatttatggaatgaacatgggacactattcgtcaaagtgaagaactcttttttctttttcttttttttatcttggttatggacatactgaactcagttgtggcagtctgcggatcatggatatctcctggagcctcttgctgtcacgcaaacaacacaccgggtttctctgtatgcggctgatgtggtcatgttcttgtgtcctacaagtggggacctatctcttatcaagcagattttggagtttttggtcagatttctggactaagaaccaatatgatgaagagctcttgcattcctattcactgcttggaagatgatctggaagtgatttctaatgagttgtcttgtaaagtgatgagcttcccttgctcttatctcggacttcctcttagaatatgtaaaccaaccaagacagaattgttgccccttgtggacaaagtggcagataatttaccatgttggaaagcctctttaatgaatagggcgtgctggcttataacagtaatggtggtcctctcggcttttatgcaatgatggcgttggatctctaagtgggtggtcaaggctatagataaaaggcatcgcggcttcttatggaagggaagagaaaacactaatggagaaaatttgtttgatctctttggatcgtgtgtgtcggcctttgtgcctatggaggccttggtatccttaacctagaaaagatgggatgagcattatgcatgaggtggttatggcttcaaaaactgattttgatagaccttgggctagtttatgcttttcatgtgcctagaacgtccattctcttt

SEQ ID NO: 28792 - DNA, 3657 bp, Oryza sativa
aatctacctatgaagcttatttcctgggatcgatcaagtttgctccttggaatcacatttggaagagttgggctcctcttcgctgtaagttcttcatctggttggccgtcaataatagatgttagacagccaaccaacttgctaagcgcggattgcagtaccccgcggcatgtcccctttgtgattaaagtgaagaatccgtcaaacacattttgatttcttgtgtcttttcttgccaagtgtggacggcactattcttgaagcaagggatatctgatgcagtgcctcaaccttcaactatttgttttttgaggtagtggagccaagctacaaatgactgtgttttcaatggcgccaatcctagaattgcggcggtcttgcaggtggtagagaatgagggtaacctttggtgtttagcaggggcatttgccctccaaaagtttcttaatggagcagcaaacctaggcagactagcgcttgccagtattggctggggtgtgtgggtgtgttttttcggtgagagtactctggttctcctactttgtatttttgttctttatttttcttccccttaatgaaatgaaacacatttctcttgctttttcgaggaaaaaaatgaagaactctcattctggtcctgcaatcaagacaaccatatgacacagcctagatgatttgtaggggggtgggtttgatgttgcaactgtgtgaagtatcaagatgaggccctggaccctgtggaatggctaaggatctatgatgtggttccagatggcaagggataggtgaaactggtatttctttcttcaatcatgcggcaggactttcatagatgaagttatctaaaaccactaacatctaatgaaacaacaaaatgacttatccagagatatgcataattaagaccagttttatctaaatatgccaacaattagacttctgaagactgtgtaaagtctgacaagctgccttgaggccagtcaacttgcacaccaatggtagggaatcccaacatgactgttatacatgacaaacagaatgaagagactggtttgggtccaagaattcaatacttactgtattgacaagatcaacagccacgacagctccatatttcttttgtaaatcatgaaaatgccgttcaagtacacgaggctgcagaaatcaaatccaagaaaatttatgacaagaaaagtataagcaatggctacattgcaaatacttaagttagatcttcataatatgtacatgaactgaaggggtagaaattagtggagcaacaacgagaaattagtagagcaacaacgataaaaaggaaaaaaaatcgtatgatgagagcactcaccgcctcctctactctgacaacatcaaaactaggtttatatgtcaaatcaacaatttgttcccacaaaaaaggcatagaacctcgaacctgcaatacacatcaatgtaacaaagttatcacagaatataaaaataaactgtaagccaaaataaatatgaaaggtgctagaaaaaagttgggaaaacctgcaaacttttagtgtcatattcaccgctagtatcaagatacaaataggaagacaagaaatcttttagcgtacatgagctgtgcatgattgactcttttttccttttcgattgttgattccaaagataaattggaaacaaaatatgaaggttaacataactttatgtgtatgcaaatcattattttttcaaaaaaagaaatgggacattgcatcatgtcaattcctcaaacggggacactagctcccctatgtgtcattcaattgagtgaagaaacttacttgcacatatgatgctgtaaattctttcgattgcattatctgctctgattcaacaaaatttgcagcataaccctctggatcagctcctcgcctccacatccgggtaccttcaacaaagaacagctcgtaaattcctaaacgatcattgacattcagtttccaaaaatagtaaaatagcaaatgaatacaaatttaccttaggttctaactacggtaacatttaatgaaaagaaaatggcgaataagcttttgatggttcgtaactcttacctatcctacgtgtacaccgacgtgcaatcagggtcacatttaccttctctgacccaacttctgcatggatactctgaaaacctgatatttagttaagttgcagaagttcaaattgacatatgaccttaacagaaaggtaacctaaatataaactatcataagtcatctaacatctcaggtaataagttgagatgttacgatgaggtgaaggatacttccttgaatgactggtagtaagtattggtgcagctgttgagggacaaaagggaaatcaaaattaattgtaaatattggtcacacgatccacagttaataacaacactaatcttactttgttctcaattagaggctccaacaagtaaccgttccaaagaatcttggttctgcctgcaaaaggtataattaattaatctggtgcaaaagtaaccagtaaagcatcaaaagacttattaacatgtccaaagtgtactcatgtagtttattaaaccatttcattttctgcagaaaattcctcctatgccactgagcgttccttcaattccttattatgctcctgcttttgcactcacttaactggttatgtatgaaaatggcacaagagaaataaaatttgcactcaaatgacgttcaagaaatgggaagtatatagtggcaaataaggtgttgaggggtttatgggattttctcgcactacatgcatagggtggaggaggcaactgtgtcttcaaagtagtagaaaaaaaatcatgctcctatcacttttaccactaccatcaaactctattagttgattaaagttgttttggattactaccctacactgttttggtagtgctgaaacctaggcaagtttcagtactaccaattatttggtagggtccataggattgtattgatttggtttggtttgatgccaattatgagccaattctttgtaggttaagacagctttcgactgctgccaatttggacatgggcattgccaaaaatatggctccaacccaaatgcatcacaactactattcaagtggccaaaatattggaaggggtcttggtatcaaaccaaaacagtccttagtattactaaaagtgtggtcaatgacttaattgtaaaaaggtaataaaaataagcggtggattgaaaaattatttgcatatgttgttacaactcaatttttcattttgtttacggaacagttttttcagtgaataccatcaaacaaagttttaaaagatattcactgtgattgctaaccatgctatgacatgtttgtctttcatttgtatgtcgtagctagcgttcatttctatttccgattgtctttatgaaaaacaagatgtcttaatcatgacatgggctccatctgtgtgttctttcctttttttgcaccacctttctcactgtccctcacagagttataacatttaataagaaagcgtgaaataagtcaatgaacattttactgcccaggtcattatacaatacttgcaagtttggtactgagtggccaatgcggtcttgctggatggtaacgttggaagttcacaatagtcggaatcgtacacgtgcaaacca

SEQ ID NO: 28793 - DNA, 2182 bp, Oryza sativa
accattgctggacggctaatcgccttgccaagcgtggactgccacatcctgctacttgtatgctttctgaccaggctgaggaatccattaatcacatcctagttacttgtgtcttttcccaacaagtgtggtcactaattctccaaaggttggggctgatttccatttctccaagtcaaaattctacttgcttatgctgttggtggcctaaggcagtgtaagaggcattgatcaaaactccaaaaaaaaagggctcaatacagttatcattttggtggcttgggaaatctggaagcataggaacgactgtttgtttaacggcgtcaatcctaatgtaatgtctgtcatccaaacggtggcaaatgagtatgacctatggtgtatggccggagcttctaagctcacatatttccctagtaggtcgctaaccccgtttgggtaaggttgtttttgttccttttcatatgtaacctcaggtcctgtttgtttgtagggtgagggagggtttttcttccctcctcgtttttttttcctgtcttaatgaaatgatacgtatttctcttgcatattcaagaaaaaaaaggtcaatgaaccttaaaagaatccaaaggataagcttgaagattttgcaggatgctagtagaatcattaccaatgggcacagtgttagcaatattctaaaatacggtgcaaatgtcatcacggaaaaatcaaaatgtaacatcagcttttgctaatttctcccaccacatccttcttaagaaatcaggacaaggaaataaaagcaaacatactatattgtacatctagaaaatatttttaaactgaagcacatgaatatcgtattctaggtacgctatggacttctgcttgcttcttggacctgttcattgaactgagaatcttccatttgacagtctatttaaaactagaaactataatttacaaattaagtaagaatctattgtgtgacatgttccgatatagctttcatgcatttggttcatttcgcttggatttgtatgatagctattttctcaggaaggaatatgctaactaggagtgtgtggtattataaattgagtttcttaaatggaaaatcacatcgttacaattttgtcacacgtgacttctcatgaaaaaatattaaccacaaattgagcatcaaaaatttttagctgcactacaaatatcggccattcaacatggcttttgtcacaaggaagagaccattcaacatttgttttttcaatgtcgtgtttctcgcttggtatggtctgttgttcatatggcttcgaacatacaacctcctcaaaatattactcacttgtttgggcgttggcttacttgtgttcctaaagacatgagaaatctgcttttgatgggtgcagcatctctttgttggtccatatggctaagcagaaacgaggtaatttttgataacaaggtggtgtcttctcctttgcaggttactactttagtcacccggtggctacgctcctgggccatcctccacaaacagggacttcgggatactattgcggtggtatcgcaacgtttggattaggtggcacaggagttttttacccaggagcatgggtggcgatctagtctacggattgatagccactagtttctatgttttgtgatggggaagtgttcttaggtccagttttttggttgtgtgcattctatgcagaggccgggggtggactcagttggaatgtatcatcttggtgtatttaactgagtcttaataaagcttccattatctaaaaaacaaatatcggccaaatgaaacacattgcatttagaaaattttaacttcaattccatctttctacatcacaagtgtaatccactgatctaataagtaataaccaaatatacaattaggttccataataaggaaagcggtataaatcatgtgaagatgttgaggacaagctatagaagcttgcagattatataagaaaggataaaaaagatcaggaatttcatgcacaagcaaaccacggaattatgtaaggagctaggcaacaaacctgtctccaaagtggaagtgacttaaactgatctcctagatcatgcagcctctgtgaactacaacatataaggggcagagataaatgcttaaccaacttaaaacgaaagaagaggaagataacaaaaaaaaaagaaa

SEQ ID NO: 28794 - DNA, 1051 bp, Oryza sativa
cgagttattgcatggcagaacttttagtcccgtcaatttgaaaattgcatgccccaagtaggatccaacacaatcacggccagtgatcacaagaaagtacgaccgaactgcaagtttgagcactccaatcacaccaaaaactattctaactttaggatttgtagagggaccacgaggtggcaactcttccactagactcattgatccatttgtccgatcaactgacaggaacaaatcagcaagaccgtcaactggttcaaatacgtaacggtctgcaaactcccacagccttagtcttgtgtgtagctttggtgaagggcatgcttcagttgcaacactcatcgtgtgatgccctgatagaggaatacatgagtaaatgttaaatcatcagaatgataaatatgggccacagatataaccagtcaagacatgtgatgcccataatatactggaacaatagtaacagatgaatacctgaataatgttatcgtgctcttaaaataaccaataacagtacaagtgtcaggattttcctagtaaggataagcctattgtaatcatagaatacaaacacatgcacattaaactaacatccttaaaaaactaattgggatttgtgggccatggaaccaacatccttcagcatctagaactgttagatagccatggtccgatgatcatatcatatcgcatatagcaagacaaaaagagcatatgagacaagaagccaaacaagtatgacgaaaagggccagggaaggtaccctgccatgtatcctttttatcacaatagatagatagggaaatcaaaccggataactataaatgtcaaataaacaagaaagctattacataagaatgcacagataatataatgtgaaaagaaaatccataacctgattttaatactcatcacatgatcctgaccttgcatcataaagaatgtacacagttttctatcaatcatgccaacagtgcctaggactcacattttctttttttctacaaaatgctattccatgatttcatataattatgcactgacaagtcaa

SEQ ID NO: 28795 - DNA, 4970 bp, Oryza sativa
acacacccgcaccacgacgcaaaaccgagaaattttggcaagcagtacgttcagcgcctcaagatcgatccatcacggtctcactgtcaaatcatgcgccccaaaattttgtataaacaattcaaaattgccgtaggaaacgaagcacacaaagagggattagatcctgacgcacctagcactccggcagcggtaggggtcggaggagagtggaatggatacggaccagcggcggttggggatcggaagagggtggaatgaatggattgagaaggggaatcgcctcggagaagtggagaaggggatggaactagcggtagtgagatgaacgcgggagagggaagggccacactagaagcggggcgatggtggccatttttggtgggtagcaacaatgtcggaggcctggtctgataaaatcctcacgttctagtacttttcctttttttttttgattatttttcttatggatgcgactacagggagcgcatgcactcggttgtgctaaccaacgaccatgctttttaccaaaaatagtgcagtgtgtaatcaacttgttacccttcttactaaaagtagtagcacctgccacttgcatcctcatacccatctaaaattcaaataatttttctcttaaatacttatctgatctacgacccgattacatcgtttcgttgcaattatatctgtacatcaagatcttacatgattatattatgatgaaaaaaatatttatgcttgtaaatcacttttaattatatactaagttacttttatcatatatatatatataagagttggattttttgcacgcagttcacatgtacccacaaggctagtatattaggtgctaacaaaatgtaacatacatgttatactatattttttacaagtgtaaaataccttgtttatataatttttgtatttcttatgcaaaacttgtttatgtagtttaccttgtttatataaattatcttgtttatgtagtttttgatggtaggatatatatcattttggaaatatcatttttgcaagatgacaatttggtgatatagtagatatattgttttctcattttgactaaatatcatgttataaacaaaataagggttagaaaaatacaatgcactagatatataaatgttatatatgattattattgaaaaatttatttggtaaaaaatgcaacatacatgttatacatatagtgaaccaacctaatcctaattatcttttctccctatagtaagcattcatttcgttaaggttagctacattttgcagcaggaatcttggaacacatcaacagtgtagattgtaggtacatatgaacccgagtgcgaatctgcattatacacacacacacaagcaaaatgcccatgcgttgcattgggtgaagcaaaaaaaagaaaaagtagtaatgggtgtgtgggaggagtgtaaagccaccaaggttaattgagctcctcatagtcaaatcgaatattcccggtgcaagaatgctctaaatccacttacatggattattataagaaatcaattaataccactataaaatctctataatataaaaaaataaatttttttgccggtactttagtacgtcatccgtgtatgagtcggtttttaacttcgtttacttttggaaatacattttcgtatttgagttagtttttaagtttgttcgtttttggaaacatagaaggagtcgtataagaaatctctttaaaaaaactcgcatgctagcttgagatgatcggactcctaattgcagcttatgactttctaaaaatatatatatctaagcaaatttaaatagtgaatttcacattaattaaacagtataacaataataagattaaaataactctcatccattgcaatgcacggggatttttatagtgaatactaaaatttgaaaccataaaaagtatttatttttatcatgagtcagttgcaatgtacggttatttttttgtcattgatattgataaacacttttttatatcataaagagtacccatagtagaagaaatatttttagctagctatcagatcaagctcactgcactccagtagcagaatcgttttcactaaaaaaaaacagaaggaaatcgtacgataaatagaaaaaaaaagtgacgtggttaggtgtcctacggcgaatgagaaattgacgcggaaaacaatcttgatgcaaacacaattaattttgttggtgattacgtgtttttcttgaaaaaaaaagcatgcgattgttttttatattttaaaaagtaaatcattttgttggtgattacgttgttttttattttatttttaaatagtaaaatagcatctatttttatctgatctctggtacacgtgagtccaaactttataattcagtgtttataacgacgtgcaagcctcatatttaagcaggtgcttgagtgcttctcaagctgtggggaagttattcgtgttacagtaccacgatgctacagtctcggttgctacagtaccgtgcagtactgtgctggctggtgctcctctgttatgtgggctggctgttgggttgagactgctgggccggccttatactgctttggttgggctgcttgctagctttctgttttttcttttctcttttatttgtgggtgtaagagatctccatcacgcttacggattgtggattagcgacaaaatattgtgtgggcccatgcttaacgacggacgaatgattaaccggaagctttacttatttttttaattaggtactgcggactctaatatgtcgtgttttgttgatgacgaaaaaaaaagatgtttaattttcaaattaaaattgattcattataagatttctgaatcataaaatatctgttgaagaaagcggtgttaaacgtttgatttttcagtgcatggtccgtgctagtggcagagagaaaaaaattgggattaaatagaatttgagatgtgagaggcaaaatagacttattctgagtaataattagtgttcaatttttttaaacggtagtgcagcatatgagaggccggcccgtactcagtgcagaaggttaggaatatgagaggccggacccatactcagtgcaacggtagtgcagcatatgagaggccagcccatactcagtgaaaaaggttaggcataggaataagtttaccggaggtccctcaacttaacagcgagattttctgaggtcccttaaccacaaaaccagaaatctccacccctaaactatacaagaccgttcactcaagctccctaggcagtatatatgggtggtttcgctgacgtggcatcctagtcagcaaaaataattaaaaaaatacgtggggcccacatgtcagccctgcatattttttttggcaaaatttgctacaggacatctaaaaaacgtgtaattagttagaagataccgcaagaatgtttatttgttgtagggcattgtaaaaaactggtaattagctgatgggcaccaacaagattattttattatatttggaggaatatgagagagaaacaagcattaaataccagtttacccttgcctcaaattagttagtcttcactaatcacatattctcatcgccaagcaaagagcaagagagaggaggctctctcgagcgcagcagcagagtcgtgtcgtttcctccgagggcagcagcagtcgccgctgccatcgccgctttctcgagcgcagccatcgccgctccctttgcgctgtcgttaccgcgcaccggaccacgtgcaccctctgcgccgtcgtcgccgctccctttctccgcgcataggaaccatcgtcgcagctcccattttccggaagaagcaaccgccgccgctgtcgtttcctttctccgcgtgcagcagctgtgccgccgccaccaccgctccctccctccgcaagttgccgctgcgccgccatgtgaccgtgcgaggcgtggcgtcggcgccggcgggcggaggcggctgttcagtgcgttccggcggctgcgggtgcggtggctagtggcgctgtaccgccgctcgctgcggcggctgcgcgcgtactacaccaaggcggtccaagacctcctcgagggcgcgacggtcatgagcacgctgcactcgtaggctgccacagactgctcgttcggcgccgctttcacgccggtggtcgtcgtgaaacaataacaccagtggttgctcctcctccttcgcttgcaggacatgaagccatggagtagtagcaccggtgacggcaggtgagcgagcgccacgacgataggcgaagcggcggcgagcaaggttgaaggcagcggttgagaacagagagagagagagagaaagaatgagagagggagaaaaggataaggaagaaacaaaaaagaaaaagaaaaaaaatcaaaaggtactccctcgtctcataatataagagattttgagtttgtatttatattgtctgaccacttgtcttatttaaaaaatttgtgcaaatataaaaaacgaaaagttgtacttaaagtattttggataataaagtaagtcaaaaaaataataattttaattttttttaataagacgagtggtcaaacaatgcaagcaaaaactcaaaatcccttatattataggacaaagggagtagaaccgtacttacacagctgtttctctctctaatttttttagatataataaaataattccgcgggtgtccagcagctaattaccaattttttgcagtccctacagcaaaaacgcgttattgcgatgtcttctagctaattacacgttttttgaatgtactgttagcaaattttgcctattttttttcttctctgttcttcctcttctgttctcttttctctcttctctcttctctcttgacttcttgggtgagggaggccggcggcgggcagcgagcggcagcggttggcggtggcaggtggagtggcgggtggtttcgccggcgtcatctcttgctggctccca

SEQ ID NO: 28796 - DNA, 1033 bp, Oryza sativa
gcgcgccctggacgcccgctggacgggagcaaggtcggaagaactccacgtacgcgaacgggagcaaggtcgccgcccgcctcacccgccttctccgccgttctcctcgccgccccggtgcgctcgtctgccgtgggcccgcagccgctccgcccaccggccgccggcttagatccctcactgaagaagaagaaagaagaagagaagagagaagagaaaagaggagaaggggaagaaatgtgcagctgacatatcggcttcacgtatatattttttttcctgactatatgccacgtcagtgaaaccacccatatatacctcacgtatatatatattttttcctgactaggatgccacgtaagtgaaaccacctataaattcggccggcttagatccctcactgaagaagaagaaagaagaagagaagagagaagagaaaagaggagaaggggaagaaatgtgcagctgacatatcggcttcacgtatatattttttttcctgactatatgccacgtcagtgaaaccacccatatatacctcacgtatatatatattttttcctgactaggatgccacgtaagtgaaaccacctataaatgtaaaaagttagggtggtgggaatcgaacccagctggccaaagcaaagtttcactccgctaaccaagttggcaagctgctagttgtgttcaataattcaatcaattaatacatattctatatcaatcgtgattttgaagtagattgaaaatggtccgactcgactattgagccgattaaaaatgattttagcaacgtttgaacaggatgacggacggaaaaaaaatccggaaaaccttacgtattttttattaggggtgtgtgtgtctatatatatatatatatatatatatatatatatatacatacatgtatatatatatatatatatatatatatatatatatatatatacatatatatatatatatatatatatatatatatatatacatatatatatacatttatatatacatatatatatatatatat

SEQ ID NO: 28797 - DNA, 4072 bp, Oryza sativa
agacgtacgatgagtattgatacgtatacccacgcgtatacggatagttccagtatatgttaaggaaatctatcacgtgatagaaacagaatccacggatgtaaggagtcctactcgggcaagaccgggtctttaccatatcgtgagaggtccgatatctccgagttctacttggagatcaactaacccgcggtataaaagggaccccctgggcaggacctagggcatcgaatctcaccgcaaacacatccaccacagctacgaagccggagcgcataggagccaagtcgccgggagatctagtcgaaccaactcgactactctctcgtcggtaccatcgagttctgttattccctttgtattatgtgatttccatcatataatcccataccaactggattagggctattacctatcaaggggcctgaaccagtataatcattgctttctgtttgcttgatgccgtactacgtagatcctcgttccaacggaccccaggtctacgggtatcctccgttgacagtggcgcgccaggtagggcgacttggtgctcaaggttctactactatgacttcaagcctcttcgacgacagcgtcgaccccggcatcaaccaaggagcctcaacttcaacgatgctggtgtggactcaagtcggcgaaatcgtcttcccggtctacaccacgatgccgatctcgaatggcccagcaattaccaggagcgagaatggcgtggttacgaccccggtcgactccacgtcgaaagatcctcctgcagaagcggagaacggaacatcgacaacatttgagcccgagaaggatcctaacacggccaaatcttgtctccccgacgagaagcacgagccgacaaggataacttccgaggcgacaaggacctggtgtcctatccacaagaccaaaaggcacaccttgcaagcttgctcggtttttcccgacgtacaagctgaaatccgtgcctgcaaataacgtggaattcaacgtacttcccccactcgtgatgtctattgtcccattcacaaggcaaagactcacgacctctcgagctacaaggtccttctcagtgccatgaggacgtcgcctcctaaggtctagcagtcacaaatctcccctagagatgcggacaaggagcgaggagtggcgactatttcagatcgattcgtcggggtaatcgatatcgacccccacgagccgtcttcctacatctgctcgaagaccaggcctcatcatcaacaagtacagcacgcaacgtgtacgctattgatgggaccagcacatctacaggcggcaacacggaagcggaggatcaattggctacgcaggcccaacatatcagaaccatcaatgcaatactgagggaaaccccttatgatcccgtcttgaacgctgatcttgatcagtggatgaaacgacaacgggaatcagtggccaacctcagaaacgcgatcaaggaagccgctgccagggcaccaccagagacaaccgccgacaggcggcgctaatggggaacagcctgaacagcggacgccacctcgtcaagccacccctctgcctcgcggcactagtgatctccgcgaccatctgaatggccgccgagaagcgcgacgtactcaagataacgaaaatcgttcccgacatcgcgtctcttcgcgacatcgcgagaacgaagagcaaggaaggcatccgagcgagaaccgagaccgtgatgatcgccacaaccgtcgcgaacgcactaatcgcgagcaacagatgccgggcgataccagtcgaggacgacgccgtaatgacgacgacgatggagatcagcgccgggacaacaacggtgggcgatgacaaggttctcaagaacctgagcgtcatcctcgtaatcgcactccgaagccgagtgactcgtcatcatcctcgtcatcttcatcatcttcatcatcgaacaggcatccacgacgagcacatgatcaccgacaacccaccgcccctagcggcgggtgcagagctttcactcgttttctgcgagaggttagatggcctgagaaatttcgactaggaacaatagagaaatacgacagaagcaccgaccctgaggagtttcttcaggtctattccacagtactctatgctgccggagtagacgacaacgcattggcaaattatttgccggcggcgttgaagggatctacacgttcatggctggttcacctcccaccctacttgatttcttcatggacagatctgtggcagcagttcgttgctaacttccaaggaacatacaagcgccacgcgatcgaagacgacctacacgcgttgaagcagaatccgggcgaatcattgagggactatattcggcgctttaatgagtgcagaaatacgatccccgagatcaccgatgcttccgtaatccgcgctttcaagtctgatgttcgagatcgctacactacccaggagttggcgacaagatggatcacgactgctcgtaagttattcgagattgtcgatcaatgcactcacgcggacgacgccctgagacgcaagaacgacaagccgaagacagggggagagaagaaaccagccaaggatgcacctgaggcaagcaagaggaagagtcgcaggagtaggaaaaggaaagctcaaacagaggtcctcacagcagaatatgctgacccacccaagcacctagacccacaaggtgacgacacgaagcaaatatggtgcccgatacacgagtcggacaagcactctctcgagacttgtttcgtcttcaaaaaggcactcacgaagcaactggcgttggagaagtgatgaggacacaactaactcggatataaccatggctactttatgtattaatcaaccaaaagtgcatatgttctatattagatttaccttgctaagttctcaaatggagaaagcggagcaatggcagtaccatgaattatttgaaacaaagtttgtggttaaggatagagcatgtcgtactataatcgatagtgagagttgcaataacttggtgagttcagatttggttgagaaacttgagttgcctacacaaccgcatcctcatccatattacatcaaatggttcaactcttgtggtaagttcaaggtaaatagaattgtgagaataaacttttcgattggaaattaccatgatactgccaattttgatcttgtccctatgcaagcatgttctttgttgttaggtcaaccatgggtatatgataataatggatcgcataattttgttgctaatacatacacatttaaacataatggtcggaaaatgaaattggtacctatgagttttactgaaattttcgaagataatcttgaaaggatgaagaatggaatcgaggaaattttcaaagatagtattgaaaggacgaaaaatagaatcgatgagattttcagagataccaggaaagatactattatgatgccttcaactaagtctaagttattacaaaatgaacgtaatgttgtgcctattgttttggatactaatattttgcaggcatctgagaataaacaaggtaatgggaaagagaagaaagacgaagaggaaaaagacctatctttagctccatgcatgcttgaagaatgtttaattaaccaagcacctataatttctgaagatgagaaaaaaggtaatgataatggtgctacagctacttaaggtatgcatatttatgaggtgccaactatgtccactacttatgctacattagagcaacccacggtggaaacaattgttgaaatacctttgtcacaaaacaatttccttgatgtttcttgtgataaagaagtgttgtgcgatgcttcacttatatccatgccacaactagtgaatgaacatgttagttctatagtagagccaccatgtgttcagtttaaacatgttattcacattgctagtgagaatgaagagcttaaattgctatcttctttaaatacttggggttatattcaatttgatgatatttgtccactcaactgtctaaagaagaattatttgctagatttgaattgccatgtccttctgatgtgatttttcatattattg

SEQ ID NO: 28798 - DNA, 1286 bp, Oryza sativa
gtttgcacaaatgttgcaacacaataagttttgtgtgttttcgtttgcagaggtacttgcttgggtgaaagaaaagagactgagcgtaaggaatgcatggatgattgaagaaattgattggggaccaaaccaagaccttctccaagtcttctttcatctcaccatgtcacttttagcccatagaagacaagagatcaagttgtacacgttttggattcggattcgggcctcctgatagcatcaacttcaaacggatctagccgctgatctagaaggaatttagaggcccatgagcacttgttggaaagattatgaagtctactttcatatggttttggtcccatgtcaaaattcctaccgagctgccgacaatcagcaaaacaagacacatatctcatctagtccgaatctgattttgagttttgggccttgtaattgtgtcgtgggcttagcccaaggggtgtgcgccctagggcaaccctaggacgtccctaagcacatttattccgcacgggttctcatcgacggaggcaactccattaacctactcttcaccagcaccttggacgcgatggggaccccacgaagtgagttgacgcccactgatcaacccttccacggaattactcctcactcatcgtccaagccactgggcaagattacgctacctgtgacttttggccaagcaaacaacttccgaacggagcagatcacctttgatgtcgctgagtttgacacaacatataatgccatcatcgggaggactgcactcgcgaagttcatggccgcatctcactatgcgtatcaagtgctcaagatgcctgggccgaagagaacaatcactattcaggaaaacgcgaagctggcggtgcagtgcgacaaatggagcctcgacatggtcgagcatgctcccaacccgcccgccatagctgagccacccaagaaagtgaacaaaaccaacaagacgtcgaagccagacagcgcaatcaagatcgttctgctctccagtgccaaccccgataaggctgttaagatcggggcgtcactggatgagaaataggaactcgcgctcatcaccttcctccgcgacaatgcagacgtgtttgcttggcagctgtccgacatgccgggggtccccagggaggtgattgagcacaaactcatggtgcgaccccgatgccaagctagtaaaggaaaaactgcggagattcgcatcagatcggaaatgagccatatgagaagagctcgacaagcttctcaaagctggtttcatccgagaagtcctc

SEQ ID NO: 28799 - DNA, 734 bp, Oryza sativa; identical to SEQ ID NO: 21450

SEQ ID NO: 28800 - DNA, 610 bp, Oryza sativa; identical to SEQ ID NO: 21457

SEQ ID NO: 28801 - DNA, 1513 bp, Oryza sativa
tgcttcggtgcccgcacacttccccatcgccttgactagcggcgaaatagctggctcacgcagagggctcccgaaaaccctcgccacagccgacacaatccgttcggtggaggctgaagccccggcggcattaccgcctgccccagcaacgccgagcggagcgaggggagcagtcgaaaggtctaaactgcggccagcgggcgaagttggagtcccgtcagaagattcgtcgtcgctgaaaacgcgggcgatgtcgacgagtcctttctttttagagatcttctgcaccggacctcccttcgccgccttgcccgaggagaacgcaactagggccttggccccttccaaatccttccgtcgaaggtgggagctgttaaactccaccccggtctcgttgtgaccaggacttggggtaggagtgtagccgagggtgtcgacgcggtcttcgatcgcctcgttcgcggccttatcagccacggcctcctcctcttcctcctctcctaggggcaagcttcacttcctaggggcaagcttcacttgtccgcacattcacattcgcgaaggccctgcatcgtcgtcagctttgtgggggtttgcccgaggaggcaattcgccgttgtaaacccggttcgcccgcccagccgcttgtcgtgttagcaactggctatactcgacgaccgacacgtcgccgatcatcctgcgggcctcgttttcagcctggtcgagggtcaacgctgcaaaagtaaagtgtgtagctatgttaacagttagacaaggcaagataacaaagcacagcagtgtatggcaagagaacagtcttactgtctgtcccttcaggaagaatcaggttcggcaaaccgtcaacctcttcgccttgatcaactgtaacttgccatgactgggagaggggaaagatgcgaagcatacagaattcctccaccaagtcacggcagctaaggcgggagcaaaccttccgcagtagaacgaaccgcgcctccatagcgccgtccacggcgatcttgggtttccagttaggcgcgatcgccctatgccggcaacggagggctttcgccgagtaagtgccagcctcgaaggggatggtgtgatagaaccacctagccatccaatggtggtcccactttgacatggcagcgttcaccggccagagatcggaccactcgggacgaacgttaaagttcatgctcccgaacactgtcttcttcgttctagccggggtaatcaccgtcttcgagttcacggtggcgaaaaatatggcgccgaagagctcggcgttaggctcaaacccggaagtccggcacgcccagtagaagatagcgatccgaacaagcgccaacgggctcagctatggaagttccacctggaagaggcgaaggatctccggcaacaacacgttgcagggaaaccgtagccctgcttcaaaaaagacggcgaataccaccgtccgattgttgataggtttcggcaccacggccttcactggggcgaaagcctg

SEQ ID NO: 28802 - DNA, 846 bp, Oryza sativa
cgagcgatttggagaagttctcgatgaatctccggtagtatcctgccaaacctaagaaactgcgaacttgagtgactgtcttgggttgcttccaatcggtgacggcggtcactgtttcggggtccacagcaactcctttagcagatatcacgtgccctaagaatttgacttcggacaaccagaactcacacttgctaagtttggcatacaattgatgttcccgcaactttcccaataccagacggagatggtgctgatggtcttcctctgattgtgagtatatcagaatgtcatcaatgaaaaccaccacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcgcgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctctttgtcttgtctttcttctccacaaaaatcacaggagcaccccagggggaagtactcggacgtatataccccttttctttcagctcttccaactgtttcttaacttcggccagttcatttgctgccatacggtagggtcgcttgtacagaggagcggttcctggagcaagatctatccggaactcaatctctcgcttaggcggcataccaggtagttcttccggaaacacgtctccgaact

SEQ ID NO: 28803 - DNA, 496 bp, Oryza sativa
  unsure (1)..(496): unsure at all n locations
nnnnnnnnnnnnnnnnnnnnnnnnnnnnnnnnnnnnnnnnnnnnnnnnnnnnnnnnnnnnnnnnnnaatcctgttcttgagcaattcattgacatttatgatggtacgagattagtacaagcattatacttggtttttggtttctacaccatcgttaggggtgcaggacaaatcttagggattttctgggctctgaaaatagtctccttgggtgcatacttacaagctgagttttagtaattcctctcgtatggacctgcaggtttatgtatggagcaagcacaatccctcattcatatgagcttcttgggtttggtcacctttactgctgcttatttaccttgggtaagtatttttagtttcctttccatgtaccacaacatgactacatgactaatgcacacttgattctcatcttaagtaactttctagagccccttcatataatcatttttttcatgcctgaatgttaaatcacacgatttgaaactctgta

SEQ ID NO: 28804 - DNA, 698 bp, Oryza sativa; identical to SEQ ID NO: 21463

SEQ ID NO: 28805 - DNA, 8840 bp, Oryza sativa; identical to SEQ ID NO: 21464
  unsure (1)..(8840): unsure at all n locations

SEQ ID NO: 28806 - DNA, 808 bp, Oryza sativa
ccgggtcggccggtgcgccaacggcgccagctgcgccgccgtcgcatcggcggaagaagccgaccaccgtctcgtagtaccgcagcgtccgctggtcgtcgaggtcggagagctgcttcgtctcccgcggcgtcggcctcgccggccggagcagcaccggctcgctccggcgagatgtgaaggtcaccaccatggcgttggcacactttggtaatgcgaatgcagcgaggttgggcgatgctatctatgttcttcggtggttcatatgtgagcttgcttgatggtggcgcacggatacgtcggttttatatccatctgaaaattaacattggtttaattttctcctgtaagtaacacttggagaatattaaatgctttcaaccattaaccagaatttactctggcagtcgtttctagggctaattatacgatttttatcacttataaaggcacggccccaaaaaagtaatggacattcatgagttacagcatattcatgaaaatgtatattctatctggtcataaatatttactacttaacataagatttagataaaagacccatgtcaagttgaaccgaccaatgtacccttcgccaaaaactacttgtgtactggccatagctgtggagttattgcttgaatccgtatagcacgcccactttaacaaactcttgtccactggatgtaagcgataatgggggccctttggacaaagagatggtctgacgagcaggaactgccagtgaagtgaactaggacatacatgaaagactcagacttggaaccccatccagtcatgcaggagt

SEQ ID NO: 28807 - DNA, 471 bp, Oryza sativa; identical to SEQ ID NO: 21467

SEQ ID NO: 28808 - DNA, 116 bp, Oryza sativa
ttgaaaaacttcagacttgtgcttaaaaaaataaatccatgttaagcgactgaaagcatcaataaaactgacataatattttttttcacccccggcaacaagagcgggaccccaaa

SEQ ID NO: 28809 - DNA, 401 bp, Oryza sativa
ccgggagcacgcgcgctaagcgtcggcagcgatgtcatatgcgtagaaggagcagagcacgttcttggcctcgttgtagccatcagctacgtagacgatgcctcgttgcttcccaacgaaagaagccccgggagtccgggatcactgtgttgtgttgccaccacacgcctccaccttctttcccgtgaaatccatgtgccgccactcgcccatggtgaggttcgtcgcggccagcacgtacgcactccatcaccgccaccggtctcatcgcccccacgcacgggtgtggccaaaacaaggaacacaacgtcctcagcttccctggtcgtcgtcggaacgtctccggctcacatgcgcgccaggcaccttggccatttcgtccgacaacccaggatgagctt

SEQ ID NO: 28810 - DNA, 428 bp, Oryza sativa; identical to SEQ ID NO: 21469

SEQ ID NO: 28811 - DNA, 725 bp, Oryza sativa
ctcgcccagcaggccaacatgatgactgctttcctccaccacgtccaaaatccgccacaacttaatgctccaccaccaccctcacaacactctaaacttgccgagtttctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgtagggacccgcatctctatggtgggaccatttccaggctacgcagccagagggacagcctattacatgggctcgcttcaccgccgctttccgaagaacccatgtgcccgccggagtcgtggcccttaagaaaagggaattccgagagttgaagcaaggcaaccgctccgtgatggagtatttgcacgagttcaacaacctggcccgttacgctccggaggatgtgcgggaagatgaggagaagcaagagaagttcctggcaggaatggaccctgagctgtccgtccgtctagtctccggggattatccggatttccaatgtctggtggacaagagcatccgcttggaagccaggcacaaggaactggagtcgcacaagcaccgcttggcgaatttccgcaaccaacagggtgctaaccaaagggtccgctacaccaatccctatccagggggatcctcctcgcagcagcaacaacagca

SEQ ID NO: 28812 - DNA, 911 bp, Oryza sativa
caccgcgtatcacccgcagacagatgggcagaccgagcgtctaaatcagatcctagaagatatgcttcgcgcatgtgtcctggatttcgggaagacctgggataagagtctcccctatgccgagttctcctacaacaacagctatcaagccagcatacaaatggcaccttatgaagcgttgtatgggcgcaaatgccggacaccgctaatgtgggatcaagttagggaaagccaagtgttcgggactgatatcctgagagaagctgaagctaaagtcagaaccattcgggataatctaaaggtggcacagtcccggcagaaaagttatgcagataaccgtcgccgtgacctggaattcgcagtggacgattttgtatatcttcgggtcacgccattgcgaggtgtacacaggtttcggacaaaagggaagctcacacctcggtatgtgggtcctttccgtatcgttgctcgacgcggagaagtcgcttacaaattggagctgcccgcctccttgggcaacgtgcatcatgtgttccatgtgtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggtccagtggagcaaccacgccgaagaagaagctacctgggagcgcgaagacgagctgaaggcagcccatccagatctcttcgccagttcttccgaatctcggggtcgagattccgtttaaggggggtaggtttgtcgcgtcccaaatcgactctaaaatacatcctcgaaattatgcaaagaataagtcaaatccatgtgaaagcctccaacaatta

SEQ ID NO: 28813 - DNA, 1871 bp, Oryza sativa
cccccccccccccgaaattttttatttttgttttatttgtttgatatttttttcacgcttagggacacacaaaaaacagaatcactatatactgtttaacttatatatgtcatttcatgtgattatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttgtggttggttgtatcgtgatcctgagtgtgaaaaaacatcggaaagaataaaataaaaataacaccgttgcaactccatacagagaaacaggaatagaggcggcggcgccagcatggctggcgccctcctccctggggcggcgccagcatggattgcgccctccttctccctactaaaggagtattggtctaatttttcgataaacagaaagagagaattcttgatcaatctgtaagaaatacaaaacgagagaaaacgggatggacataccagaatcactcacctgggaatatcccaacggtgcaaaagccgcttatgtcgatggaatcacgccgccggctggcttgacatggattcaagccatatatatatatatatatatatatatatatatatatatatacacacacacacacatatatgtatatatgtgtgtacacatatatatatacatacatatacatacatgtacatatacatatatatatatatatatacatacatgtacatatatacatatatatatatatatatatatatacatatatacatatatacatatatacatatatacatatatatataacatattgtcagggttatggataccacatatctaatagtcgtcgtcgccactgccggtttccggtgaggaggttcgtcgctgccgtcaccgccggtggcgtggtttcgtgtgtaatttattttaatctattcttatattttggcggggtttcggttcaactgtttcgcaggttgagtactataacaatttttctttgtttgtcaagaccttaagacgggaatggatcctactaataagttgttggttcatcctcctagtgatccaataactgtacacgtatgtatatatgttgccacaggatgatcgggagaaaatggtctggtcgtgggtagaagaagcaccagttggatgcacgcgctaggagctagtaggctgttattcacattatgtgttcgatcgatcgagacaggattagttttttgaactgatgttcttagacagtgtattaactttaaaactaatttgaatacaataattctagagtatataaaaagcttgtgtcggataccttgatcgcatctatatgatcacagatttttctagaataagaaaccagctagttttaaacatttgtgttaatcacttatcactgattactgaaaaataattttaaatgtgaagcactaatattaagtcgaatagactcagtcagacaggtttcaccacactcaattcgcaaaatatccaatcatgctttcaaattttagcggaagtttccaagttccatatgcttcaattgcatcggaattaggtatatttgtctggatttttcacattttgattcttttgaaaaacttatttcgcaaatagacccttgaaaaaacttatcccagaaatggtcctttttgggcaccagagtggctggcgccgtcatccaacgggacggcgccagcctctctggcgccgtcctcctgccaccgtggcgtacgcgaaccgacgtggcaggaggagggcgccagccatgctggcgccgcccca

SEQ ID NO: 28814 - DNA, 4116 bp, Oryza sativa
ctggcgccgtcctattgaagacggcaggccagccactctggcgcctcaaaaaggaccatttttgggataagtttttctagagatctacttgcgaaataagtttttcaaaaggacaaaaatgtgaaaaatccagtaagccagcatgcaggtcaccagcggcgtcgtgatccatcggcaacttgatcggcatcgatggcgcgcggcgattagatctatgtccacagccacgttgcagcgactcgatcggtgtccacggcgcaggcgctcagccgatcggcaaagccgaaggtgacgaccaatccattggctcgctgaaatcatatggtaaaggcaaaaagcggcgctggagacatcacagcactgcttacagcatcgacaacagcatcgtccaccgtacatcaatagcatcgttctgggggtaggtactcccgttttgattttcttttctggaaaaataattcccaaaattcttaaatccatgcaaatcgatcggaagctacaaccaacatctcgcataaatctggtggtgaccaatttacccagccattcggtatttacaggttgggtgcgtctgccccgtcagcggcggcgagccgtcgaaccctcttctcaagcggctgacaccaccagcaagaggacgctgcaccttgagcatgtagctatccaggggcctgaagcgttcggggtttatacgcgagcggagcgccggcagatccaaccatgcacatgtttatacccaaatttgacacctatgattaaaataggaaagattgccaaaatttagaagtctaccggtttcctccgagtgggccggtctgactgccgtgtgttgggcggtcagaccgccggttgagggccagtcagaccggcggagtgtggccagtctgaccggcaggtccgagtccgactgtgtttcgtcaggtttcgaggtttccttgctcaggaaggcatgttttgggtttcctttagtttctaccccgagttggacgtggaggagggcctgtagaggacaagaccaacccctatataagggacatggccgattcattgtaaaaaaccaatctacaataaatcaatcgaatcgtttttcatattgcttttagttttctcttagtttatccatctttgtcggtttgcgtcgtaaaccgtccgccgccgctgccagagtgcgacatctctttgtaggtttgtcctgaaaaccttccgttttgcccacgagacgggtagttatctagaaatcggctccgctagccggtttagttattaaaacccatctagatttagctctttgctagatcgaggtggttggcgactctaggatcaccgcaagacttaaggtgctgcgatcgtgcttgttaacttgtcaaaaaagttgccaacatgatttttggcgactccgctggggaagagatccgttcatcgtcaactcaacttcgatttcgccatgatgaagccgccatccaagacggaggtggagccatccaatatgataccggtcacattggatgatttcgtaggagaagaccgcaaagctatggaggagtacatcaatgaactcacacgggagacgttgatgagggcaagcaccaggactcgtcaaggtgtgatcatcaagcccgggccacgtcctaagctcgcccccgatttggtaagcaatgatgaggtaacacaatctatccaacaacaagtagcatctacaatagattcatctatgattgcttttaaagataagttagatgcaacttttatattgcgtttgttttctttatctttgtccggtaatgcttttacattgtttacttctttaccggcaaattctattcatacttgggctcaattagaagaaaaatttcatgattatttctatactagagaaactgagcttaggttatgtgatttaacatcggttaagtaaaaatataatgaacctgtcattgattatattaagagatttagggatgttagaaaccgatgttatagcttgtcacgaccggaaataacccaacgggcgttccttacatgcgtgtattattccttgtcccaggaggcaaggtacaccaaaagttgatacaatacagagtttaacaagcggaagcgtaaatagttaatttattacatgggcggcgagggcccagcacacatgaagataaacgaaaaacaatggaagactagggcgacgaccacaggcgcttgacggcaggcacgagctagacaccaaagccttcatcatccaggaactcctcttctgggattgggaaaaattgagcaagactgagtacaaccaccgtactcaacaagacacacccacgagtgcaaaataaatgcaaaggagtacaagggagttataatataggggtggttagggtttgcagtgaacagcattaaaagacacttagttgctcaaagctatttcgtaattacgatcctagagctatacaatattattaatacaaggccatgaacccacacgaacctgccttaacccaaggcctacgatgatttggaccgaactggcaacctgaccctgggtcctagctcgtaccaaagccaacccaggccaaccatttacaaaaattagttgttaagcgggttttaagaattaaaacactaacttgggtacattgctaggcatgcccataaccgagggcgcggctattcgaataggttatactctgatcagaggtgtacatctttacccacaagacacatcttcttcacgtgtaaccatgtgccacataccaccacggtatacggacggaagacgtgacatagtttccaacccatcctagccatagacaagagtaccgacccaaccccacctacggccggaacctccaggacaggtaggcaggactgagcccatagcagtaggacaccagccctgtgccatgacatctcgactaccgggccgcagctcgtgtagccttcatttgccctagagatgtccatcgacccccgacttcgtccatctccatccgtatacttttgtttataaccagactgagccacaaactaagccttacccactagacatgtggaagtacggtagtgctttgcaacagaggcacgagcttaatccttatagtacccaaggtacgacaaacaaaacccaaccacgcacctcgagcccagcctaaaaccattttgggggttttgaatagagggggaggtatgtgtccaattccaccataatccaaccattccatagtgtctaagtgatatgagaattcccaaagtctaaagttataaaaccacctaatgttgcctaattaaccagcgaagcatctacctaagttcatactagtggaaccataaatagagtacccactagttggggttttattttcctagggtgaacaaggtaataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgcttttccaaacgtcggcttcaacctccacgtagagcggatcttccgaagctacagcgtctacacgaccaaagaaaaggaaaaagtattttactctaataaactccatataacaagcaggaacaaagtacaaaaatgggttcttgacttcttgaggaaaaattagagacttgaacggtccaattccgagttcaaatggccaagttatggccatttgaagtttatatgctctttaagtgaatatttgcgaatttcttcatttaaattttaatttaaaaaggatttattgcgtcagccgaggggagagcgcgcgcggaccgggtccacgggggtggggcccacgcggcagcctcacggtccacggtggactgggtgcacccgggctcacaccggccggagccgtgggccccacgcgtcagcctcactcgagggcacgggcggctgacggccgggccccacgcggcggccactcggcgcgcccgaaggcggccacgacggcgcggtcggcggcaggcggcacccgcgcccctatggtcgccggcagcggccataggcacggcggagcagcggtcgagagaggggaagggaaggggggctgca

SEQ ID NO: 28815 - DNA, 4894 bp, Oryza sativa
ggtgggccccagctcgtcagcgagggggcgggcgggcccgcccgtcagcggcgcgcgcggggggagaggccgagtgggccgcggggagaggagagagacggggaggggactctttagggttattctttttataaagcctttttaactttgtttatttcttcttaattattatttgtgctctgaaaattccactaaaatttatttacacattttaggcttttaggaattatacaaaaatactctaagccttatttgacttttactttgcacattttaattttttttgaggctttcacgaggattttaattattctaggcataattttaaaggatatattttagggtcgctttgggacgtgacatagcttgaatataactgacagagatttggctggtcttgcttttaatagtttaattgctccttttagagaaaaactagatggccaacaatttcttgatgttagtcaacttatgcaaagggctctcgcttgtcgcgtcccaaatcgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaagtggttttataaaaagaaaaatccctaaaagtccttttcccccccgcttcctctcttgggccggctcggcccagctccctccctctctctcctctcccctgcggcccatcggccttcccccgcgcgcgcgtcgctgacgggcgggcccgcccgccaccctcgctgatgggtggggcccacccgtcatcccctacctcgcgccgcgcccgccgcctcgcccgtgccctagcgccgccgccgccgcggattccgccgcatcccgccgcccccgcgcacaataaagaggggaaaatcactccccgtgattccctccctctttccccccacttttccctctctctctctctcggattcgtttggaaatcctcccgcaaacttcgccggcgtcattgatggagccgagatcgccgcgccggtttccttcccctccggccgccctctctcactcccaacactatttaagcactccccgtgcctccctcctccgtttccgacccttgccgctttctctacccgtcggaatcgagctcgcgccgtcgtcctctctctccgccgtcgccgccgagcttcggttcgccgccgtcgtcgccccggacctcctcccacttcggcatcgcctccttcggcttcgccgcgtcctcgtcgacctcgtccaccccttcgtttcgcccgccgaccgccggaacgccgccgtcctcgtcgacccgagccgcgccgccgcctctctccgcttcggtcgccgttcccgtcgtcgccgtcgacccggggtgagccgaggaccgccatctcgcttcccccttccctcccctctctcgggcgccgctccgtcgcgccggaggtcgccgccggcgaccatcggggcgcgggcgcgccgcctcccgtcggccgtgccggcgaggccgccttcgggcgcgccccgcggctgccatgtggggcccggccgtcagccgcccgcgccctcgagtgcggctgacgtgtgggacccacggcgccggccggcgcaagccgcgtgcacccggtccaccgtggaccgtgaggctgccgtgtgggccccactcccgtggacccggtccgcgcgcccctcccctcggctgacgcaataaattcgatttaaaattaaaatttaaatgaagaaattcgcaaatatccatttaaagagcatataaacttcaaatggccatatcttggccatttgaactcggaattggaccgttcaagtatctaatttttccttaagaagtcaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatacctatttacctttgttatgaccttattattgttattgttattatttctttgttcaccctagattaaacaaaaccccaactagtggacactctactcatggtaccactagtatgattataggtagatgcttcgcttttaattaggtaacattaggcggttttacaactctagactttgggaatgttcatatcacctggacactgtggaattgttggagtattgtggaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaaatgctgtttactgcaaccctaaaccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttcgaaataaaaatcctttgtatttgtgaaaatcctctagtctctctctgtcttgctgcttcatttatcgccaaaatctgacctttaaaatgttgcttttctttttgtttttgtttgtagatggccggcagcgtcacccgtcgtggtttggacatgactggtttcgtcttggagctgcggggcatgtgcgtggccgtggggtatccacacggagtggactaccaggccaggccgcttctggagcaggagggtgacgatgcagagccccacgctgcttgggaggtcactgcagtgatcctcgctggctctcccgagcggacttcgctgacagtcaccgcgggtggagactccttccccgccgcttgccagagcgccgctctcctcgccatcggcactcttcaccagcgctacccggacgagttgcagcactcgccctaccgctaccaccctcgtcgcggaggagcccgcgaccacgccaccttccgggatgctagctcggaggatgacgctaccatcgtgcacttggcgcgcatggtggaggcgtacgacgcggctcgtatcgacttccatcagatggtgcgccgtgggatggtcgagaacaacctgaagatcctggagctgcgtcaagagaacctgcagctcaagaaggacctggacgcagtggaggcgcagctgcatcagctcaagatcgcccagggagagatctgccgccccaagcgtcgccgcgtctgccgcagcctgaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacagaggatgcgctgttgcttaccttccgtcctggcccgtcgcagcagtagacgagcagtagtaggcttgcgcgtgtgttctttctcgtttgtcttcttgttgggttgtgtggggcacggttatgccggtgtgtggtgtaactgtgtcggagcctgtctttattttattcgcctaagcaacttgaactttaatgaacccatttaatagcagtaataaatttaagaattatggtagtcgtgggtggttagctttaattgtcagctctctctgtttgctggttctgtgtggggttttcagatggtgatgaccaggagaa

SEQ ID NO: 28816 - DNA, 2110 bp, Oryza sativa
  unsure (1)..(2110): unsure at all n locations
tcatccacaagatatgtcatggggttcttatccaatggccaccgccgggttatccttatccttattacatgccctccaatgcaattcaaccaagggtggggaggaccgaggaggccaattcatgagcgtttattttcaccgaacaacggccggttatatggtaagaatcgggctaatgaagaaaagagggaaagaaagcgcatcaaggtggaggtaaggacttcggaagtaattaccatcaaagtggggtctcatgatgtgtcaataccttctggagatgaagttggagagtcttcaaggaaaaaatccgaggccggtaccagctcatcgcagtcggatggtctgaccaggccttctggccggtctgaccgcagccatacagccggtctgatcgggccatcaggccggtctgaccgccgacccgacagcggtccgaccgacacctcaggctggtctgaccgtgcgccaaatgtcggtctgaccggcgcatctggccggtctgaccggtggtctacgtccggtctgacccggctccagcgccggtttgataggaggtttgcaaagggcgatgtgagggcttcatcgtcttcaaacaaggttaatagagggcattatttacctcctggaacagagccggatcctaggtggatgcctaaggatttgacggctactcaaaagagaaggttgcaacgtcttcgggctcaagagataagagagaaaaaagccgaagagcaaagagataaaaggttcaatgagttgcgaccaccaccggtatggaggcataagtccatagagaaggaaaaaccggttgttgtagaggagaaggaggaacaatcggttgataaaggtgaatcatctccaaaagaagacatgaatatgaacatggtatgtatgttgcctatgcagttttgtgctatggatgaagccgaggttgctcaattctcattaggtcctaaagacacggtttttgagaagcccgatgagtcaaaccgtcacatgaaccctctctatctcaaaggccatgttgatgggaagccgatctctaggatactagtggatggaggtgccgcggtgaacttgatgccgtactcattattcaagaagttggggcgtgaggatgatgagttgaagaagaccaacatgattctcaatggtttcaatggtgaaccaacggaggcaaagggtatcttttcggcagagctcaccgtgggaaacaagacgctaccaaccgctttcttcatcgtcgatgtgcaaggtaactacaatgttattttgggtcgttgttggattcatgccaattgttgtgtgccttctaccttgcatcaatgtttaattcaatgggacggcgatgatgttgaaattattcaagcggatacatcggccgaggttgcaatggccgatgctacttttgagtggcgccatgggaatatccaatgcttatcggggagggatctttctagctacgattttattagtatctccgatggcaaatttgtatctatctctgtaaagccggctagtatagcacgactaagccatataaatttgtataatgagtaaggaggctaatttagaatggttacaaaagagggtgcaagaatatcagtctacaaagaacgatattggtgaaatcgttgaaggttttgatgaagtggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28817 - DNA, 7762 bp, Oryza sativa
  unsure (1)..(7762): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggccgtcttagttatatcatgtttattcggagacgactcccggtcgatcgagcgcccgatcaggagggggtaaaatcaggcgcgacgtcagcgctcgattcatgtgcaaaactactttaaactgatttttctcttaaattacttatacaaatcatgatccgattgcaccattaaattcattgtaattaaatcttcaaaacaagaccatacatggatatattccgatgaaaaaaaatttagcttattatataattatttttaaatgttgcacgatgttccaccaggtatatcgaaattgtttcactaaggtggtgtttggttggagggactaaagtggggctaaactttagtccctctcacagaaacataagtccctaccatagggacttgtacttttgtgagagggactaaatttagtctctaattcccaaacaccccctaagtagattgaaaatgtttcactcatttaaatcgggtgttgtttcacttatataaaaacaatgtttcagcaaatagcgaaagaatgtttcagttcactgcaacattagatctatacatagtgaaacattgtgtgtacactaggtgaaacatttttcggtggatcaaaaaataaaccaaattcccttaataaggggtttccaaaatatgtgggttttttgttgcaatggaatgtttcgttcactgtaacattagatctatacatagtgaaacattgtgagtacactaggtgaaatatttttggtggaacaaaaaataaaccaaatttccttaatagagagttttcaaaatatgtgggttttttttgttgcaaaagagtattttaattcactgcaacattatatctataaatagtaaaacattgtaagtatactaggtgaaacatcttttatgaaaaaaaggagagagagaagtaggtgggcccaacagtacgcacgtggagggaggggcatgtaggggagctagcgcccgatccgcctccccccgcgccgggcgaccaaggtaaagtacttttgcgtttattcgtacgtgtaacatgaatatgcctactgaccatcagctattatatgtttgttaagacggtcagcaagcttataattacctataattatacattaaaatacggttgtactccttcagctactataggtaattacgtagtactcctttcgtattctaatatataacgccgttgatttttatcaacgtttgcccatacgaattataggtaattaagacccacacactattatgtccaccatataggcttctctttggaagagtacactgcaggccataaaaataaatttttaatttttacatttttattaaaatattttaaaattatatattttatttcgaaaatttataaacctagacgcctcacgcgtgctcactacgcgttctaggagtacgttttttaaaaatcaacaaacattaggggacctaaatatttcaataaaaaaaaagtaaaaataaaaaacacccgcaggagcagcatcgatgccggtgcggcaagagttgcagtcgtcgccgcaattgtatggatggtgaacgcgtaggttgtgggaagattaatggccgagctagcttgtcccgcgggtataatcattgaggctcactcagcttgctacattagctaaagtcatgcataatactgtttaggatctcggatgattcggttatataaattgaaaaacccgttatatctgatattttagttcaaggaagaatttgagacttggtctcctctcccctactacactagactcaaggaagaataacgaaaggagattccagcgaggaatacggagccgcatgagacgagagtctctcaaattaaggaacctaaagttaacttattactaccatcaacagtttgggtttcgctgcagcagatatacatgccggcccataaggctaagtaattcggatagtatttgggctgttttcgcaggcagatcaaattgtccccaacttcgtctcttctcgttcaagttcgctgtgcctgattaagcaaacaattgagcactaatggcagacacactcgaaattcatttttcttttctaaaaatgacaacgttttagagacctttaattcttcttggcctagcaattaaaagatgcagaaattatgttaatagtcagccatatttcaaggcccacccatgcatggatcatatagtaattaagctaaaggggtacgtatagcacatactacaaattagaagatgcacacaaaattatgtatacatgttcgagtacagatatatatccatggacgattattatcttattatttccacgtaacaagtatatattacacatgcatgcatacgtcacggacatatatatcaatatctatagcagccagctaatgcgtgcacgcatgctgcaatattagccatagatcatccatgaccatgatcaagttaatttaattaggtgagaagatctatgggcagaagacgacttggtagttgctgtttcccctgcacgcgtgcgtcttgctgttgtcgctggggaacaggtaagcgtcggggcatctgctgtccctgcaggtcagccccacgccggagctgcaggagaagctcatggcgacgttgtacccgtcgatcaccgacaggtcgtagaagtcctggctgccgccgagggtgaactccgccagcgtcatcggcggccgcccggagaggctgcacgacagcgcgccgccgcagtcgccggtggcgcagccgcccctgccggcgccgtcgaagttgcagcctgtccggccccacaccctgccggagctggtcccggcgggcacgttgatggtccacgtctgccccgggctcagctgcgtgccgccgcccaccggcgtcgccgccggccacaccgtgaacgagcaccggttggtgatggtgaaggtcgccgcgttggcgccgccggcggcgagggtcgccaccaggaccacgacgacgagcactgcgggagaggcggccggagctgacgccattgttgaatatatcgatctctcgaagtcgtagctagctagcttaaactgcctcttaggatatatcgatcgatgtgtgtggattgactaggaaggggcatgcgtatttatagataagatgcaaaatggcacatgccatgctgctgaaaaagtctagattatttcttaataactgttgagaaatctagatgaagagagaatatactggaacttcatacatgaatagcattgcagcagtaactaatattatttttacatttgaaagagttgctatacggattcagtaagctagatgcacacaactaaattgaataatgtactattatttagctcagcttcccctgaataatcagattgggtgcatgaaagacaaatataactaaaaattaatataagatatcctttatttcaagtaaaatcaacatttgaaaatttcaactagtaattgaactaaaagtactttagtatatttagtatatcatgcacatgtgattattagatttctatatatttgaaagtatttttatatgatattgattttatagtcatttataatatattataaaacaaattaatgtttaaagtatatgtaaaataatacttatcttattttaggatgaagggaatatactttatatgcacgagtgtttgaccttgaaaagtacgtatacacataatattgaccaagtttcagaaatataatgcaaatgttctgatgaccaaaaagatcagtagaacagatttgaccgagttatgttttcgtttggtgtgcccaactacatatatttttaatgtgctgcagaaatataatgcaatataactaggaaggaagcccgcgcagatgcgcgggcatcttatttattgttttatgatttatgaaataatgctaaaagatgtcatgtctcatcttttttatgctgtaagataaactgattttaatatacttagtaaatgataagaatgtctccaagattaaaagaaaatcagtctgtcccgattacttataaattctcctatcgtcaccagaacttattattactattttaaaagttgtgtatctataaatagataaaactggatatgtaccaataaaataagcctaatacatcattgatacactaaaatatctacttatctaagtgttcatgtttcacttattccgaatccatatataaatattttaaaaataccacttataccaattaatgaaataacaccgttaaagataaacatgaatgccctctaacgggtgaagccgatcatagccaccaagactttttttctctgttgagttgaaagatgagtccctcgtcgattttagtctaatttactatcacaacctcatggagaattgtattcgtatattggggtcacctcaactcagccattttagtgggaggtatgctcaaaggagagtgttgtagcatttgcatttttggcagttaagtttgataccctactatacttatgacattgtagcaaactctattgttaatgcttgataccctttagaaaaggacacataaagtgaaggtgatcaaaataatagttgtttttaagctttgaatagatgtgtggcacacgatagacacaattttatggtgttaatcatcactaaaattttcatagtatacatagagtactctattttgaaaaaaaaatgatgaggttcattattcgatgctactatactaaaaaaaggtataccaccacaacaatctctatatcaccatattattggttatattgataaatatctatagtttagcacctgatttattttcaataactattaagaatgtatttattttttcaaaattctttacaataactaataatttgtgggagtatacttatagtcacgtggtgggggtgtttgacatacatacatcaattatacctaacatgttgaaattccttggaaatatatcatgtgtagttcactgcgcatgacacttgattgttcatttgttgttaaaactatttggtaaaggaaaaaacatacatatatgactgatttatgatggatgaaggggttatattatagcaaagatcattggtaggaaatatttttatttttatcacatctatgtatcgtatgttgatcatcacttaaataccaatcaagcggttctaaaaaattgaaaataaaatttttgataaattaatccaaaaattaaaattaaatcggatttacttaaaaaaatagactaaattgttttttttatcattttttacatttgtagatttaaattggtgttgtatatttatcaagtgatattagaaatcctaaaatataatgtgaaactatttaaaaattaccacaacattaataattatatgttggtcccatgtgtcatgatgtatttaggaccataatataccttttataagacataaatatttcatttaattaaagcatgaaactaatcacaaattgaatataaatataaattaaaaagatgaatgtttaaagacattgatttgatatttatattatagatctagttctatttgcttatatttgtgaagtaatatattttattttatattatagaaacatctgttttaaaaaccgttgatacttttcccattggtactacgtacgtttttttttgcctttatcttttttatcccaagtacgtgcgtatatttttcttagtaagctctaacttttttttgaatcatacttacactacttatcttttttgcaacagttaagtatgtacatgtagatttgatctaatgtcctaagataacaggcctaccaatttaaataaaaattaatgatgagattagacaaagtcacatggtggcctacaagagttggtagaaatggcacataagatataatatgacatagtagtaaaaatatagctaatatagctctggaattggtgatttaattaaaaaaatctgcagctgctaaagtgtatgcgtagatcgtatataaaaataattgtttatttacaacaccagatcacttctattgtaaattcctagcgtttgcgcattcacactcagattactctctatgaaaaactgtgataataaattatgatgtacatgtatcatgtaatttggaaaaaagaaaaaaaaaggagaattaggatctggatggcatctatcgagctcgccgaggcagatcagtctccatgaaaatgataacaaatgcacatgtattgtgtaattagaaaaaaagaagagagggagaatccagagttggatggcatcgagctaacagaagcataagtacgtacgtatgtacttgtgggttcggagagaaagggtgagaagagatttagttttgatctaacggttaatattattgggtccaccattttaaatgaaaacttacggtcagatatttttctttttctcagaattttatttaaattattagagggccatgtggcgacttaggagcgatgtggcgacttaggagcgtttataggagtctcacgtggtggcttgagagcgtttgtggaagtttaatggacttttagtatataacaataatagaatagaatagatagatagatgagagaacaattagacagaaatttattacagctagttgttttagtgaaaatttggtttttatctaatttattagaacgtcacgtggcgttataggaacatttatatatgcgtcgcatggtatttagtgatgtttataggaaatttgatgtactttttactgtataatagatatataatagatagattggatgtcgtggatataatttagtgacacctgtttgtagaattatttaaagtaaaataatatatgctgttaacttttttatagttaaaaagtatttccttgttatatttggttgccatataaagcatatggcgcatagaatagcatagatcttaaattacttatttagttaaaaataaaataacaataaaaaataagatatgtggcttaaattggagattaggaaaggaaaaaagagatgaggggagaaggagttacgtacgtgatgaggggagaagtagttacgtacgtacgtagcaacaggaggggagatcggtatatgtggagaggggaattttgtttttttattagatctaattgctgataatattggacccaccaatttaaagtaaaatcaacgattagattttgtagtgccacttggcggtttaggagcgattgtaggagcgacacatggcggcttagaagcgtttgtaggaagttttatggacttttagtatataataatagatagatgttgaaatcaaacttttataactttgactatcgataactttaaaaatatttagtttgacaacacatataaatttatcttaccaagtattataataaaagtaaaaatatatttatttattatatatattaaaataaataaatatagtcaaaaatataatttagagtaaaaaaacattaagaattatagacccgtcgggagtatgcatatttctatgacgaacaaaatagtctttaatttcgacctgtccgcgtctatcgatcttaattttgaagtcttgtgccataagttgccgcaggatgtgatcggtcggtcgtcggaggaggaacttgagatcaattgatctagaattctagctacacttttctaatggaaagaataaaatggtccatatatatgtgctacagat

SEQ ID NO: 28818 - DNA, 3068 bp, Oryza sativa
tatggagtttaaaagacatatacaatatttagcagtttggaaaacgtatacatatagaaaacaaaggagtgaaagttggaaaaggagagaaaacacacccttaagaatttaggataatgtatccatcgatcttaatatatttctccactgacacacgtaagtttaaattcaagccaagttgaaaaatatattaacaaacctttatttctacttgtacatgtcaaactaaatttaattttatatgttctctggagtgatatatcacacgttaatgtatgtatttaaaagaaatctcacaaatatttaaatagcacacataaaatgagaagacgtccctcttggggtagaatgacttttgtcctgggcatactattcttcgcgaggagaccttctagctggtcattgtgcacatgcatatcattgtcatctgctgcctctctgtctttatttaattatttgtacaagtagtagagatctagaccttctaattaagctggtcatcgtgcatgcatggggtcatctatcttctgtctctatctttaattggttgtaagtaagtactatatttttcttagataaaaatggctttacattatttccggtctctatcatgggcacacacccgacaggtctcaaaagtaaaaaaagaaagaaattaaaaaacaacgtgataggacaaacccccaacttctgctggatcaactgaaatattagctatcacgtgtccaattttccccaaaatattgcgttgcaatttgctgcaaaattaagctgatcactgacgatgattgaaagatcagagatcgctaacaaatggaacgatgaaattggatgcttcctctataagtagcaatcgaacttgtgaaccgaggatagatccatgctaggaattgtaatataaaaaagacaagaatttgtcttttttttttcaatcggtaggtcaaatttaaaagttgatttttggtgaagtgctagatatcactttactttacattgtcaattattttaaaagtttttaataactgtttgcatttaattaatgaaagaggaaggtataaagggaatatcccatcgagaaattagaattcattccctcctcatcggaaagaaatattatcttctaggaagcagagaaaattagatctgtatatacaataagtctataaacctagctagtgcgcacaaggaagaagttatatatgtacaaagtagagaaagcagtgcatgagaaagaatttccgtagaattagtgcgcctggcctaacgactgcgacaccattatacatatcgtctagtacgtccaataatatatgtatactaatatgatactgatccatctgtttctaaatattttataccgttgacttttatgaaatatgtaaaactttatgtatacatataagtatatttaacaatgaattaaatgataggaaagaattaataattacttaatttttttgaataagataaacggtcaaacatatttaggaaaatcaacggcgtcaaacatttaaaaaaacggagggagtatgatctggccggctagacgatctcatatctctatatatgcatgtagaagtcaagtttagctccattatttctcggtccataaatatctcatacggagtatctatcttttgcttaacgtgctagacacggccggccacaaactaattaacgtgcttaccggccgtcttaattatatatcatgtgtaaacatatgacatcctgttcgatcgatctaattacctactatatattaggctgtaattaatattagtcttaacttggggaagttaattatattctcaagttaattaaaacacctgcatgcatatataaagggcctacttcaaatatgaactaacaaaattggaaaatctcaggggttttctccgatcaatttgagaagcaactagtagtagccagttggtgagaatataaaaagaaaactgagttttgtagcttttggttatttcttaataattttctgtattctatatatagctatatattcttagaatctaggtgggaatcaatctggattgttcaacgtaattagtgattttagaagaagttgcggctactaaaagttaacttctataaacatgaccttaatatacaactctatctatttaaaagaatagctatttttaactttgaatataaacaagaaatagctttacattcttgtacatagggagtactatacagcaaaaagcaccgctcacaaataatctcctcactggtttgttcgccatataggcttctcttcagaaagcctatataacatgataaaggcccatcaatccggacaaggcccaagctagggattttcataggcattttcatatgacatcatcagtttgcaaaaacgtactacgtactactgagcgtttgtatgcgtgtacgtacgtataattaaacgcgcgcgacagctagggacgtggaaaatcgctgtggaaacctgctacacacgcaactcaagtactgcatcactctctctgctgctataagctaagctagctagtgtctatccattagtattgtggtgttgctaagaataatccaacacctataagagattgtgtagtgaagtagtactgtaagttagctttgctaagctatcccaatatatatacttcctccgttttaaaatgtatgacaccattgaatttcacataacgtttggcggtgagcaccataaaatattaaacttcaagtgatttatgggatggttttacaattttccatttattaatagattacatatgcaatcatgcatatatataatcaggggttgtctatatatcttgtgacagaaaatcgcacctcctatcattcgaattttcgaccattggatatactctaacatacgtgcaagcacttaatcgtacctcttcttctcccgttcccctcgctgcctcgaggattccgtcctcgattcaccgccgccaccgccccaccgcactatcgctcgatccatcgacgcaactgtcccaccgcactgctgcccgcctcgccagctggccagaaggagtcaatggtgcctgcgagcccccccctcc

SEQ ID NO: 28819 - DNA, 16534 bp, Oryza sativa
ttgaaggagagaagccgatgcatgaatcttggcataggtccaatggtctaaaaatctgtaagattccattcccaaattttattcgaatgacatatagcaattctggatcacgttcgttttattgtatgttcttattattttccctgatacagtttagtagaagtatatatatagtagtaggttcatatgcatgaaatcatgggcagaagacgactcggtagttgctgttgccgttgcaggagcgcagcttggaatcgtcggaggggtactggtacgcgtccgggcagctcctctccctgcacgtcagcgtcacgccggagctgcaggagaagctcatggcgacgttgtacccgtcgatcaccgacaggttgtagaagtcccggttgccgccggacgtccccagcgtgaactccgccagcgtcagcggcggctgcccggacagcctgcacgacagcgcgccgccgcagtcgccggtggcgcacctgccgcggccggcgccgtcgaagctgcacccggtccggccccacaccctgccggagctggtcccggcgggcacgttgatggtccacgtctgccccgggttcagctgcgtgccgccgcccaccggcgtcgccgccggccacaccgtgaacgagcaacggttggtgatggtgaaggtcgccgcgttggcgccgccggcggcgaggctcgccaccaggaccacgacgaggagcactgcggaagaggcggccggagctgacgccattgttgcttgctttcttctaatctttgtgttaatttgtatagcttgttaattaagagagctaggaatcgatcatgcgtatttatagatgggcatggtgttgaaaaatctacgattttgtctgaatattgtactgtgttgcaaaatctagatgtggagagaaacttcaaacaagcacgactgatcgagtcgccgatcgatctatttattttatttttgcacaagaaagatgaactacatctccagcacacgtactagctaccattattgccataattaaatctcattggctgagattttgccatgcaatatgcttggatatccaatattgttgaatcatacaaacacgtacaactcaagtcatcagttatatgtttgctgaattttcagatcgatcgggtgcttgaaagatgaaagtcaatgcttatatgcgtgattctcgccggcagaactactgatgtgagggttaaaaatattgaatagctctacaaatgctgtagagaaatcaattttatcaggcctgcagttgattgatgaataattctaaatgcatgcatgtaatatatttatcatttatttgatttaattagctcctgcatctgctatatattggactctacaacttagtaaaagttatgtggctttttacaaaatcgcatctaaatttcatgagctttttagagcaaaatatttgctccggttttacgtataaccacaaaggtacgatgaagacaacaaattcatgcatactgcatgccgtaacctagagttatggttatacagactttcgctaactatgaatgaatatttacaaatatatagacttcaataattgttgggtttatatcttgtgttggtggtactttagtcatgcgtgcatcgttgtttctgttttgttctctgaggatagtttgtgccctttgttgagcgaattttttaaattaaaaattggctgtagctactttttagcaaaggccgggatttattccattattaaaaaaacttaattagttttgttatttgtcagtatatatattgttggtcaccacacatattatttttctttttttagtcaataacctatacgtaccttggaacaactcaagtagcacgtacttctgcatgcgaagagatagtagtaagctactagtacgtacaagcgtacaacaaaaatatgagttaaccttatttaattagctttgacgctgattattattttttcttttatattgtcagggacccaaaagttaatttttattttaagttaaatcacttatttttcacattgattaagatcaattaataattaaccatgcatgtataagccgtacattctgagctagcagctagttgtaactaaaaaaaatatgtacgagaaagaatttattttactgtagaaattagagaaggttggtcaatagtgtatatatggcggcgttgtgcatgagaaaatttcaattctgtagaatatatttatgggctcggcctaacagctggcagattatttttttccaacacgcaaaagattttatgtgttatatattaacatctagctgactgagaacggcaccatctctaatgcatatcgtcaagtacaataatgtgtatgcgatcgatcgatatgatctctcatctttatgcatacatgtgttgacgtcaaatatttttagttccagcaatatgatctgtccatattgtatatggttttgtttggatgatgtaggggatcggttgatatgagaatacaaacaggtaatagctctatctccattgaccggagtcaaggtagccattatatatcaatatctaacaagtacaatagtgaggaaaacttaatctagtctactaggctatcagtgttgtttacacccaaatttaacacctaggatcgaaataggaaaaattgccaaagtttgaagttatgccggtttcctccagagtgggctggttagaccgccggttgagggccggtcagaccggcggtgtgtggccggtcagaccggcagagtctgagtccgggtctgtttttgttggacctcgagttttcttactcgggaagacatgtttcgggtttcctttagattctatcccgagttggacgtagaggagggcctgtagagggcaagaccaacccctatataagggggtaaggccggctcattgtaacaactaatctacaatcaatcaatcgaatcgttattttacttttgcttctaattctagtttagtttatccatctttgtcgatttgcgccttaaatcgtctgccgccgctacgagagtgcgacacctttttgtaggtttgtcctaaaaaccttctgttttgcccacgagacgggtagttatttagaatcggctccgctagccggtttagttaccaaaacccatcttggtttagcttttgctagatttaggtggttggcaactctaggatcactgcaaggcgtttaggtgctgcgatcatgcttatcaacttgtcacaaaaagttgctaacaagtgtaaagctcgagcatatggtcgaaggatagctattgtctgcttcctcgagaagtaactcagcgagaatgaaggtagctctaggttccttttgacttctagcgggcttgggttgtcttgtcccctcttcttctacaagatcttgtatgtatacctctttgccctttgtccaagtatatattaactagggatgcgtcgtcgaacttagtacaatgtataaggtaacccatatatatttataactctaacatagacacacatatataattagtaatatatattggttcctacaggtgggtggattgaggataaactattggttcctacaggtttcgcacacacgaaaggagcacttacaatgttgggatggctagaactagccatccaatggtattaagataggagaacccaaatattttttttcaacccttcatttaatctaggtgaaatataagcaggttgagaggtcgaaactgggtctgctgggtgaaagcaatcaacccataccaaccgagttaggcacggttctcaaaggagcgcttactgtgagagaggtagggaagaaggacgattgtgcttttaagtactagagaaattcctccattctaaatagtgtttaattacaaattgtctgtcatccctgtctgaatttggggaagctggattcaaattcatacgtgtgaatatacctaggacctagttcaaatttgaaataaaacgcttcactgatgagaacatgattaatttgcaagagggaaatacagtacatacgcgtatatggatctgcaaaattagatagaaatgaaaagcccagcccacaaaggaagcgagatcacaatttctgggccgtcccagaaaggcaagtgtatcggccgataaacgaggcccatcaatcaatctgaccaattcagtcaagtcccaattcccaaataaattttcattcgacagtgtgatacgtataggagtatagaagatcgaatacatgaccgtatatatatactcctacgtaggaaccaagcgtatacgtacatgcatggccttcttccaaatgcagcaaccgtacgtggaaaatcgtctagtcgtggaaaccatggccgtcgatcgtccctcctcctataaataccttagccatggcgccacccattgccacattgcaagcagcagctagctagcagaagaagcaaccatggccaatactcgcgtcttcgtcctcctcctcctcgccgtcgccgtcgccgtcgtctacagcgccgacgcggcgaccatcacggtggtgaaccgctgccgctacacggtgtggccgggcgcgctgcccggcggcggcgtgcggctcgacccaggcaagtcgtggacgctcaacgtcgccgccggcaccaaggccgccaggatctggccccgcaccggctgcgacttcgacggcgccggccgcggccgctgcctcaccggcgactgccgcaacgcgctctcctgcgccgtctccggcgcgccgccgaccacgctggccgagtacacgctcggcaccccgggcgccgccggcggcgacgccaccgactacttcgacctgtcactgatcgacgggttcaacgtgccgatgagcttccagccgacgagcaacgcggcgcggtgcggcgcccggcggcgcgggccgagctgcggcgtggacatcacggcgcagtgcctccccgagctgaaggtggccggaggctgcgacagcgcgtgcggcaagttcggcggcgacgcctactgctgccgggggaagtacgagcacgagtgcccgccgacgaaatactccaagttcttcaaggacaagtgccccgacgcgtacagctacgccaaggatgatcggagcagcactttcacctgccctgccggaacaaattaccagatcgtcatgtgcccttaattaataattaagctaatataagatgtgataataaggggtagtgatcttgtgtgttgatcactaccattaccatgcatgcgtgcatgcgtacgtgttgttcaatatataataaatgaataaaaactcttatcttcaattctgatgaaaaaaaaaaagtgagtcgggttgccattagaaaaccagctccatgcatgcatgcctgcgtcgtactacgtccatatttatgtacgacgccgttaacttttttgtctaatatttgaccattcgtcttattcaaaatatttatgtaattattatttattttattatcatttattttattatgacttgattcgtcatcaaatgttctttaagtatggcataaatatttttatatttgcacaaaaattttgaataaaacgaatggtcaagcgttggtcgaaaagtcaacggcgtcatacattaaaatacaaagagagtatttgttttctgcgaagaaatcacaccaaaatatgtttctatgattttcttgggtgatgtggactttgaagctcccttttcttgcttgcaatatatataggagttgatgatgatatatcatcatatatgggattacctatagtataccatttgatagaaaattccttcacaatattttaatgtaattatattgtaattgaaatataactatcatggtgaaagggcctgacggagctcgtggcccctcaccgggagactgcgcaagcccccctttgccggttcgaccaggggcttagggtgcaatcccaagctctctctctctccctccgtgcccccggctggtggtgttggctgtagagcctttgtggcgagtcttcggaatgtccgttggccctcgtggcccctcaccgggagactgcgcaagcccccctttgccggttcgaccaggggcttagggtgcaatcccaagctctctctctctctgtatgtggaaagatcacccgcccgcaagacacacgagacacggcgatgtatacaggttcgggccgctgcgaagcgtaataccctactcctgtgtttttgtggatttgtgtatggacaagttacaaaagattaacttcctttcccctccgccttccaaaagggccatatatttattctaaatatttagtctgagcgcttatattatttacggattgcgtctgcttaggtagggggcacagaagccgagtgcgccctctggtcatgatactcccggtcccatatcaccgacagtagcccccggcgttatgccagagcaatttcccttccccagggaagcggtcaggtgtgacgccacctctaaagcctggtgacaggtgggaccggtttccgtagttgggcaaaatacccaacggtctcaaatcacgcacattggtaatggtgactttgctgtccataatgggcggtctcttcaagactgccatatcacttgagcggcgtacgaatctgggtgagccgatttgcttcgcctggagatatggtgatggcgcttttttcggagccatcagaatagcgtatagcatcttctgggcctgagggtatcgggttttggcgtcccggagggcctcgctaacaaagtagacgggccgctgcacctttcggcggggccgatcctcttcgctagaggccgcatctccagggcgctcttcatccgagaggcagcgcggggcgcactcggcttctgtgccgacgacctcggggttagagggcgacaggcgcggccttcccgcagtggcctcggggccatcctgggggtcgggggcgcctggcaccgtcgggcaagcaagcggagggccagctccggccgtcgggggccttgggccgccgttcggctcgggggcctctcctccctgctctctcttcgggcagaatcctcggctcgcgttcgccctcaactccgacgaggaggacgatgacggcggagtgggcgacagtggcgacgaggccggcgacccgggtgcatcggagtgagcccccaggcctccgccaatcttaatagcttttccttcttcttccgaggccttcgggcccccttcttgttatagactgatttaatctgcaatcaaataaagaggaaatttttgtgtcaatttcatttgttctgtgtatgagacgaggatgtctgtgccgcgatccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgtcccggggcacggctcggttctgggccccttttggcgattttagccgacccgagcccccgagggtaggattgagcacgagtgacctatttcaagtcaagattcttcaaaaggaaacaaaagcacagacacagcctttaggaaatcgaaaaatgcttttattgaaatacggaagagaaaaaagataagcccccggccaaccctgcacgcccggggggggtgcggagttggcccgagcccaagacctgacacccgacccccactaggggtagaagcgacgaaggtgttcgatgttccacgggttaggcagctctgtgccgtcgcccgtggccagccgtatggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcagggagcgccggcctccttctttttgtcgctcgcaggcctcccctttcgggtggccagcgaagcgccttcgacagcgaggacatgaccctcgtcgtcggaatgggctgacctcttcttcctcctcctgtcacgccgccctgtctgagcggcggatccgggggcggccgaagctgccactccggaaccggaggggttccaggtccaggcctcctccttgcgagccactcggtccgcgagctgaaaaagctctgcggtagtctggggctctttggaggcgatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggtcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggcgccgacgaaggagtggtagccgaatggcgtgcagcagccgccgctcgccgcgccctccgccttgatgacacagagccggaggtggcggcgccgaaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccttgaggcgtgctgccgtcgccgtagacgaggaggcgacgctccccatctcgccgttctcctgcaccacccgcgactggcgatgctgcggatttttcgactctctcgagcgcctccccccgcttgggactttggcgtggaggaggtgggggagtacgagctcgacggcgcgggtttggctccccgtcgtcgccactcacactcggagagaggtcgtgcgcctttgcttgctcggccattaggctgaacaagggaatcttggcgcacacggaagagtatgagagctcagaaaacacacgctgagccccctacctggcgcgccagatgacggagctcgtggcccctcaccgggagactgcgcaagcccccctttgccggttcgaccaggggcttagggtgcaatcccaagctctctctctctctctgtatgtggaaagatcacccgcccgcaagacacacgagacacggcgatgtatacaggttcgggccgctgcgaagcgtaataccctactcctgtgtttttgtggatttgtgtatggacaagttacaaaagattaacttcctttcccctcagccttccaaaagggaaaagtcccctctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgtcgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacatgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagggcctatagcgtagtggttacaagagcctcagtagtatcttaggtcagggttccactccctatggaagcaaattttataggatttaacggctttatgctttcagtggtagacgacgtacccatcaacagcgaggcgcaatctccaagatggatttgctggctcagtcttcaaagacactcacagggtgagtgtctgcgttgtactatgtaattctaagaataaagaaaatatagacatgatggtggccgtacatgctaagctaagttacttcctccgtcccctaatatgataaagtaagtcacaaataaaataaataataattttaatttttttaataagatgagtgatcaaacaaaatgttaaaatttcttgtattatgttggggtgcatgcgcttgactcatgcgtagtacgtacgtgtgtgttaagttgtccggaagagagaggagaattccaacgtttttctccacctacacgtactaaagcttcttccagtatctagacgatcgatggaattcataccatatgcgaccgacgatccatgcataactctacaactcgacacgtacgtacgccttccaaattttcggcgaaatgcacaactacaactcgacacgtacgcacgccttccaaattttcggcgaaatgcaccagctatagctagctagctgcttggccggtccttatttttcttggtgttgtagaagataagggagaccagttgaaaatttgtaagccgaactaactaacgtgtactctccctctataccccaaaaaaataattcctaaagataaatctagataaggagttcagtgcactggtggagaaaccatctttcgtcggtcggccgatttccacaatagtcccggatgcaataaaaaccggggctaaagatgatctttagtcccggttcaaaagggtaacgggcatatttgatctttagtaccggtttgtgttaccaaccggaaagctgtcagggcctgtcaggcccctccgggatctttagtcccgattggtaacaccaaccgggactaaagatcgtaacttaccaaccgggactaaagatcccggtgatctttagccccggttggtgctaccaaccgggactaaagtcccacccctatatatatgtcttcttcctcctccagctgcccgagtaagcttcaaaatttcttcaaaaaagaggggaggtcatgccaaaatttctattgaatttattttggtgattaattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatctgaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgaacttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgtaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagatgcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccccctggctatgcatgaagaggaagtacataatgatgccgattattattcaaggccccaagcaacctggtaacgacatcgacgtgtacctaagaccactggtagaagatcttaaacagttgtggacgaagtaaggtgtccccgtgtgggacgaggacaaacaggaggagtttaacctacgagcgctgctgttcgtaaccatcaacgattggcctgcacttagcaacctatccggacaatccaacaaggggtacaaggcttgcactcactgtatggatgaaacagaaagtacgtatcttaagcactgtaggaaggttgtatacatgggtcatcgtcgattccttgcagcaaaccacccggtacagaagaaaggcaagcacttcgaacataaggccgaccaccgtatgaagcctaaacatcgcagcgggaaaacagtgtttgctatggttaaatatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatattaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttcaaccttcattttttaatataatgacgcatttgctatgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcgggctacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcacgacattccagggatatgagatcaatgggtacacattctacacaagagcccaagacatgaagagcacgaaccaaaacagcgctgttcgtgtcgatgccatgggacacgatggaacaactgccacgtattacggtgccatcgaggacatatgggaacttgactacggtcctctcaaggttcctctgttccggtgccaatgggttaggttgactggtggaggcataatgattgatgacagtgggatgacaactgttgaacttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgcattgattatccatataaatcaattgatgtatggcatatgttaattacgcacgattattagaggtttcaacaaatttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgcaaattataattgactggagaatttttaaaagtattaaatttaatatatttttaaaactatcattcatatattagagtttttcacaatttaatttactatctttcatatgctacttatatatgactattcgaatttttaaaacgtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttggtgagaacaaccgggac

SEQ ID NO: 28820 - DNA, 5948 bp, Oryza sativa
tcaacaaccgggactaaagatatctttagtcccggttgttgagaacaaccgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctcccttcatgcatctcgatctctccgatatcgatctctctccgtcgcgccgcccgccacgagacgccgcgccacgacgacgacgcgccacgccgccgccttcgccgccgccgcatgccaacgccacgccgccgccgccttcgccgccgcatatgcaatgccgccgccgccacgccacgccgccgccacggccccgcaacgccacgccgccgccgccgtcgccacgccgccgccgccgccgccacgccgccgcgcccaccgccgccccgatgccgccacaccgcccgttaacgaacgagaacgagaacgatcgaacgaacgagagcgagaacgaacacgtcaacgtacgttgccgcgagaacgtgaacgagaacgagaacgatcgaacgaacgagagcgagaacgagaacgatcgatcgaagacaagcgagaacgagggaacgaacgtgaatgagaacaagcgaacgaacgtgaatgagaacgagcgaaggaacgtgaacgagctagggaacgtgaacgagcgaacgaacgaggacgaacgttaacgtgaaatgcaatatatatatatatatatatatatatatatatatatatatatgttacttcgcatttatcctaatacatatttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattagacttagtatgtataattattgactacggaattggtgcgacaagtagcaattgactattgtagtcttaattagacttagcatatacgcacgaaacacttagcatagatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatagggttgtataatatacgtcacctagacttagcttatatcacgatttataattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatagaatcgcggagggaagcagccagtactggaatgaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtgcaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgtcaagaagaagtaccatcaccacttggggtcaggaggctatagcgtcgcgatgccgaagtgggagcagatggaggctagcttgattgagaggggtatcgaaccggcaacagccaattggccgaaacgatcgaagttctggtactatgctcacggtggaacgctcaacccagctgatggctcactggtcttcggcgatcagatatgagaggctgcgtgatgactaacagatgcagtggaagcctcctctcagggcacgttccgagcagacaaagatagggacgagctgacactcgccctgcagactccagagcatccaggacgaacacgagggaaaggggtgattccttggaagattgatttcaaggaggacatccacacgtataggagtcggatgaggagcaagagagataccgaggcgaagattgcagacctagagtttcgggtatcgagctacgaactcaacatgcaagaggaggtggcaaggaaggttgatgaacgcatggccgcacatcggtcccatgatccccagccgaccattcctcctacaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtatttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctgaggatcctgcaccgactcctcctcgtgctcttacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcacatgccaaggaggccattaagctatcggactatgagcgaacgctgaagaaagcatcttctggaaagtccaaaccagtccctcagcttggagagcaaccaaaccaggagatcgagccgttggtggccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacaaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacacgaaacagaggacaatctcgtccatctcctgaaggtgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcttgcaccatcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttgatacattcatatagtttattcgcatgagggataacctgaccacacacaaggaatttatcacggcggttcaagaacaactcatgggattcatcaacgaagaaatccttgatcccaagggtgaattctactacgacagaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatataatataatatatatatatatatatatatatatatatatatatatatatatatatatatatatatacatatatatatatatatatatatatatacatatatatatgtatgcatatatatgtattgaaacatatatatgcatggtttatatatatatatatatatatatatatatatatatatatatatatatatatataaacc

SEQ ID NO: 28821 - DNA, 20325 bp, Oryza sativa
tatatatatataaaccatgcagcaacagggccatgcaaaaaaaaaaaaggtcagctcgatctttagtcccggttggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtggtggcggatccaaaaaattaattcgttggtgtcataacgtatctactggtgtcatagtatgctaattatgattagatcatggtgttataatatatgaataagcagtttaactatagattttgccaaaagttgtcggtgctgtctgataccggccgttacactgtagatctgtccctgaatggctcataattaaaaaaataaggtgtgtatttatatatgtaagtgtgcgcacgtggtaagtccctatgttttgcaatgtgtattagaaaaagattaatcattaagattgagtttttttttaaaaaaaaaagtagacaaacaatcaaagatagctagacatatagtcaatccaacccatgttacatcgtctaacttgtatcagttaggatatataagtagtaatacaattctagataggaggtggcttttacattatatttattactccatctgttttatattataagtcgctttgagttttttctagtcaaactttatcaagtttaacttagtttatagcaaaaattagcaatatttaaaacaccaaaatagtttcaaatatagcattgaatatattttaataatatgtttgttttgtgttaaaaatggtattatattttttctataaatttagtcaaacgtaataaattttaactaagaaaaaataaaaacgacttgtaatatgaaagagactacctatacatttgtcgacaaattttgtcgacaaattttctcccaaaaatttgacagatgtaattatagtacaatcgtagtgtaattacactgtaacttatatgtaatcactgtaacttgcatgtaactacagtgtaacttatatgtaagtttcacataattttgaatcgttagatctattacaagatttgttttggtgagaaagaaaacaaatcacagcacacacatatgtgaaagaatttgttcccacgacctccattttaccgaaataacatgttacggagagatttttgaaagttacatacaagttacactatagttacagtgtaattacatgcaagttacagtgtaattacactacgattgtactgtaattacatctgtcaaattttgggggaaaaatttgtcgacaaatatatagcaaaatcgatatgaaacaggggagtagtcatcttgctcaatgaccccggcccacctctagagatatgagccgaattttggccctacccacacagctgatacctgtgggcctcatactaggccgcacaaatgcaattgggcctcatattggcccacccacacagatgatacctgtgggcctgctactagatcgcacaaatgcaattgggcctcatattggcccactccacatcgtactggcaacatatcccgttccgaaattttcgggatagcgagctccctaatcatgcccagataattggtactattaatcatgctgagacaatcatatttttactggcaaagattatatatatactactatcaatcaagctagctccggaaaaaccaaggagtaaaagggaattcgatggaattttattcatccaaattatcgaagagagatcatcgagtgcatgcgttgccatgtcaattattgtactagtagtgatcgatcaaggcacacgaaattaattaagccgataagcttaattaattaattaagcagaggcgatctcgtcgtcctcgtcaccggccgtcacgccgctcgtcggcgggcagaagtcgacgcggtagttggtgccagcggggcaggtgaaggtgctggtctggtcgtccttggcgtagctgtaggcgtcggggcagagccccttgaagaacatggagtagctcgtcggcgggcacacgtgctcgaaccgtccccggcagcagtaggtgtcgccgccgaacttgccgcacgcgctggcgcagccgccggggacacggagctcggggaggcacctcgccgtgatgtccacggcgcagctcggcccgcgccccttgctgcaccgggcgccaccgccgttcgccggctggaagctcaccggcacgttgaacccgtcgatgagcgacaggtcgaggaagtcgtcgccgccggcgccggggcggccgagcgtgtactcggccagcgtggtgggcggctcgccggagacggcgcaggacagcgcgccggcgcagtcgcccgtggcgcagcggccgcggccggcgccgtcgaaggagcagccggtgcgcggccagatcctggcggccggtgtgccggcggcgacgctgatcgaccacgactgccccgggtcgagccgggcgccgccgcccgggagcgcgcccggccacaccgtgtacgagcagcggttcaccatggtgatggtcgccgcgtcgacggcggcggcggcggcggcgagcagcagcagcgacacgagagcgatgtcgatacgtcgtcgacgcgagatggagggctccattattgttgtgactagcttgaatttgattgatgctgtagtacagtcaatgcctttgcaagtactacaatttgtgtttaaatttatagaagacatgagatgcatcactgacacgtgtgatagatattgcgtgtgaaatttataggtactccctccgttttatattatgaggtactttggcatttttcctaatcaaatttcattatattgaccatgtttaaaaaaaagttatagcaatatcaaattaattttattaaatatagcattgaatatattttcacaatatgtttattttgggttaaaaatgttgttgttattttttataaatttaatgtagccttaaattttaattagaaaaaaattaaaacaactcatcatatggaatagagggagtagttaacttgtggtgtcagtgcatacatgtaaataaattgggaaatctggctggaaaatatagatctaacctgccggcttgagcttgaatgggtcagaagtgatcgatcggtcgacgataacgtacgtggcgcacacagacagagcgccaggccgccagctgatgccatcacttcactgttagttgcatcttcctgtgcaagcacagtttatgatttttatacttcgtgcgcatgcttatgcgcgggaccgtccaatcagtaagggtgaaatcggagcggattcggacggacagtagtcatattatatcctaaactatattttttaagcgggtttggtgcgggtgtggatagtataaggatatggatgtggagcggattgttttggatgtcggaaatggtgcggagtcactgtggaatcggttcggaaacggattaaatttatcggatgttacatgtatatacaatcaatgcaatatcgagttagcaatataaggaacaataatacaataatcaataaatgacccattgtaataattatatgattaagtactacaacatgaatacatgatgtccataatataaaaaatatagctatgtgagtgtgacatgagatggtaaaagccttagaccaaaaaaatctatgttaattgatgaattaaggcattgtatgtaccaacttatgttatatgcaatagatagagtggttatatatgttgataatttcggattatccggcaaacggtttatcggataatctgacaaaaatgtcggataatccgcatccgccggattttagagatatcatatccgcatccacatcatactatccgcatccgcagcccataccatatcggatcggatattatctgatccgttttcacccctaccaatcagtcttgcggagatgctgatctgctgctgtgaaaagagaatgcctattcatgtgttggagccaacacatattataattcactgcaccctccgtcaaaaaaactaatctactattgaatttgacacatcatagtactataaatctggacatacatatatccagatcatcatactagaatatgtcgcatgctgtcttagatttttttttatgggacgtagggtgtagttctttctttgtcccaatttaattgtagtcgtgggtttccgcgtccaacgtttgaccgtccgtcttatttaaaaaatttaccaaaaaaaataaaaaagattagtcacacataaaatactatttgtattttattatttaataacaaaaaaaattaatcataaaattttttcaaataagacggacggtcaagttgaacattaacggtgcaaaactactcttttcgggacgaagatagtattaatttttttatggaacattattcttttttagaatatatggaacattactcgatgatttatattttttaaaactatgtgcattattttttaaaatctgtttgaaccattgtactgtacttaaagtatatgatgaaatgagtttaatattaaatttattcaaacatttaaaagtattttactcgaataataagtttgttatagaatacaatggttcaaacggatcttaaaaataatatatatacgtacaatttaaaaagatataagtccttaatggttaatttataggagtgttaattgtagtcaagaatatatagattgatgcatgaatcaatggattgactagctagctgttaaacaatattattgtgtaatgcttgtactggttgcgtgtggaaactagatcgatatcttatatagttgtacaaattccacaccatcagttgacaaactgatgatccagctcatcttatctatatatatatataaatccgtcagctgtgatcgaagttaatctgaattatttcgatgccattgccggtcggactaatgactgacggagtgcaccagtaacatgttgagtgatgtaggacggacacagcagcggcatatactccctatctcccataaaaaatcaatctagcagtgttacacattgtaatgctacgaatctaaacatatatctgtccagatttattgtattagaataagtcacattcaatcctagttttgtttttcgtgggaggagtatatatatatatatatatatatatatatatatatatatatatatgtttttccttcaaaagtagtagcgccgattttgggtaagtgggtcacccccatcgtcgaattggcctaactctttttgtaggtaccaagagtcgacaggtagtcctaaatccctatcccttttggcgcgagctaattcctttacgtctttataaagataattgttccagcaatatgtagtctttgcattgaatttgaatatatggaagcggcgaaccatctcagcatcatcatacttcctcttgtatgacttgcaatagcgctcaaataaggcccacacggcttcgtccgactcaaggtcctcttttgtcacgcactttccatcatctatatatcgcaaacaaatcaatatatttttgcaaacattgcattacattacatctaaaaagtggtcaataattaaaacagcgaattgtactatcaaatactagcatgcaattaaattcattcaattgttacatgctattcgatcgtacttttttttttcatgcaacaactgaatgaatttacttaataatactagaccatagatatatagtttgtttatgtaaatgtaaatgaatttaatacaaatcaattgaatgaaaaaaaaaaagactatatatagtttgttttgaagcaaattaggccctttttgattcagcttaggattattataatctaaattattagaagtaagctgaaacaaacaagtagattattatgctaggttattataatctataaaccagattactataatccaataatctcctctagaggagctttttccagattattaagtggctaaagacccactacccttagatgcctttaataatccagagaaacaaacaactcgtagattattttacgattattttgtgtcagcttattataatccagcctagagtaatctgatttaataatctaggttataataatcttaagttgaaataaataggtccttaattagggtgggattaggtaggtttacctgggggctcggtgctgtagcggaaagagaggcgatgagagttgtcagggggcttggagaggtcggcgatgcggcggcgtcgagacgcggcggcggaggcagcggccgcgcgcgctgagcgggcgacacgagacgcggctaagctggcggcgcgagatgatgccccctcgtcgtcacggcgcgccgccgccgccgcagcagctaagcgtgcgacgcgggacgcgccgtgggcggcccgcacgagcctcgacgccattgttgtcatggcgatcgatcgatcgagagaaggatgggtgacacggctggtcgccggcgaggaggacgacgacgtacggtgttctatcgtgtcgtgtggccttggtggcgagagatcaatcatcatcaggcttaatttgggtgactacatatatggttacttggagttatgaatttcgatgaataaaatcgaatggatttcaaaattgagatataatttggaaatattagtttgcattccttaattaattaattaagtcatcagtacattgacccggccggcccatgtatgaaagaggatgagagagagttgacagcccaaagaaggtaggtcgatgggcccatcagatagagcaagcccagttataacaaaattcttctcacctgaaaaagcgcaaaaggcaaagctaccattcggactctcctcctcctagctccgtccggccggtgagcttcacattgaccacttgctcctccatctaccatcgatcgatcaagctaccatttgttagatgcagcagcccatctaccatctcactttatccatcccatttccttatatatatacgcacgcacgcacattcatcgatcgatccgtcgatcggtgagtgactcacaggcacagctcgatcgatcgatcgatcaccatggccgcctccgccactcgcagtagtaagctcctcgcgttgtggctgtgctgcgcgctgccgctcatcatgtcctccaccgccgccggcaccaccactgccacgacgccggcggtccagcagcagcctcagcctacggcggcggcaggcgccggcgaaggccagtctccctcatcaactgcctaattaatctcgatcgatcatgatcagtaacacgcagtaaatcgagagcttcacttgcaggtgtcgtgccagctccgacgacctcgacggcggcgtcgaacgtggcagctgccgatacgacttccaagaagataccagtggaaggagcagggccgcacgaggagtacgtgccggcggcggaggtggcgtcggcgctgccggtgccgatccccgacgggaaccccgtggagggcgccttcaccaacggcggcctcggcggcaaccaggccttcttccccggctccagcggctacggcacggcggcgggcctcggcgccggcggcttcggcccgtacggcggctacggcggcggcccagggacgtacggctacaacggcccattgtacttcggctccgcgccgacgagaaccggctcgccggccggatcttgcgccgccgccgccgtgttgctccttctctccgccgcggccatgtatatttgagataataattagttaattactcggttataaatcctaattaattaagctagtatgcgggagcagtaaatttacactcatgttaatgttaattacctaagtaatactcctatatatgattaatgatttgtatatgttaatggtgattatttttcgaggggatagacagtgagttcctgcaattcaatgtagagaaagagagttgatccagttaataagaaaaaccaaaatcaaaaaccttataacaacacggttaattaatgaaaaaccggtgaaaactccgacattgataagaacaacagtccaacaagggaaaaaactcctaaaacgaagccttccagaagggtacaccgacagaacagcgacatcgtctaatcctaacgaatttaaggttttcactcggagaatccccttgaagtggcgctgaacgagggctccaatagcaacgccttcaaaaaggtaaacggcgtccgagggtgtcgctgttgctagcaccggaagtggagcaaggcttactgttaatggtgatggtacgagtaataattaattactccagattgattcttaatttatagtagtagctatcaacagtgatgttcctctttaactagcttaaaattaagatcaacagctaggtaggagtaggacactcttcatgagtgacacaactcgactaatgcaggcaggccatatcctacaaacactccctacatatcccttaatttgtccttctttgagagagagtaacacatgaaggtcatggtgtggtgaaagcttcatcttaacttgcattgcatttctccaagcaagtatatagggagtttgttgagggatctaacaggctttatatgttgcaatctgcatattctgttgcatcagacctgagagtcgcgccgatacgtttcccgatgtctttcatgccgattgattagtactcctacatactacctccgttttttaatagatgacgccgttgactttttctcacatgtttgaccattcgtcttatttaaaaattttatgcaaatatataagatatataaatcacacttaaagtatcatgagtgataaaacaactcaacaaaataaattataattacgtaaattttttgaataagacgaatggtcaaacatgtgagaaaaagtcaatgacgtcatctattaaaaaacggagagagtacgtaataagaggtgacaaattatgtacactatcaggtgcatatatatattgggcatattaattgctctaggtgatcagtagcattggaggaaggaggaaatgaaacacactacttactatgtcagtgtttgtatatcttatatatatatagtatattgggaatttgggataaagggttcataacacacatatatatcctcatcaaactatcacattcatatatctttctgataggtaggtaagataatactcggtctataacaacataatgtgggagaattggatgatgccaattgaatattgaattgtggttctaccactatcagatgaagtgaattgcctcgttcaagtatttattagcattgtaaaagaaaaagaagaggaaggtgaaattcatactagtaccaggcaactccaattcagtgttgaagttgtcaagaccagcttcttgctcaacagttttggtatggccatgtatgtgccacccaatccatcccatccatgagaccatgacggcctttgcagagtgaaattcagctctggctgttttgctgttttcaggtgtttagtgtagctttggggaatgatcttgaggtgcttgtaggatggtgctttcagtgagaacttttcttagatggatgtatatctcttctttatcaatgaaatgagacagaacttctgcctttgttttttttttaaaaaactctggctgttaggctggagggaatgagggaaagacacaggtaagacagtacaatcaccaaaaaagttaaaggcacaagacaatagaatgattgagtaaattgtacgcaaaatcgacttttacctgcttggaacaactatgcacggcatgccagtgcgctcaacaacaaactcataaaaagctatcatctgctccacatttctcttggaaggaagtactgttacagtgttactcaacttttctttctttttgttttttggagaaagagaggtgatcctttcccatttcattaaagaaatgaaagcagttctaaccgacgttttgtttcaaacttgcatctttgctaccagcgtacattactgaacccgactgaaaaaagccaaaaacaaaagagagagagagagagagagagagagagagaagaaaataacagggcaccaaacatgtgctacaccgattatcagacaagagacgcaaaagacaggcagtagttacttaactaggtctgatggtctgatactaattggcaacatcactcaccaagacatgccaagcactcaactaggaattaaacaggaggcaaagggatgatactcaaccgagttgtcttcatcaagttgagagcatgtgatgcgctgttattcacaagttccgggtgtcttccatgtctacagagagctagaacttcagtatactgtagatgtttgtcggacaatgtggtgatcattgtgacagaaaaagcagcatgtccagtataccgaatctccatattgcggaacaaaattaagcttatgggagtgaagcttcagcttcatattctgtttttgttcgtgaggatggatttctggacgggtctcttgtgctttatgtgctttgatctgcatatttggttgcaacatctgaagattatgttctcataatattcccgatggcttccatgcctattcaaagttggccatatatatataggacatgagttggagaaaaggtgacaaggtagatatatgatttgatcatcaaatgcatcaagcatagtgctctcagtgatcagcagagtgagcagcaaatgaagcaatactgtaatgatttcttttatgatcttcaggaaatacacttggatatatactgggagaagaattcagagactcaaaacatatataaggtgggtgaattggacattgccagttgaattgaattgtacaccacacgagttatggaatctaccacgtactgacagatgaactgaattgcctcattcaagtagaacagctgacttgtgaaaaaaaaaaagggaatgatgaaatcaagcaccatggtatttctgcaatgttaatgtacctagcaagttattgaatcaggtgtttgagattttaaaactcagacggaaaaaaaacacttcatgttattactcccacataagctgagaaaccaaaccaaaccagaaaataggatgagctgccttgtccaattacagcgagttcagtacattttttttgttacaaattcatataggagtatattagtaccagccaacccgagtgcaggtccaaattcttaaagaccgtctaatccatggctatgagagtacaaaaaaattgatagggctgcaggtaatcatttttttttaataatggattcaaccggcctcaacatccaaatgggatgtgcacagccaagggttgcaggtaattaatcatggtgactatgtttgctaagcttctccctaagctatccctgattacttgtatggattttctggagggatctcatgggctttatatgttcgatctgtacattgtgtatttgtgttgctgcaactgtctgatctgcaattctgcatctataagcttcccaatgccttccatgcttatccatagtagtagatccaattaattaggacatgaactgaagaagaggtgagaaactatcaaacacatatatccaacgcagattaattgctctaggtgatgagcagcattggaggaagaaggaaatgaagcaccgttgactttttaagtacgagtttgaccatttgtcttattaaaaaaatataagtaattatttattcttttcatatcatttgattcattgttaaatatgtacacatatagttttacatatttcacaaatctatctaatctaattatatactaaaagtccattaaacttcctacaaacgctcctaaaccgccacgtgcccccctacaaacgctcctacgccgccacgtggcactctaataaattagaagaattaagcaaagcatctagccgttggttttcatttaatctggtggacccactatttttaaacgttagatatagcataaaaaaatatcaattagatttattattatctttaaaaatccacacatgccctgtacgtgtacgtgcatgtacgttacatattttgtacgtgggccctactcccccttttcttttttctttttcactaacacatgagaaaaaacaaaattcatattccagcccatatggttcggagtatgtacttgcatgtagggcctcacgtccccacttttcttgtctttttcttttttttcactcacatgagataaaaaccacgttaataatttcaacccatagttgtacaaatataagttattttgagttgtattgtactatacgcacgtcatcgaaatattcataaaatatctaaataaatgaataatatacattatataatctatctatctattatatactaaaagtccattaaactttctataaacactctcaaaccatcatgtggcgctctgatatattagagaaaatcataaaaattctaagaaaaaagaaaaacatctaccccttgattttacacttaaattggtgggtcctatattacacaccgttagatgaaattgattttaaaacaaaccaagtactatagggtcccacctctcctccttctcccgcacatgtgtgggtatacgtatgtaccatggtatgtatgcttccttcccttctttttttccttttttcttattttccccatttatataatagatatatatatatatatatatttaaataatcataatttcaccaacaaagaatgctcacaggtaactaaattagctctacaatttttgaaaataaaatttacaccattatatgttaccattaaattaataatattatatattttctacataaacatgtgtactcattattttgtactattattttcacataatgcactattttaaaataaagtttacacaattatattgtgtacctatcaaataaataattttagatctatattaactgatttatatgtgcacttaaactgatggacccattatttaaatcatcggaactatttttttttacattggactattattctcaaataatgcactaaagtctacatcattatattgtgtacccattaaattaaaaatttaaaatctataataactaatgtacacttataaagaaccggtggactcatcatttaaatcatctgatatattatttgctaataaataaagcgtccgaagttctctttttggcccgctacacaatgcacgtctgcacctttaccttttgcacgcgtgacaaagcatcgtgtctgaggcatctaaggtgatcatgactgccgcagcactaacgttttgccacatataaattcatacatagagaagattaatttattaataacatgaaaagaaaattagaggtgtgatgcagcaagagcagaattaagcaatatgggttgtgttttttctaacacttagctctatttaagttaaaatcgagagttaattacagaataattataatgtattgtgttatgtcgtgtttggattttgtactatttgtagctctatttaagttggaatcgagagttaattacataataattataatgtattgtgttatgtcatatttggattttgtactatttgttggtataggtaaaagaaatcattatgttataatatgagcacaatattaacgaatatcaatagaactcttacaaagacaagagtgctataaggaagtttaagaccctctttttttccttgattctatagttggattttcgtttgcacgctttccaagtttctaaacggtgtcatttttaaacaacattttaactttctagaagtcaattcattcatgtataccctcaaatagctatcacataaatcagataattcatcaatttcagctgtcctaaaccctaagtagtatatatttttttcatgcgagtcatggtgatcattaaattagggatcaacggataatcaaagtcgtaagatgaatatgtacaaactactatcaacaactgtaaattggtgtcaaaattaattgctactaattagacatctaatggcttgctagccacataattaatttctctcgacatgtatataaacatgcacgaagctagaacaaatattaccatatgccccatacatatatattaagcggttaatattctaattacatgtgttaagtcctttaaaatttcttaaagtgctctcaagctgtcacgtggtgctctaataaattagaggaaatattagaaattctatggaaagaaaagcaaagtatccattacttgattttcggttaaatcggtacgcccaatattataaaccgttatattaaattgatcttagagcaaactaaatactgcaaggtcccacctctcatcccctggcataggtacgcacctacgtacgtgggtacgtacgctttccatcccttttttcatttttccctttctttttctttctatgcatacactcccctcccccctttcctactatatcatgcgccttcatgagacaatttatcacaagaattttgagtatcttgctctcgtatttttcatttgtggccatacaacacggtatgtatatgaatggcctgtatgatatttaactagcaatagtttattatttactcgagaaaaaaatgattcaaaagtcgtaagtacttaattcatctcctactcaaagtttgtgaatggttttttaagatacattaagaaaaatagaacccttaaataatcataaaatgacattatccgagctttagtttgcccttaatctatgagacaaaatttttgaacaacaataatcttatctttcaataatataagtgcccgcgcatgcgcgcgggccaccttcctagtttttttaataagacgaacggtcaaacatgtggtaaaaagtcaacggtgtcaaacattttgaaacggagagagtatatgatagggactcaatctgatgacataatgtgggtgaattcaattgtgccaattgaattgaattgtgtgctataccactaccactatcagatgaactgagtacaatggcatgtggcctagcgaaaaaaatgttaaacagcatatacttgtcatggctttctgcagtgtgcaagttttttttttttttgagttgatgcaagttatggaataaaatgtgacagattttatgtagacactgatgaaatccaccatcttattactcacggtagggacaaggtttgaaatttcgttttgcgtatttacccagggaaatttcgaatgaaatttgtattaatgtgaataaattttgactgaatttgaccaaaatttgactattcaaaagaattgaaaatttctgttgaaaaagttcatgccaaaggggtccgaaattactgaaatatagaaattttgaaccgaaatttcaaacattgggtagaggacgcaaacccaacttgtgaaggagttcaattgccgcgatgaactatatcgagttcagtactttttttttgttccaaaaaaactctgcccgaaacagcttatgcaatctcattgctggcctagcttcttggatgattctctcaatcaccaccggcacttgcgacaacacgttctcaaagaagtgagaactgtattcccggcctccatgggtgccgcaccacgaagattaccgtggagtagaatctatggtgttataagttctgatatgcatattttattctgagagaagttcacccaaggcacctataagcttcctcatgccttccatacccattcgtagtagaggcgtagaaccggacgtgaactgaagaagaggtgatgatttatcagatgaatcgattcagaagatttctctagcctctaggtgatcagtagcgttggagggaggaggaaatgaagcacactatacatataggggtttctttctgatcttgaggaattacatttcaatatatatatattgggataaaggacctagaacaatagataaggtaagataattgatatgactcaatctgacaacataatgtgggtgaattggatggtactcccagctgaattgaattgaactgaactgtgtggttctatcactatcagatgaactgtactgcatgctccattttgagaagaactcagttagctctgaaatacaatttgtttcaacaagagttcactaggtcttaagggtacatcacatgtcatgcattcactaatccaagaaacagaggaacaaagatcactgatcgattattttcagagtacatgcctgtttctctctttgcaattgatggggttcaagcatcctaccgaggcatcccgcgtggttgttgatatatgcaagaaactgaataacaccgaggcatcctgaaaattagcagctacttgattcagacgagaaaactaatctatgggaaaagtcacaacagataagtaccatcaaatagcagctacttgatttttttagataatgaaaatggattacatccccggcttctgtcataagacacacagccacagaaaacttttatggtacaatgaactgctagtatatactgcaagtatatatgatctaacggtgtatattgatttgatattttagttaattagattgcaatataaaatttgaaagggtaattttgtcttttctttcgttattctatcatcaaatcgtgctatcgtcacgtgctttgtcatcaaatggcgatcaggatgctcctcccctagtgcacgataagatctaggaccgggtactcccaattagattcaatctgaatcaaaaattactaaagtattattttattttctatcaaattcctaatatgcccttctatatactgccagtatatactggtagtatattgtaccgtaaaagttctctatagtaataaaaaggtaaggtaaaagtaaatcaaaatgagaaataaagtgatgggacaaatcctcaattcccctttattattgactagcgttaaaccacataaaatttttttagctagcaattctaatggaactacgccaccaatagtggaataagagacccttagctaccgattccaagagtatagcactattgcgcatagtatcctgctcctcctgtgatagcatgatcgtataccaaaagtggagccagtaggaagacacgaagataaagcagctacttgaatcaaacgagaaaactgatccatgggaaaagtcacaacagatgagtgtcatcaagtgcagagcatgtcatcctctagaagatgagactaggatgtgattgtcaacttccagatgccttccatgcctagctacagcaacaactagcaatggcgattgtatttacacatgcagtgattttgcatatgagaaaggtttcgaagcagaatgagcattgctgggagcagctacactgttctacttgtatactccagtatatttcttgtatgcaatgcatatgcctgaagcaggggagatgtgtgtcagacaatatgctgacaatgatgatagagtaaattttgttaaggttagcaagggcattctagttattttcatgtttattgtgcacatttatatgctcctttgagcaagcctatctcaatgtatagagttttatccccaaatttcccttcttctcagcatcttgacaaagttaataagcagcttggcaggaggagcatgctgaactatgattgatggtatagtacttgatactgggggagttaaggatttgaatactattccatttattattactatgaaccattaggggaggacatgccctgttagaaactaaacacaaggtggttttatttgtactggaaaagtggaccatattcagaaattaatgatgattgatgatgcaagatactactagtatatgtttaacaatcagggtcagggaagaaaacatggaagaatgcccactcaacttcaattgatgccaaacaaaatatatgcaaatacacatacgattaatcagatgtaattaatcattgatgattagaacaacaaaccagtaacaagctagccagccatcatctactccacatttccctgcgagagaagtactaactacctagctctgatactaatcgacggagactcgctgggacatgccaagcactcacctttcaagtacacaggaaacagagtgttgatgatcagacggcgcctgtttccatcacaagtagtttgagttcatgtggtgattaactatagatagccaacaaaacgatgacgtttacaaggaagcactggatgccatgggaaaagaaaccaatgacgaattttatgaagtgcgaagaatgtcatcgtctaagtcaaaatgtgttgatgatattaccaagttcaggattcctttcatgcctacagagagctagagctagagcttgggtgtaatggagattgcatgtcacacaacacaatgtggtgatcatgatgatatagcaaaatcaacttcactagttcaggacttcagatcagaaccttggcagcaggagctaagctagcatgcatatatgatggtagtactataggagtaaaagaatttggatcctcttccatttattaccattagccattaggagtaaaataggagtactaccattttctacatgacttggcagtgtgaaaaaatattgcaggcataccatcttgtagtttcagctttacattgcaatttattttgcaagtatggattttctggagggatctaatgggttttataggttttattctgcatattctgtagctctagatctgtgcctcgcacctaaaaatttccagatgccttccatgcctattcgtagtagtgtagagccaaggatgtgaactgaagaagaggtgaacaatcatatatcgagcagattgatcaatagcattggaaggaggaatgaagcaaaatatagtgtggtttctttctgaacttgacgaattacacttcagtgtatgtatatattgggataaaggactcatatcatatatcttcactataatggagacaaattatcatatgcatatatctttctaacaggtaggtaagatatatggtacgactcaatctgacaacataatgtgggtgaattggatgatgacaattgaattgaattgtatgattctaccactatcagatgaaatgaattgccttgttcaagtattttatcaagctgtaaaaaaataagaggaagatgaaattaaacagcatgggcttgtcatggctttctgccgttagggaatcagatgtgcgagattttgaaatgctgatgaaaaatcaccatcttattactcacttttatgcaaagaccaaaccagacaatgagttcaattgcctcgtccaagtacagcgagttcagtacattttctgttcccaaaaaaaaaatgatgcctgaagtagcttgtgcttctcatagttttctttctgcaatgtactacatagaggcctcattttggttgtaacatatacccaatccatgggttacatacaaattcaaactagtagcaggcaactccaatgtagtgccgagttgtcaagaccacttcttgctcaatagtttcgatatggtcaagtcagtaccaccaaatccatccatgacggccttcgcagagtgaaactcagctctggcggttaggctgggaaggacaggcacaggtaagataaacacaagcaccaaaaaattggggcctaaggcagtggaatgatgactaaattgtatgtgaaatcgacttttacctgcttctaacaactatgcatggcataccaatgcgctcagctgcaagaacgccagattggctacctgcgacaagaacacagttttgcacgtcccgtccaacatactcggatccagcgcgtagagtgacaataatcttctcggagctgatgatgcaaagtaaacagtgtgaagttcagatatatttctcatcaaagtacaaaacctatgaataagcaaacaataataaccttttagacgctgcattgatatcaacactaagtttcagaatggacgcaacttcttctgctatcctctgcttttctgcagaagctgtaacacagcacgcaggggaaaatttttaacattacagacacttaaaatacatgagcaaggcttcaattgttgcagtcagtaataaatactaaccagccttttgtgcttccttaactagctgttcatccaaactggaggctactccttcaccaagaacaagttgtccatataagcttctttcaacctcttctttcccaacaatatgtatttttgatgttctctcttggcctaatttttcaatgatatatctgcactcaaaggtagaaggcacataatatactaaaactgtcgcatgtcattcaggtccagattatcttgacagtgtcatgcatgtcccaaagtgcaaagtttcatttctatttattttgagaagaaccacagagttgactggaaaaaaaa

SEQ ID NO: 28822 - DNA, 20717 bp, Oryza sativa
gttttctctccatttctcccggtatgttgtcaatatggcgacaggcacaccctcattaagcgcatcatcaatgaacctttgaatggtttaatacacaagatcagacacaatgtaacttccaaagttcaagatagtagtaattcataaagcaagctcatggcatagaaaagaaaaaaaggaacaaaagatcaaaacaacgacagaacagaaagatattgcttacaaatgctcatgcattgatggaaataaagcaagatgcatgggtataaaaaaaacacactggatcttttgaattatggtaccatgtctgccatactttgcagaatgcaaattctcacataaatttctggtaaagcccctcaaaagaactaccttgcataccactatggttatcatatcttagaagtatgatttataatgatcctaaaagtgatatatcaatcaacaataacccaaatgatcctggaattatttcactagagagatacttcatagaaaattagataaactgggaacggtagacttactgttcaactccaggccgcagtggtaagctatcagaagctgagaacacttccaaagctttcagctatgagaagaagcacatgtaaacaagtcagtagaaggatattttttggtctataggaaagaagacgaaaaaacacccatcaaccattttgatctggactcccgatagaagaaaactcataagttgattgaaatcaaatgcaaaatacaaatagaaattaacagaaccaatcataaaagtcagtgcattggatggttaatatgcaatcctgttctcagggtatacccaaatgcaaatggttttctgactgctaaaccctgcaaaagcctaagttccaaaattcaaattgccatttatcttccattagcagaacaatgcatggtccatcatgagaaatattttgagactatacagccatgagaattgagattcttaactaaatacaatcaaccctaattcaagatagtctgcctatgggtaatcataatagaaagttcatttttttttagtgccagtatggtggttttttcttgttaagtacctgcatagcgtaaagtatgtatctaccttttcacgaagaacacttttcataaatgattctttctcgttagttggcaaagaagtaggccacccaatctgtgcaagtcagaggacaggatagtaataagtaatgcatgcatatctcaatcaatcaacaaatgaaattattcagctctgcaatagtactgtggtacacaatgaatgatttaaggagaacagaaacaatagtattattggatcaaatatgacagctaggagaagagctaggcgtactctgttgaagaataataacaacatcctttcctcgtcgccactagctttcctaaaaaactacatagcttcagacaaataaaaaaacaaaaagagaatgatagattttcatgcagtaaagtccaaaatatattctttgtaaagagaactatatagaaaataatagagactggaaatagcaggggaaaacattcattgatgccaatagtaaatccagtgcaattcaaaagagcgcatgtcccagttttgatgaagctaaagagtatagtatgcacctcactaaatcagcatatattggctctgtccaatttgcacaatccagcccaagattttgaaatgctgatgaaaaaatatgttagaaattgtgctagaagcattaagacagacaacaaaattacttatctgcagcactatatgttacacttcttctgttaaaaccaaacaagttttattctgtagaaaacacatgttggttattacacaggccaatggtgtcaatataattcaatgctttgcacttgtatattggcatcgcatagaccagataaatgatcacagatatggaatggaattgcattaagcaaagaagcatatttacattgttcgcacctacattgaaagcttggcgattgccgaagcgatacacatctgcaagaactctggagaaacagaggaaattctatcacacaatcatgaagagtcctcagagaaaaaaaaatcagaaagaacaagccacaaaaatagaacaaagtcccaagcaactactacctccgtttcaggttataagactttatagcattacccacattcatatagttgttaatgaatctaggcacacatatatgtctagattcattaacatatatatgaatgtgggcaatgctagaaagtcttataatatgaaatggaggaagtagtaactagtagtagtacatcacaaggcaatcgcatttatcctgagttcctgacaaagttacaagactaatcgaaggcggtattagaattccacagacagtgtagccgtcttgaattgctgaactataccaggagcgcatcaccaactgaattgaaccaagctcatgaaaacaacattgagacttctctcaagaacacaagtacagaacatgaagcatttcgaaattgataagagagcaatagccaattacaactaccctgtgcatctctataccgtggtttaattttctgtaaccagatgaatataataagacaaatagtagctctatctacatcaattgaagctagaaaatggaatatataaaaaaattaaagggcactctcttggtcgcaaggccaagaatcaagaagaccaggtggtctctgaggcgctcacccttccacttcgaggagcacggcgatatccggcgacgcggagccctgcgacgacgaggaggaggaggcgcaccggagcggcgggatacggcggccggagctcgggggaacggcggcgcggagagggagagaggcggccgcggtggtggtggaggaagaggaggaggaggaggaggaggaggcagggatggaggaggagaaggccttggcgacctccggcggcgaggcccggagcgggaggcagcgagcggcggccatggcggagaggagaaggtgcgcgtgagcttcacgaataatagctcagattattatttattttatttatttttccactatataaatatataaataaagtgctacacgtacacagcaagaggcatccagcagtgtatagctaatgtccaatggttgttttgttctacactcttcttagtctgtgttcttttggtgttggtcgggaattaatccccgttcacggaaaacggagtgatcaattagcgtacgattattaagtattagctaaaaatatttagaatggattaatataaattttaaagtaacttttctatagactttttttaaaaaaaacgtaccatttagcaatctaggaagcctgcagacgaaaaatgagggaagtgaagtatgggaatcatcacaaacgaaataagcttgttactccatcttttttaaaatactagtaagtgtgcacgtggaatccacgttgctaataaaataaataaaacacataatataattgttcaagtgctaaataattttcagatttcattttttgtttcaagatcgattaacgatcagtgaggcggtcagaccctagcttcatataatcacacagaaccaaaatttgagggagtcccatctaccttttgttacagtaataacgttttcaaagagtaccacaccaaggaaattatttaacttgttgacgtagtgcctgtcttgcaagacacggattgttcctgtcaaaggaaataaaaaacattctcgagccaatccaccaattatattcatcatctcgaaaaacataaatatcacaatcatttacaagagagaatttttttgaaaacagcttttggtgagcttccatgcattttacaagaaggtggttgagagcatatgcattacacggtgtgaattattatcatttaggccccgtttgatttagattattaagctaattattattatggattatctactataaattaaatattttgagaataaacttaaaaaatagcttaaaataaatggactaaacaaaaatcaatttctagagctatccatattccacagtatgaactaaattctagatcactcaattcaatcagaagatacagtgacaaggtaatgacgtaatgttccaaaatagaactcatatgccatttgcaaacatctcgaccttctacatacaaatctaaagatccacttgtactaattcaagttcatttatcaagcatattaaacggatagcaaacgccaagctgcagtatgaaaatagcccgaattttaaatgatttcataagtaattaccaggggccactcaaagtctagttcgtcaccttgcaatattttaccaaccaaaaagcaaatttcaggaaatatttcacttgatgtagattatggtaagtaggagcaagaaaaactcaaaccgtgtaataggatcatgcccagcaaatccatcttcactgtttatagagccagtacacgcggattaaaaattaaagttcaacaaagttcaatggatttactctaggtctctagcaaacccctcttgatcatagccatgtgctggtgaggtgcttgtatgatgttcttgatgtcccacatggccatccagttggtgtttatcatttctagcacaaacttgatgtcctctattgaaacaaagtctaagttgataaaacaaaggacataaatctgtggatttctgatgggtattaagttggtaccctacttatagctttcagctctcataagagtgtgaaggtgaagaaatcaaaatagctacatagaacggactgaaatcactgtattttacatgggtgtaaagttggtacccttttgttgctttcagatctcataagctgatgttttactgtagaaaggaaccaaacaaaattttgtcagacatcagcgtaagaaattaagaagtaggtggcactaatagaaattaagagggctagctgtgcaaactatatcttactattatgccttgatttgacaatcctaattgattttactactatattccaaatggaattttttctaagaaaacacacatatatatcttgagagaaaagattttacttctcaagagaaacctgtactaatttactaaactcgaaattacttgtgctcttggatacattttcatgcaaaaatttacaggcacaatgtatgcaaaatagataaaatccctataatactaacctggatttgaagaatgctatgacactgataaaaggaaaataaaaacattgttgctccatgaatagaaatctccaacattcacaaaaatagcatgaaaaaaaattgagtgcaagaaaccgacttgcctgtaccttgacctggacagcatgtgcctcactcgcacgcatcaatgaaaccagatgagacaagtcttcagcaactgggttggaggggactgctacctcatgcgtgacctggttgtatcattgacgaccagctaagagacgggacatccaatggagatcactgccaacacaaactacagttcattatgtccttccataagcatggaaaatatgatccaaaatgatggcagaacatgcaaactggaattgcgggagcctcaatggatgaccatatgttcaaaagctttgcaaactggaattgcgggagcctcaatggatgaccatatgttcaaaagctttgcttaaatcgacgaagttcagtagaaatcttgttttctaccttcagaattacagtactacaaatgcaaaggttaagtagaatacactaagaaccattgaattgttaatttgaaagcagcaaacaatcaaccagaaatttggtcagtatgacatctataaattgtcaaattgtaaacaggagatgatgctagtgctagctaagcatttcatcaaacacattgcaagcatgaatatagaacatcaacctcacctgttgctggtgttgctggtgtccttatttgctagcatgaatgatgtccaacggccctagtcctgtgccctcgttccagcgcatccctgataacaacaacaatgaaaaattatacaggatgttgatgatgacagcagtggtggcacaggtagcggtcctaggggtcgtcggctctacctccagtcggcaccctctcctacgaccgcgccggcggcctgctcctccccggcacctctgttggcgctcgcctcttgcccagccaacctcgccgatgctgacgggccatgcgcagcgacctccagccctcctccaatggccccctctcctcctagcaagactctccgccacctcatatcccctttccggcgggcggcacccggatgtccggcccgcgcgccggcgcgcgcgaggagtcagcggggtagggggagcagaagtgcagaacccgcctctctttcctctccatcgcggcgcggcgcggcgcgagcagggaagcaggcagcggcgggtagggtgaggcggctccggcgggtgcgcgcgaggaggaggcgagcagctccggcgggaggcggcggcagcgggctggcgcgctctaggaggagtcgagcggctccggcgggagaaggcggcggcgcgctggagcacaaaagggagcgttccctttcttttttctttgaccgatccctaaccgctgtttagaccctcgcaaaaaaaaaaaccgctgtttagaagtgggagatcgctaattgtttctttttttcccctaaccgctgtttaccacgtgggaatcgctaattgcaggggttgatccaacttttgatataaaccgttagatgaacagatctaagggtcaggagagagaggtgttagatgaactggtgctttttatttttaaaatatatatataattccaaggacatccacaatgtgtcataagaatgaaccataagaccttatgactagccatatacattgtggatactagccataagacattaaatgctaaaaatagccataagcttatggttcaaccttaagaaataaaataatgagataaagcacacgtgcacactaaagagtatgataatagattatggtatggtgggacctactttaaagtagaatttgtttacatagatgtgggacccatcttaacatctattcttgctttaaacattgtggctatggacatagggtatggtgggacctaccttattttcaccaacaccttaagcattgctgatgctctaaggatgtaccatgatgtccagacatatctttaggactagattttctttgtagggctgtgatttgtggagaaggtgaattagggattttactgttgattcattggtcaatccgaaaggtatatttgagtataattcattggtcaatccgaaaggcatatttgagtataatgaagatagaagttactaatatacctctaaatacatagaactagccaaccatcttatattgttttatgagtggagactggccagccttgttttggaaaagttattactacactgtcttgctttatactgtcttgcttagggtatacaaaaccacatagtcatcacacggttaccggttatcacgcgcggtaaccttcccagtttttgaaaccaagataattctcacagtaaccacatggttatcgtgataaacgtcttatcgtagggtaacggtaactccacctaaaatggtttggtaaaccctggtcttgctagtactgcttgaacgatctatacatacacaccaaaacaacatgttgctagttgccaccactaaatttaatgaagtggaatttactgtttttccactttctacacctttaccatgttaaatatgggtgaaaaagaaaattctcgaaactcatggcttatagtcttagatcgaatcatatcgaacttggcttggttagctaaaacatgtacttataatgagctgaaccgattgagttaggttcatggttcaccaaaccattttgggtggggttatcatctcccctcggtaaggcggttaccacggttaccatgaaaaccgtacagttaccgtgagtattaccttggtttcaaaagtaagaagattaccgtacataataaccatgtgatgaccatgcgattttatgaaccctcgttaggcttttagctcgttgcctagcgagccaaaactcgtgtttagcttattcatgtagaatgtcattatatcattatatatatttagtgtttcttagctagctagtagttactaagataccttacaacaatttgtgtttgtaattagtgagtactattttactagttattatttattattatgttagcatatgatacatcggcaaatattgcaactatgtggcataagaacaattttcccatatactccctctatattttaatatatgacgccgttgactttttaataaacgtttgacctttcgtcttattcaaaagatttatgtaattataatttattttattatgacttgatttatcatcaaatgttctttaagcatgatataagtatttttatatttgcataaaaattttgaataagacgagtggtcaaacgttggttaaaaagtcaacggcgtcatacattaaaatacggagggagtactaatgtacaatctagctaagaagcatacaaactttcaaagcctgaatgtagatgcaaatcatgcaatgctgctaactttttctcatgcatatatataattaacatgtaatacacacagttaattacatatgtacatactgagccgagactagcaaagttacatacgtataagtagcatactaatggagcaattttacagttcttgagaagggtaacataaggtattactttttctactgtaaaattggtatctcttgatattagataccaagagatactaaatttacattaaatgtttggttactcatactaatatcaaagtaatgcaagctatagctaacatatagttgttcgatctgcgtcaattaattaatttattacaagtagtaattattattagcagaattggtagagatatccatgatcctccccagctcgtcccagctactgccgctgctgctcccgccatccctactgaagctcatcacctcgctccaccccgccgccgtcgacgacgacgacgacgccgtcccagcatggaagtcgagcatgaacggcgactgacgatgacgaatgtcagcgacgaggtgagactgagagtgagagtgagacctcgtcgtcgtctcggcgtccgacgagtgatcgatgacgtcgacgatgttggccgccgccgctgccatggaagcgctgccggcgtagtgctgcaggtggcgacgatggtggtggccatggccgtcatggactacctcgtggtagtagaattgctgctgctgatgatgatgaatgtgctgaagctcatggctaattcgcttgttcatggatgctgctgccgccgccgccctgcccttggtgtaggtcatgctcctcttgaagatccggcaaatcgtccatgtctcctgcatgccattgatcgagatgatgcatgaccagtactatccatgaattcaattcagaacaaattaaaggtgtatatatatataagagatcattctgacgatcgatgtagctaattaagctagctagctagtgacgcaatgatgtgcctgtctagccgattgcgttgtgtatcaaaaatcttttccttctaatatattgacgtgcaatcttttgcgtgttcacgaaaaaaacctgacatactgatgcgtcttggaggtgatcggagtcggagatggaggaggggagtcggaactcgtgcatcatccaatctgtcttggtgcctttaccggcgctgccgcggtagtagacgagagacttcttgaggccaatgcagtcgccggcaccggcggcggcggcggcggcggcgagtgaggaagagtagattggcttgtcgatgccggtggccttccagaagccggagccggtgacgcggttggggcggatgctgttcctgtacttcctccctcgaaggcagaagaaatagccgcactccttctccgccgccgccgccgtcgacaacgacgacgacgacgacgagccctgcagcgccaccgcgccatggctcacctctgcattcacaagcacaacattagaatttggttgatatgcatgcatgcatggctcgttgttcatcatttttatctgactttgctgatatatatcaattattctctcaaatctctgattgtgtgttaattgttcagtgtttaatttttattcacgatcgatcgatcagagaggattattcagagatacaaattgtaactgatagctagtatatactaccacttatgactgaatttccttttttttttcagttacagaaccaactaaatttaaatgacacataggcatgattttatgaatgtttcaattgcaggagataattagtcatgcatgacgattcgcctatactagtcatattattaaccttcaccaccaagtgtgacaaaaatttaacctctggtatcacaattaatatatcttgcatcatattcttataatcttcttgaaagtaagatgaactaattgatatgcacaaaggaagaacatgagatcagaaaagtaatacggtttcatgccctgaatcctgattttatcccctcttacttttcagtgcacatataatgatgcgtatacatgtgtggatatgttcaaatcaattaagaacataacttgcacgtacaccagtttttttcttaaaattaagaacaaaattgaagtaacctacttggaagatcccagggatcatgcttgtagatatcgatctccttgatgatgtcaatactgaaaggcttcttctccaccttccttgtcagataaaaccccacgagctcttgatccgtcggatgaaatcgaaaccctggaaacaccagatcatcatcttctgctaataaagctgctcctcctcctgggctaattggactgtcaatctccttaataatcctttccaacctcttctcctcctccatggcttaatcttgtagtagctagctagctagcttaattggacagagctataataacttgtttgatcctatatacagctagttatatatagtgtatgaggtttagtgttagctatacatagttgcttacatatggtgatggagaagtatggccatggctgctgtattaataaattaatgtgctatatttgaccatattagaacacatttgatgattaattatactagacaaagctatagcctgggataataataagatgctggaaatttttgtctgagcaagctgagtctaagtcaatcgagttgaaccctctctctccctatgggtctctgcagataaatcgtcgtacctctgatgacttgctcaactcaattatatgtcgaatcaggagatttttcttcagtgacgacgatactttatttcgatctcgccacagcaaattaaatacaggaaggattaatttatttcgaagtaaaattatcacattgttatatatactagtggtaggcctgaatatatatgtagcacgtggttttcagagttgtgggaggccgttgaacaccttaattagagtctcagtttattcagaggcaatgcacatatatgggaaattgacattctaccaagtcaaaggcagataatattgattgacttggtagaggtgtgctactcatttcttccaactgagacatgcaacccaaattactcccttagtgcaacttataagatgtcaatgcattttaagattcaactctcataatatttgaaaaacaattagtcaaatataaatttaatttatttgataaataaaaacaatgttattggattgatatttgaatgtactagctttttatagttatgatttaatttgttgctacgaacattatattatgtgagaaactgaaagtcaaatagtagttttgaagacatcatgtcaagtttaactatgtcttatattttagaatggatggagtacattttagcaaataaaagaataatttcttgatgtatgaagtgtttacaaaattattgattcaaataactctcaattcaatctgctaaagacaactcgaatttctcgcgttgtggaaattagcactaaaatttcgacacctcgtgatcctttatcaaatactgcaacaatgcatatcaaaataaaaacttaaattaaatgggcataagtgcttattataatcgaagaagcttctgattaggttggacagttaccatctttttgtagctagttgcacgactaactactagtaactacttagctagagccaagaatctcataccgttcataccaagcaactgtacagccataggatttagtcacagtgtagacagtgatgctgtggattaattagcaattcgaggatttataatacggagaacgaatcaatctttcaagatgtactaatgaaaaaggaatgacgaactttgaacatttccagcttttgaaaagtacttgagagtcgggttcatcatattcggcctgaagaaaggataaattcgagaaatatatttcagtcaacagctgtagatttgtaagacgaactgatgaaaagaatttttcaagggtgctcacaaaaggccactttaattaaagagttcgttcaaaaggaggatttgagggtttttcttggtggctgttggtgccttggtggagttaattttggttaaaatcatgtgtatggggccacaaattgaccctttcatgactctctaacctccagagaaaaaaatttacatggtaaatattttctctaaactgtttttttacagcttattcgttttatattttttttcataaactcctctatctaaaattaattatactgcatgtttttgtcctatgtaagtccaactttcaaatacaaatactctgtttctatgagccgtcaagcaatgggtaacctaacaaagaaatgaagaatcctagtcattttcatctgtcagattggacgaaatgttgctatcacaagctttgaacaatgggtaaactacagattttacagtaattttttctaggatcatgcaagaactttgtcaaaagccttgacgtaacggtacatgcgcggtagattcggcttgatatttttacctgtcactcagtaatttactggaaagcaaagccaatattttcatctttgttgggttctcatcctggaaggtgaaatcctgaccactggagccttttcttcttcctgtgatcaccaaagtcagcatgctctgctccttgccaaaacaaaaatggaaaagattcaaagcaaagagaagaagagttccaatcttctagacccagttgctagcaacagatccattgtagtaattttttaaaaaagtatttaaatattgggtttagaagactattgatgttcagagtttttacagtcaatggcaccggttggcttgccagggaagaaactcaattagcatatgattagttaagctttaactattatatacttcaaattttgatttatttgattttctttaaaaaaaaccttatatgtagaaagttttttttaaaaaaagatcacatcgtttattagtatgagaagcgtgtccgtgataatgtaagcctaaaacgacaaatttagaagactgaaagaaaatgatagttgagtgttgacctgccagattagtgggagtactgtagactgaaactttctcctggatgttttgtcagagaacttcagcattatcctcatagtttacttagaggcatcaaagaagtacaagtaaaaccacttggtgtgaaactgtccgatgcttccaaaaacacatttttgcaaattgcatcatccaccatgcttgctatcctccatgtagtaaaaaaaaaaacatgcatgtatgtagttttctgtcctgtagaagagtctaaggggatggccatgtattctctcatgaccccatcagctcggttgacatgtttgatatttccttggacacttgattatacattggtcagcaatcttccaccagattgacttaaggtacagtttgtcaaaactatgtttgtttacgggtgtaatttagtcaggcatgaaacaaggaatcccattgtttcatactaagagaaagtagacattgaaaccactgaaaaatgagatgattactgaatccaactctttagaaaaaaaaacctgcttaattagtactcccttcttcctaaaatactagtttaggaagtcacacattcacgtgactataaccattctattgttaatggtattctattattaatggtatagatgaaaccttatctatgatgttcagcaattgaagaatttgagtattagtatttgtgaaaaatagaaacgctaatcaataacagaaaattttaaacacggtattgtaagatgtacttgcaaggatgattttgtagacgatgatatagtagaaccctttgtgtcattgaaatgagggtatgcatgtgttatcttgggcaaaggcatggtttaatactgtcattgtcgttgttctttcttttctttttagttcctacaaatatgcatgagtgtacagtgtactgccctctggaaattctgcaacccaaaagtcacaaccatatcaaatactccctccgttagtacggctcactcagacgatttgttaatccttgatcttcatgataacaactgaagttaatttatttttaatgatgtaatttgtcgatgtatataatactgtacgacttagtattataaattgcattttaacttatcttttgttaaataaaacacattatataaaattaccttcttgatgagtgcttttttttttcttaaagcagctgatcactcctcctcttactgtcttacagcatatttctatctataagttacagctagaagatggttagcgatgacaatgtctacggatacacaggcgagcaggtgacgatcaggcagtagccaacgacggaagaatgaagcaactaccaggtggtgctgaggctttgaagaatgaagcctacaaatctccaaagtccaaacggccagactaaaatggatttacatctcgatgaggtctacgaatccagagtctccaatcgtccatccgagctatggttcaaaaagtcaacttttcagtctctattcaaagcgcccagtcgatgccaagcacatatgtattactcccttcgtcccagaatataagaagttttagggttggacatggttattaagaaaatatatagaagtgagtggtggagggttgtgattagttggaaagataatgttgatgtagaagttgttatattttaggataaatcgtgagggttaaaagttgttatattttaagacggatgaagtaacatatactaggccctagttcagcaagcctgagccatggtgtttatacaataggccatacaggcctaatggttgcatcaaaatagtacaagtacaacagaccaattacaattgagactcgagagagtatgcccaaagttaatggctctttgcaagaccttgttaccaactccctactttcgttttccgcaccacgtttttcaaacagctaaacggtgcgttttttaaaaaagtttctatacgaaagttgcttaaaaaatcatattgatccattttttaaaaaaaattacaaatacttaattaatcacgtgttaatgtatcgctccgttttccgtgttcactctttgggttgggaacatgttcctacgaacacaactagcaaagttaactatatgtgtattttttgttttgtgggcttattctcctatactggctatgttattttctttgtacatgagcacattttggttctttttgtctatatggattgtatctagttgatgtgtacaaatctagatcagaaaaagaatgtggctagctagttgtcctggatttatatgttcgttaatttgtacaacttgatgaagttctttacattaatacaaaagaatctgaacattgaagttatttagtttatattatgaaattttgtttaggtttctgcattaacatgatgccttgaggctgctcagctaaggcttgctcgtcggattgccaaacaatgcaagcacctaacatgtatatatatataggttgcaaaaatattttctagataaactcaattaacatccatatgatcaatctaagtaagttttcacacaggtagctaacagctgtatatccaatgagccaactaatccaaataagaaatttttagttccatcactatctatattcaagtaggattgatgtattattagtttataaaggtccaagccaatactgggtatatgccgctaccttatacatcaaatgaatgaaaaatgagtgaaatgataataatggtggagattgtgctaatggtacagtagcagacgctgacatgtaagcccgaatccacgtatcagccattgctactgtgtcaacagtagcagagaatgcactagaggcaggccggcagatgattttccttgatggattggaattcagaaaataatcctttcacgggcatcgtcgtgtgggtgcaactcttccagtaggaaccagcgttcgacagataggccttttgcacaggctaatccgtctaggtctttatgttcataactgttccaagtgtgcaccgaattcgcagtactggacttgaaagtctcgaagcggcgagccatctcagcatggtcacgcttcaacttgtacgatacagcttcgtctgactcgacgtacgtcctcggcagtcacgcacttaccatcatctatatatcacaattcacagacaaatcaatcagttttacacttgcatacaaacaaatcaattagaagtattaaactttgagtaattttacggtccttgaggaggtaccattttttctattataaatttgatacctcttggtacctaggtactatgagatatcaaattttacactaaatttttggtacctcatagtatctcctcaaggaccgtagaattgctcattaaactttagttcctcagggtcgatcagggactaaaacatatcggatgtttggacactagttacaagtattaaatgtagactaatgataaaactcatttcatgaccctagactaattcgtaagatgaatctatttagtctaattaatccatgattagcctatatatgcgatgctatagtaaacatatgttaattatagattaattaggtttaaaaattttgtctcgcgaattagctcttatttatgcaattagttttgtaattagtctatgtttaatactctaaattagcgtcgaaatatgcaatgtgacagggactaattaaagtgatccaaacaccaccaatctatccgtatgctaaattgcatgtacagctgcatctttgattgtacgattggttattatggggtttaatataatgggattacctgggggctcgctgctgtagcggatggagaggcggtcggagacgtcagccgccgcagctaaacgggcggcgcggcatgcggccgcctcggctaagcgggcggcgcgagatgcggccgccgcgtcatggcgcgccaccgcggctcgggcggcgcgacatgcggcggccgacgccactagacacgacgccattgttaattagggcttactgtattttgtttctaccacatatgcatatatgtcgtcaaataagatcgatcgatcgatcgatggatgagagataggaaacaagtcaatacgactaatataaattatagagtaaaatacacggtcggtccttaaagttgagcgcgggtgtcacttagattcataatcttgtaaattacacatctagatccaccatcttgtttaagtgactcattgaggtccaaaagacctctgaccgggttgactggcttacgtggcggtccagcgtggcaacatatttgcattttgcccccctttttgattccccgtgtccgatccaatcccttctttgcgtggcgcacgcaggaacgcgtcgacggcaacgtgcgctagcacgcacacctgcggcacccacctgtctcaaccacgctgcgcccgctgacgtgcctcgtacccctctggcagccgctcgccggtgttgcgcagcgcccagagaaaccgcacaccgtcgtcgacgggaaggagaaagagcaggggaaggggaaggcccccgctctagccagccgtgggtgcacgcgacaagtggctgcggcagctgctcaagtcaagcttgccctgccgccccgctgccgccatggagctcgcacccgcccagctcgcgccgaactcgccgacgcctcccccacacacgcggccgcggtaggcgacccctccccccgggcgtggccggcgacacctcccccgcgcgcgccaagctcaccgacgcctctagcaccaacgaccagcgggaagggagaccgatggatctggccgtcagtgaggcgtgagcgccaccggcacgctagctacgaagacagtgacggcgctccgcaaactctcctctagttccctccgccgcctgccaactgctgccacattcgcccgtcgccgctccgctgctgctccgctcgcaccccgctgccgcgcttgccctccaccgttccgcccgccgcccattcgtcaagaaggatttgaggtccacgacggcacggcgtcctgatcttcgagctcgtccgccgctcgcttcgtcccctctaatactgtgtcgttggcaatcatgcgtcgcttcgtcgaggtccacgatagcggcgacggaggacactgatgttggcgaggcgaggccggagaacgtgacaagcgaggcggtgcagctgtgctgtgcgactaggcgccgcaacagctcagccatcggtatgacatggccggcgaaggggctgacgatgaggatgacgtgcggcggcggtgggcgatgtgacgacggaggcagctgagggatttgggggttctttttggtgcccagggctctactaaatgcaatgtagatggtcagcttcggtcaaaccgggtttggaccttaatgagtcacttaaacaagatggtgaacctagatgtgcaatttacaagattatggacctaagtgacacccgcgcacaattttaaggaccggccgtgtattttactctaaattatatctctatctctcccaacttctcttctactccctccaactaaaagtttaagccatagttcttatatcattgagaccactcaccacaggcggacaattttttttaattagatactaagtaaaatttggtacataaaggttctatgaaaaatttagtgtgcttcaaggtaatttcttaaatactgtaaaattcttaacatactttgcagtgatttcaggcctgttattactatctgcaaagtacgttgattactgaatccacttcttccatcttttcactagttgtaattggaaatcagcaatatgaagaacattgtttgtgtgcgctggtgcgtatgtacatgtgtgattgtgtggcgtagaccaaataatggtgaaataataaaaccagcttaagcagataatcacaggtaattaagacatgttcttcgtagttctgtcagcctttaaaaaggcaagcctgaagatcctttccttatgacactagctatcaggtgttatttatgaaagagatgattgactttcagagacatatattaaaaggagaagctgatgaaaaatgcaaagactaagtacataaatacatatattcctcgctttgaactggctcgtcaggcaaatatttgtgttttcatcaaatctaaggcaaggtcaaactccaaagtccctgcaaaaaaaaaaaaaaagctcaaactccaaagtgggacaaagttgctccatctctagcttcttttagaatggtcgtcaccataaaatcaagaacacccccagcagctggttcagagtcagttgctaagaaaaaaattcagattagtgtactacgtcaaagctactggagccagaatctgtatgaaggtccccgtttctcttgcaaatcaagaatccattgtcgtctagtccggttaggatatctggctttcacccagacgacccgggttcaaatcccggcaatggaacattaatttttgtacattttttctttgtctgctagttttgtttgtgagcagctcacaaaactaacttcaagatttaatttatggcttgttcactttgttgcttaccagattttcacaataccaatttttaataagctttggttttactaaaaaattttaacttggtgtgtttagtttgacatctttctaaatcttggtagtgctttttatcaggggtgaagctagcatcaaaataagggggtgtactaccattaaaaatctagaaattttcagtacaaaactgtgtattttagtgtttttaagtgagaattgaggaattctggggttaatgtgcaccccatacacaatatagcttcgccactgctttttataataagaaagttccaaaaccaccaaataatgttaaggttaaaatcagaataaagtgaacaagttctcatcagctgtgtttgttatgttgagttgggaactcattcccttcgcacgaaaaacggagcgatattttttttatgattaattaagtatttattattatttttaaatagattaatatgatttttaaagcaactttcatatagaatttttttaaaaaaacgcaccatttagcagtttaaaaacgtgcgctcggaacacgagagagaggagttgggaatccaggcggccaaacatatatagccgtgtaattaatttcctacgtaccactaaacagcttttttgaggtgaaatttatcgtcatttcatctactacatgtagaattttgcattgcttggagccttagcctagttaactaaacagggggatccactagg

SEQ ID NO: 28823 - DNA, 30824 bp, Oryza sativa
  unsure (1)..(30824): unsure at all n locations
tatatatttttctacaaaatcatgagctgcaattaagaatccgatcatttcaagttagcatgcgagttttttaaagagatatcttatacatatttctaaaagcgaacgaatttaaaacctgacttaaatacggatctatattttcaaaatcgaatgaatttaaaagccaactcatatacagatgatatataaaagtatcggtaaaaacatcttcaatttttataatggaagagatatacatctaaacgactgaatcttctcttgcctaagttgccttcgtgaaatttcttcaaactcgctttgaatcacgcctatatgcaccaattaacgccttgtaatcagtggatatttgcattgtgtccaatatatcaatcagtacgcgtatggcttgtggccgagtattgaacgctggctgaacgacttgactcttgtgctggactttgatctgttcgactcttttagtagcttaattattactagccctcaaaatattgtcttttgttcctagctcaaaaggcaaattaattaagtcgatctagatgtttgtgctgctatacacgagaatagatattgttgtttcactgcaagatgaacataacatttgcagatatttttatcctttccaactagatgtacacaattagtattaaaatttcacctgttattttcgcatagagagattaatggaaacgctatgcgttgtcggaaacgacgatcgagttaataagctgtggcttgtgttaggaacatgtcgcatctatgcttccaagaagcctctcatggctagttaaatagttagttaattactatcttaattaatttgatcatgtgcctctccattcatcggttcttacaaagtagtagtatatactactcctaaatccactcccaaaaaattccttcatcagcttctagtatactggacaactacttctctgaatacttgcagatgcagagagtctctgtctgcagctgttctatactccactgagctagtaacaactacttttgatctgttcaccaactagtagcattagtacagtttcttattcggatgctctctaatctctgcataataagtagcatattatactgcgagcatctaatcctaatcaccgtatttgttactcaacttccaccgtctttgtccaaaaaataggccacaaaaagagccaagcaaaagttcaggttttcaggagttctttgctgtaagctaatgagtgagttgggatgtcatgacagtgatcttgagcaagcacacacaactgaaattaaaaagaaagaaaagaataatctaatagtatgagattatacttgcattcacacaacatcctttttctttcagttccaagatgcatatgattatctgcaagggattaagtgcagatctgataatcaagtgctttgctaatacggcaagctaatcacatcttatctccgacaaagagacaggttaatgctagatcccaccgtggcaaaaattgtcagcttgtggtatgaatgaaatgatgattaaaaacaaagttgtgaggcagctgggagcattctagaaagagccagcaaatgccaatttgacccaccaccttctgaaagctacacaccaaattgcaaagtgcagaaaaagaaaattttgaacatttcttctcatggtcctcttcaacaccaacaggaagagatggaattcatctttgtctccatggccatggcgtgtcagggcacattatgaaattacacccctacctttcagcaaaatttcatccaacagagttgctgttgaccgttgacctttttgtgggtcaactcaatcaagaccagtcaaactaagcagaaagattcatagatcagtgaatgtagtgtatgaagttatagtggaaacttgaaagtatgcaatccaaatttgtcaaaagagcattgctactcatactatttttctttctttttttcgcatagctcttaccaacaaatctctcaaccgtttgatttaataattatatgggagttcaaagtaattctatatttactcacatcataccacatcaatgtttgtaatagatttataataaatcttttaggacctttgtagtaaaaaaaacaagtctaaaatcaagaaccaatacttttgggcttttggcgagtacaaaagtggaggtcttaatcaatcctcttaacaataataattaaatataaatatagggggtagagtgcaaaaaggactcaccttattagtcatcttccttagccttaagcgtaaagcaactcgtctcatcttcagagaagcaaacccaacaaaaaaaaaaaaagaattttcaggttttcttctcgctttcaccggagaaggagaaggagaggaaggtgttgatcgaatcctcctccaatcgcgcgcgattcgatccccgttgctggccgctcgctcgctcgatccctcatccgatctgaatcccccgatctgatggcggccaaccccggcaacaagatccgcaacgccaagctggtgaggaatcaaacgtctccctcaatttggtttcttgatttgtttttgtttccccctggatttagggctgatgatatttccccctaagatccctccttgttggtcgcgattagattgatgaactgattcccccttattatgatcgtaaaacaagaactcaatctttacttattggcatcatgtgctcatgttgttcatgtatcacgaattccgggtcttgggagtatgttggtatgcgtttactaacagtgttgattaaccaggttcttcttggagatgtgggcacgggcaagtcgagcctcgttctccggtttgtgaagggccagtttgttgagttccaggtgaatttcttttacacgtgaactactatgacctaagattgagcaggtttggtgtgttgggataggcttgattttgttggttcattcggatgcaggagtccaccatcggcgcggccttcttctcgcaaaccttggcggttaacgatgagacggtgaagttcgaaatctgggatactgcagggcaggagaggtatcatagcttggctccgatgtactatcggggtgcggctgccgcgatagttgtctacgacatcacaaatgcggttagtacaagactaagtgacttgcttgaattttaattaagttgtacatcttgatgatagtttctcaaagttttgatttaatgcaatcatgcctgcatatcactgaaaattataagtacggcaccacagccgcgattggtagaaattactaacagtctaataatataatttacgccattgaaaccagaattacgattagtaagtattggtaaaatcaccccttctctgtgattaacatatcgaaccaagtattcatgataatcgtacaccaactttgacattttaatccatcatcttttattgtcacagaagattcgaacttcctacatatagttttaggttatattgctcttctggtcttggttcaagtgtggccatgttttcccagatgatagactgatgagttggttctgccattaccaattagcaactcccatgtcctggcgttatggcacactgatagtagatcaactagttatcttcactgtttttgcaccttgtttgcatcttatgagcaagccctattcggagaagatactgtatctattgtgtgcccttacttgaacggaggaacccttcaattcacggtcttgcgatcttatgtattagcatattagcaacgcatctctttatatttttcttgcttcacatgcagcttttagtgtgtgttcttggtaaacatgatttcgatctgcattacaagtttttgggaagaaataaatatatcatagttgatagtttacaccgtgcacaaatttaagtctaacttcattcatactgttttatctgagtatgctcactgctcattttgtaaaagtggtgctaatagtggttctcatcattattttctgccttttaggcctctttcacacgtgcaaaaaaatgggttcaagaacttcaagcgcaaggtaatccatttctctttttgtaattttcacgtatgattagaacatctgtaaataagcagctatattgattttgtacaactgctggaccacctgtactgtacagttctcttataagtgaacttgcaatttcatagcactataagacatcgtgtctgtttttttaatagtccagctaatacaagttaacttctttttatacaggaaacccaaacacgataatggctcttgctggtaacaaggctgatatggtagaggcgaggcaggtgccagcagaagtatgtaattttgcttctcaaatccctttttttgtgattatatgtcaaagcactagtgcatttctgcatgaaactatcatgtcactgtgatttgatatttgtcactagcatctcataatggtgcttattttcctcattgcttcgagcaaaagtataatttggccttaccagcttcaaattactgtatttttctcctgtcacatttgacgatgaattatcagtatgttgtgatagtgaatagcacagaataactatgtctactttttgttgctcctgcttcattgaaaaaataactctgaattgaagtatttaacaaaaaaatatataataaaaagttgtgaaggcaagaaggttttctgttctgtggtggtcttttttgtttgctcattgcaacactgatctattaaataatagataccatcttttgtgtttgtggcactatcctgttcttgaaatgaatttcttttccattatgacagcctctgcggcttgctttgttgatgcttatcaaaagctctaatttgtatggtgcaggaggcaaagacctacgcacaagagaatggccttttcttcatggaaacatctgcgaaaacggcgatcaatgtgaacgatgtattccacgagatcggtgagtttagatcacaaatcatttccgcagtggatttctgtacgccgacagagctggttggttatttggtgtacaaaaatgtacacagcctgcttctgctaatttctaagcgaatttgcattcttaatctgatttcagcaaagagattgcttcaaggacagcaggctcaagacacaccggctggaatggttctcaaccagagaccagctgagaggatggtgagcagttcttcatgctgctcataattcaagtgtggagtatgtgacaactacataatgccatggcctgaaatccaggagaagtgtgtatgcatcagagatgcacacaaagcttgtaaagtggctgctgccatcccagctgctgtttcttattttgtcatgttcgttctgtaaatgtgaatactagggtgtcgctgcagaaattcagatgtattactacagtgtatgctcttgcttaagtatttctcgacactgaaacagagtaaagcaaagtctagtcagattcgttttgtttgcttcaattcagatcatgcagtgagcttgctttttacattctaattgtgctagtatgtgcaattcagaccacattcacccatttgtaccttttcgtcagaaaaatggaaaaatatgatcagattttgtagttacccttttacacaaggaatgtggtaaagatacacgcatcaactgaacaattgctgatgtagcttatccaattcaacatcaagaagttctgaaaccatcccaagcatgtgtggctcacaagaaaaacaagcatatacacgcttagggaattaacaaaaaataaataaaatcagtgatggcaactccttttgcttatgcaccaaaccaggaaaaaagggagtacaagaggaaaagctcatgaaggtatagaaccatctcacttttcctgtattgattttcaagaggggcatggaaacatattattccaaatgaaattcatcagtatgtgccattcttttttttcttaatgctatctatgttgttttcactggatgtaatcttcattgtagctgtcactgatcaccgaaacgaaccgctcgagccatggcagctggtgaaggtccttcatggtgtcaatgatatatgaatcggcgcagcggggcggcgactggcttggaggctcacccaggttgaaaccccctgagaggaacctctgaatgagagccagctgagctctctcctgctccgagtacccttcgatggcggttggcatgcagtcgaacgtgtcccatgcccatatctcggatgcttgggtggaatgcgctgccgaggcagcctcgatgctctcttcgtcccagaaaacacattggcatgtctgtataccattggtgtactcggcgccacaggagtagcagaactcgtgcccgcaccttcagaagtgacaaaccaacatttagcatatcgataagaatcaaaaggtgcattcatgaattagtaatccttgatgggagcgagcatttgcaatgcaatagctatctaggtgggcgagcaacacagagcacatctagttggatctgaatctacctagtgtgaaattactatgaagagtatgcccatataaacaaaaccctaatgcggactgtagaagaaaattctcttattgacaccagtaatgcaccttaggccccaactaagaattatatgaagttatctcttgtatgatatgataaattaaataactaatttgggaatccgggattctgaggccataataaggaacaccttggaatttgtactgaaaactaccaagttctttaattcagagtgtggtcagagacagagtgggccaacataatatagctagcttacagtctacaacatttctatctgtttggtaactttcaaatattacagattgtgggagaggcagaaatcagcgcactacttaaaagttgcactaagaaagcttcatcaaacataataaacattcgttcataacctgtgaaaatgtgaaatgattcttctctctcatttagaaattttaactactagcatgacaacagatctttactcttataataaacagtgtttaatgctttcaagtttcagttgaagcccaatgaaaccggccaaaaagagtgcttctctatgtagaattataaagcttagttctgtgtgtacttgtttatttttttaaaaaagaaattcctctttttagtctacgagattccataccagcaagtgtgccaaactgaaaaaaggaacataccagcaattcatatggaagcagccttgtgtgagttcaatcattcgtcggcatctctgacaacgcctccacctattgttttgtgctagccgatgcaaagacaggtctcctgcatctctttcatcaacaggcaagctctggtactcatcacagcccatcatgacatgccatggcactccacagttgatacagatatctctatggcattctgggcactcaacacaattgagatctgactgacttgatgtacttgctctagagaagtgctgactaagatctagtagaactgaacagtttggaaagggacaataaaatctttccatgtctgaggtgccagcttctgcaaaagctctctccagagaatcgtagcagctaactggaaggaatgacttacactcactagcagaaatatgatatttacaccttaactgtgggcatcttataggaaccttgttggtttgcagcttctcttgagtatatgaagtcaagcagctatagcaaaatgtatgagcacaacccactttgatcatctgagcgcctcgtttttcctcacagcaaattgaacaggtgccaacctcgtatggagatagatacatgatgcctatggcttctttggccaactgcagtggcctctcaagctcaaagctaggaagcaatattatatcaaagtcttccagcttttccaccagttcaagaattctgtgtcctaaagctaccaagagctggtcttctagaatttcagcttctgcgatctgtcagtgcaaaagaacaagaaatgacacatcatgtctaagtatgatataatacaggaaggcagtaagataactctattgaaataggtaattatgtaagaattctacagctttcggacaacataaattgaacaaactactgcatagaactgcaagtgatgaatacgatctatatactgcagctgcactgcagtagcagaatttggaatgtgcagctgtcataactgcacattccctaccttttcatcctttcgttcctctcagtttagttctgtttacaacagtcagctattaataggtagctgttaaaatctcaaataggaaagacggtttcttcattgactgattgttgaattgattagttcgactaacttggaaccaagcaagatggcatgaagtcaagtatagttatcgtggtgcggtccatttttttgtcattcggattaccagccaaacatgtggtatcctcaaaacatgaattacattattttggtagcgtatatcacaatgccaaactgcaacatacagtttagttaactaaaccttaagcgcccattaggtgatgcccaatagcagaaatatcagggtgattgaaagcgatactagcgattctgtgtaacattcataagggcaaaccatatattagagaaaatcggaaactcttgcctgaaagtacagcttctccgaattggtgaaagcaaagatcttccgtatcccattctgcaacgccaccaacaggccatccatcagcgccaagtgatcggccactagctcatccacatagaagtccagtttcttctgcacctgaagcataggcaccccaggtgacctctccatcaccaccccaatcccggacagcttcttcccctccgcctcggggctcgacacgcccttgaagaacagcctcaccgagctctcatcaagctctcccttggcgacgccggccgtgaatgactcctcggtgtcctcccactcatcctcatccccacagcagctcctgaagtcatcctcccctctcgaattgcaggcgaaactgccctccacgtcggctaacctctcctccattgctgaaatcccaatccaattggtgaaatccaatcaaatcaaatcaaatcaagacgacactctctgactcagttagaaagctgagcaatccccaatttgagcaatctccattcagctagatgggtcagcaagaagctgagcacactgacaggcaaccaaaaccaaaaaggtttccaccaaacgagcccttttgagctcgagactgcacctaatcccaactccaagaaggtgccttgttcctttttgccacaaccactatggtggtggtggtgatggtgccagtgacctatcgctccgacgaccccacagattcgtgggggggcctcggaatcgcacgagatttggctcagaaattggcggagaggatggccatgaagcaccagaaggagctccacatcgcgaattccagggccgcgagggcgaaattgaacggggcagcgaccaaattcacccaaatgttggagctttcgtcgattctcgaattattcctcatgcgagagagacgctcagtagtaattagcaattcagaccccgaggacagtgcaaatcaccgccgcgacgtgagctccaatcacctgcctgcaaggtgagaatttaccaacaattcagatcaaaatcagcaattgcgagaacgaaacgactgctcctgaaattgacaaaagaaaaaaaaatctagctcaaatgttggaaaggcccaagaaaaaaaaggaagaaaataccgaggcaacctgcctcgcaatcgaatctaacagcaaattctgcagaaaactcgtagaaacagatctagagaaggcgagcatttaggcccaaaagtagatattccagctcaagaaaaattactagaaaacagcaagagaaaactccgcccaacaagcacaaaaagaacccaacaaaattcgcagaaaaaaaaaaagatgaagaacaagaacacactccacacagaccgagatgcgcccaatcgaagcaagagcgagtgtgggtcagaaagagagaaaagcgggagcacctgggagtcacacgcatcacatcgaggagagatgaaaccgggcctccggggacaagaacccagagggaggaaagaaggaaggaattgagggcaagcaacaaatggagacaaagatgggagctttccggcacaccccggtgacggtgaggcgcctttccttgcggcagtggagagagaatttattctgaggaagaagaagaagaaaaagagagaggagtggcgttaaagcaaagacagaggagccctaattattccttctcgaccacgaggagcaggagcagcactgcaattgcaaactctcctcttctccttcttcttcctctccagatttgcactgctgtccctcaacaagcacaaatattgcacctttcaaacttagcactactacctctcttctaaaatgttcagttattttatcatggaacgtgttttaaaatgaagggtgtgtttagttcacgtcaagggcccctttgatttgaagaaaaaatataggaattttggaggatttcaatcctatagaaaaaattcctatgaagccctttgaaacaaaggattaaatcatatccaatcctttgaaattcctatggaatgcacaattctatagatattttggaggaaatttagcaagagctccaacctcttagaaaatttcctttgagtctatctctctcatccgtttcctgcgtttttcctgcgctccaatcaaacgaccattcctgtgttttgcgatcctatgttttacacttacattcctatcataatcatgtgtttttcctattcctatattttctcagccctgcgattcaaaggagccctaaaattgaaagtttggttgaaattggaacgatgtgatggaaaagttggaagtttgaagaaatagtttggaactaaacacggccgaagttcttttcatctacattatcttcttagccaatcataaccattctctatttaatttctttatatattttcttttatcaacaatgacaacttttttaatgatttttgtatattttattaatatttgctttgatcttaaaaacaagatagtggagaactaaggcatgtttgatttagattattagatggattatttagggataaattacttttaaagtaggcttaaaagatactactagcttagaccaaacggtcaatacagtgaaaataatttaaattattgaatggattatcgatttagttgtagaaataaaattatatatattgagaaataaacttgacaaataacttgaaacaagcaaaaatgcataaattattttagaaaaatgtagttttagaagtgtgaaacaaataatttattttatatttcgatgaataagaaaaaaaaatatggcaccatcaatccttaaacaagtcattattactcgttcataacgtgtccaattgcctacgtttgcttgtgccatatcataagacgactccgcattttataaacgagtcaatgacatcgatgttgcgagtgtttataatgggttttattgctccttgaaaccatcaaggataagttaaccaaaaaaactttaaagttttattgttaggtgtatgtttgtttatactttaccctcgtcaaagaaacaaacatgtatctaccgtagagaacaaatcaatcaatgcattctagtagtgctaggtggtacttggattcagggactaaacctgtcatatcggatgaatttggagtattaaacatgaactatttactaattacataaataagagctaattcgcgtcacaattttttaagcctaattaatccatataattagcatatgtttactgtagcatcacataggctaatcatggattaattaggctcaatagatttgtctcgcaaattagtccagggttataaaatgagttttattaatagtctacgtttaatatttataattagtgtccaaacatccgatgtgatggagacttaaaaagttttaatcccttttaaacggggtcttaatcaagcatgtatttattactactccctaaagtagtggaaaattaatataccctccttttctaaatacagtaactaatcttaaattctgctctttggaattatgaccacaatctactcttaaatgttaggtaaagtgaacgaaatttcgttcttacatttactccatccattcctaattaattttttcctaatcatctttcacaatcaattttcagcatcatgagattaatgttttaaaattcattgtgtaatatttatataatgtactccctccatctacttttgatagtcatattccatcttggcacacagaccaaggataagtaattctacttatcatctatttaaacatgctaccaaggataatatgataggttgttgaattgaaatatgcctatcaaagataaatttttcagatttagaaatatgactatcaaaagtagatggagggagtatatttcacatgatattgaactataggaatttctaaaattttattattgttaaagatagatatgttaacttacgataaagctaaatcaacaagtaatatgaaatgggaagtatatgacatattacacttaaataacatataacattttttatggtttgtaaatacttaaaagaacaaatgatcaaaattttaaaggtggatagtgtgcctaacgttggttattttgtaaaaaggtgacgaacacactgacagccgccaagaagtaattcatccggttttataattttaaagttttgaataataacacgatctacaaaacgcatctttaactatgattttctcttgtaatgcatataataaataaatatttaattttgttacagtatttttaataataatctatttatattttttaagtgcattcaaacttgtaaatattttagaagatactaattgttaaagaaattttaatagtttgactccagctgaattaaggaatcggatggagtaattagcagaagagaggaggtgcggattgcaaaagaggcatggaagtggttggtcgattgattgatgtcgagtttaatggcggtcggggcccacactcacactcttcctgcatctgcatgcgaacggaacggaagaagaaatcctccgttccgtttggactcgccaagttggggcggtggagtgggcccacgctgtcggcgagagcagccaactcggaccagcgacgtggcaaccaccaccgtccagtgtcagcgtcagcaactgagcatattctaccaaaatcatcttcctcctctcatcaattattattatgcttattaaggatcaggaacgactacgtgcacaggattctaatctcctaatccgattgaaaacatgcagagattcttccctgcattctgaatttctgatgagagaatcaaggatatgagcatgaacgtgcggataacaaaaaaacaataacaatttttagaaacattaattctctctaatactccctctggttctatattaattgacgttttgggcaagcttgaggttaaacttttataactttgaccatcaataactttaaaaatatttagtttaaagaaactaaaaaaacatatatagatttgtcttttaaaacactataataaaagtaaacatgcattcatttattgtatatattataacagaaaaataaggtcaaaggtatatcttgtagagcgtgtcattatccaaagcgtcaattaaaatgaaaccggagggagtaactaatgtatgcatgtgtgtttccttgcaatcgtatctttttctccttttatttttccttttcctttttactgacgacagcacctgattcaagattctaatgctcgcatcttcaggcttttactaatttttttttcttttcatcagtcttttttgaactcgattcttttctcttttcttcaagagcaaaactcagctttaatctactttctgcctgggccgggattcacacactgattaggcaaggagggtaggcgatagattatactactgtatactgttgctgattcagctagttgtgttgtgtcattaataggaaattaaccacagcttgggagagctctagctaaagaactcttgttcatctactctcgcgtcgtcctcccctggggcggcacgggaggcgacgacccagccacccatctccctccccttcttcccctccgcctcgccgccgctcgagcggccaccggcaaagccggccggccgcaaggacggcggcggcggggcccctcaccgacctttcaccgggcaggcaggggagccgccaggcgggacggcggtgaccgccagatccaggccgctccggccggatctggcggcggggaggacggcggccacggcggcggggatggcgacggcgaaggcaggggcgcgcggcgctaggcggcggcggctgaaggcaacgggaatggcgatggcggcggggatggcgatggtagcggggaaggaaccggccgcgggcgcgaagatggtggtggtggtcccgtgtgagcttgtggtggcaacggcgcggtgctcctcggcggcggcggcggcagtgtcccccagatccgcgcctctcggccggatctggagggtggccggcggcaactggcggcggctgtgcggcgacgacggcggcggtgcggcgacggcagcggcggcggtgcggcgacggcagcagcggcggtgtggcgacggcagttggcgacggcgacggcggtcgcggtagttggcagttgcggtgttggctggcgatggcggcagtggcgcacatggcatggggcggcagccagccgcatgctggtgaagggtgacggcacagcggcaggttgcggatgcgggggctggagtcggtggcagcggcgacggcggccgtttgtggaggcggtggtgacatcagcggcgaggcgaggatggcgacggcgaggaagctgggcgttaggcagcagcggctgcggtggtggtgaccgtgtctgcggtcactggaggcatggcggcctcaaacggctagctgagggcgtgggaggcgactacatctggccggcgcggcatcgtttggtggaggggtcggagaccggcttggcgcagagaagcgcagccgatgacagcggaggccggctcggcgcgagaggcgcgagcgacggagatggaggccggcttggcgcgggaggcgcggccgatggagggagaccggattggcgcgaggcgcgtccggtggaggaggccggcttggcgcagagtggcgcggccggcggtggaggaggcgacctaggggtgagggagagctgccggtgggtgtagcgcggtcttcagcgctcgaagactggccggcgggggacgccggtgcaggggtcccacatgtcggcaaagcttgtgtggtggtggagcatcggtgcgtcaggcgtggtttcgcaagtggcgagcggtgggtgaaaacccagtccggccttggtcggaccgacaacgatggttatcccccctcctgagagcgttgtcgtgctgtctcacccctctggtgaccttgtctgtgtccctttgttagcctagtggcggtcggtcacgcttagcggcggccggtccggtgttagccttctcctgggcttgtgtgatggcgttgtcgccgtgtgggtggtggtttattttttcctttttcctggttacgaccctccagggttgtaaccttgtaattttttcctactctatcaatagaacttcgcaccgtctcgtgcgagtcgttcagaaaaaaaaaaaaaccacagcttgatacaataatccagggtaataattgcctgaactgacagttcattcatagagcgactaaaatacttgcatatatatatatatatggtatccccatattgatcctttgcaatcagctggctttcatgtgcctaggcacattggtttaaagaaaaaacatataaagaataactgagacgataagataatgcaacaggtggctaaggttagataatgcagcacgttctgcaagaattagcaacagtaatcttgcctgcctgccatctttcggcgtttagcccagtaatcagttttaggttttgagggtgtactcttctgcttggaccagtcagctagcagtgctgacctactactaataataagatacttgtactaattattaaaagatacagtacttactactaattggagtactggtagtatggaatatgtttagcacctgttcattacaacaagtactactgtactaatagctgttctgtcgtctaatggtaactgtacctatcatatagcaggtggcttggagcttagcaagggaacagtactagtgttagctgtattaatactacgactatcttacactggagagagaacagctagtgacacactaaccaatcaagctgtagtagttcagtagtactagtagcttggatcattttgccatgaagttagctagatgccaatcggctcagccattcattatatactcctacatctactaaaagattaattagagtggaacagataatctcagcattcttcaaggttagtatagtattaacagtgtcagagatatggcactgattagatcatactgtcgagatgattcaataatactgacctatagctctttgacactgtatacatgcatgttatgatcaatgtgtatgcagtaggttttgcaaaaccatacgattatcatgcgtttattattagtctccttagtttttaaaaccacaataaatcttacgataattatacgattaccccgataaccgtaacccattcaaaaactatttgatgaacgcacacgatgctttacgagagaaccttttcagatacagatccctgcttccactgcattgcattgttctgatgatcggtcagaaattcagaatgaatgactctgaagcagcattgcagttgagttgatggaactttacatggcagagcagggcagctaatgacaaggcatgtgaacggcactttgcagctttctgtctcccccttgattagcacagagatcagcaacctttggattttttttccctattaatttattgatatactcgagcctgacagccgggacattagtattagtaggagtatataatgagtatttaatctactcaaagcagggcatgtatatataagtagtaaaagaaaaagaaaagtgtactatatataggcaacagtaattacagtatgaaatttggagtaatacactaatactccctctaacccataatataagacgtgatcaaagttggcacggtctccaaaacaaatctttagcttacaatttctcatatactataaaatttgtagcaacaaaattatagccatatgaaagtaaatttaaatctccatctaatgatataatttttactcctttcattccaaaatataaggcacaaccacccttaacccaaaaaccaagaaataattattatcatcttgtagtttgaatcatcctaataaatataatgcatgcatccaataggattagataacatgagagtagaggatttaaaaaagtaataatttaatggagaagatgccatagttaattgcatgcttgcatgcatgccttatattatggaacatctaagaaaaatggttgtgtcttatattatggaatggagggagtaacaaataaaatttattttatattatactaagtgttggtcaaatgtttttgttttaaaggttgaatcttgaaatacgtgcacgccttatattatggaatagagggggtactcattaattacattacatggtgaaattggtttatcttcttgcatgtactccatacaacaatgaccaagagtattaattagtacaaccttgaaattaaactcgaacaagaccataaaaaggcccaggtttgactgcttggccctttcggatcacacaaggaggcccaccacgatctggcccatgtatattacgggctgcacgtaggtgacaatccccaagggcccctatttaacacgatttccgtttcatgggcctcacgacaggctgagactgcacagagaagcccactctcgcgtgcgcatttctcacgggcagcaccctttgggcctttggcatcccctgtgagcaagggtctattttaatgtaaaattattcccctcaatcccctccaatactttttaatccattctaaatcgaacaagacctaaatgtttcggcttcgttggttgggagctccggatttatggtctatgcttttcgactccaaatgatcgcatgtatttctcgtagtcttagaggatgtttggatgggactaaaaatttttagtctctttcacatcgtatgtttgacactaattagaagtattaaacgtaaactattgataaaatccatttcataaccatagactaattcgcgagatgatctattgagcctaatcaatccatgattagcctatgtgatgctatagtaaacatgtgctaattatagattaattaggcttaaaaaatttatcacgcgaattagctctcatttatgtaattaattttgtaagtagttttatgaatatatataatgatattagtgtcataaaatatgttgttttactcgggagggtatgtttcgggttttcattggtttttatcctgagttgaacatggaggagggcctgtaggaggcaagagcttgggccaaagaccggggaagctaaggagagatagggaaacccaactgctgccggtcggaacggacaagaaagaggtggggataagctatataagagataaggccgattcaattggaaaaacaatatactcacaatccaatctagccaattgaatcgttttttcaatattgctcatagttctagcctagttcatccatctttgtcgatttgcattgtaaatcgtctgccttcgccgcaagagtgcgaaatccatctatcccgtaaacctttcgttcacccacaagacgggtgtttatcgcttgttctatctaaatcagctccactagctggtttaatctatcaaaacctattttgatttagcttttgctagattggggtggttggcgactctataccaccataagacgtttagagtgtgctgattgtgattgtcttctcgccgaaaaagttaccaacatgatctaatctaaataatctgtaaatttaaaataatatttgtgttaaatctacaaaatatgataacactggatatcttattatatatcgtggtataactatatatctcttgatcacgtaatttattctatctgatctgtaactagctctggacaataacaacaaccagaattaattagcaatctcgaaagctactaattaaccttgactacatgcttcacctgcaaggtacagttatacctacattttacatgagcaaagagatgcacgcatattgcttgtttttgaaaattttaaaaatcttatagtattaatttgtatttattgtcttttgcaagtaagcaaagtgtttggccgagctataaatcttaaattgagatggaccaaacattaaaatatatggagaaaattaagtagagtggagctaaaaacaattacagaagcatagcggtgacaccctgcttcgtaactctgctctacatttattttacgaaaaattaagatctacttcctccgtttcacaatgtaaatcattctaacattttccacatttatattgatctatatctagattcattgacatcagtatgaatatgtgaaatgctagaatgacttatattgtgaaatgaaggaagtagaaaagttcttccggcatatatagatccaaatccgcagtggagaaaatggatcactcactgagacatatctgaaatgcattttccctccatttgcatcactaatttttaaagttgtttcataatataaggcttgcatgcaaacatgtcattaactagcacatctttttcattgaaatattattatttaaatcctccatcattaagatctctaattttattaggtgcatgtattctattaaaatattattatttaaatctttcatcataaagatctctaattttattgggtgcatgcattctatttatcagggcaatctaaactatgagaagataataattattttttggtctttgagttaatgatggatgtgccttatattattttggaatggagggagtaattcattagcagtattactaggagcactgctacacgtattatatttcttttacaaaactcttacaaacaattatttcaaccatttgatttaaatagatggaagttatagaaaatttagatgtcctcaccgcgtgacacatagtgttagtaagagtttagtgtgacaaaatttagtatgtatagacttttcttattagtagcttccccgtcatatacagccacatgccgtcggtccatttccaccaattaatggacgagtctgcgggtcgggcgcccgatcggtgtggagaaaaatcgggcgctgacgttagcatgacgtcaacacccgatttacttgcaaaactactttaaaatgattttttttctcaaattaattatccaaattataatccgattgcaccattaaattcgttgcaattaaatcttcaaaacaagaccacacatatatatatatatatatatatatatatatttcgatgaaaatttttttagcttattattgaattatttttaaatgttgcacgatgttccaccgggtatatcggaattgtttcactaagtagatcgaaaatgtttcactcgtttaaatcgtgttttgtttcaccttatataaaaacaatgtttcagcaaatagcgaaagaatgtttcagaatgtttcactcgtttaaatcgggtgttgtttcattaagtagatcgaaaatgtttcactcgtttaaatcgggtgttgtttcaccttatataaaaacaatgtttcagcaaataacgaaagaatgtttcagttcactgcaatatttgatccatacatagtaaaacattataagaacgctaggtgaaacatttttcagtggaacaaaaaataaaacgaattcccttaatatgggtttctaaaatatgtgggttttttgttgcaatggaatatttcagttcactgcaacgttagatctatacatagtgaaacattatgagtacactaggtaaaacattgttggtggaaaaaaaaaccaaattcccttaactaaaggtttctaaaatatacgagtgatttgttgcaatggagttgtgtgtgtggataagtggcaggtggacagggaacatgtggtgggggccaggtacgcacgtgatgggaggagggggaagctatcgactttttcccctccccgcgcgaccgagaaggagcattctcggcaatcaatccccaatttaatttgtgttgttgaacatttcctcctcgatatcctgtggacctgtactctcgtatcggaaccaaaacaattatggagtgataacacgcacgtgattgaattatttgcagtccgttaatgcgtgtttatccgaagaaaataagacatacagaaattttttaaaaaaagaagaaaatactatattgaaaccaagttaattaattaatcaattaatccgaatagctaaaaatatatcgggaataataattaattaactaatttacagaaacaagcgggacactcacgctctatatataccaagcccacgcgcgcggccgccacgtgccacggtaaaagctgagccgaccgccgccgccgccgccgccgccgccgccatcgacgacgacgacgcaagcttcccacagtggtagtgtactccggccacgtacgccatggccgtccccaggagatcagagatggtggccggcgataaaggcgccgtcgaaagctgcaggaaccaccaccacggagaatgcgccgtcgacctcgcctcgtcctgctgcacgtgtgcgccgcccgccacgacggcggcttcgtcgaggaagaagagaccgcgcgtcgtcgtcgccgatgagacgacgacgacgaacaccgtcgtcgacgacgacgatgaggatgacgacccgtcggccttgctgcggcggcgggcgaggtggaagcaggggctggaggcggtgaagacggccgtggcgtggcgtctggcggcgaaggacgacgagatcaggcgggcgcgccgggagatggcggagcgcctccggtgcgcgtgggcggtgtcgcgggcgtggcagagcatcgccgtggcgcgggagggggagaaggccgcgttgcagggcgagaacgccgcgctgcgcgtcgagctcgaccatgtgctccgggcgaagccgcggtggcaccacgacgacgacgacgccgagtcctgctgctacggtgacaacttcaccgacgacaccggcggcaaggaggaggacgagggcggcggcgacgcgagcacggcggcgaggtgcttcgggtgcggcgagagagcgtgctgctggcagtggcacctgtgcgccgcgtgcgcggcggtggcggcggcgtgggcgtgcccggcgtgcggctactccaacatggacatggacgacacatgcatggtgtaggaggagaattgaaggagatcgcatcacatatcatatacatagctagcttcaattcttcttcagttgtagtgctagatttggttattcaatttgtgaacacaaatcttgtcattcgtaatagtttggagtattgatggatttattcttaatttgttaatcgcaaccccttggatagtgatacatgtccctcttaattaatactccgtttcatattataaagagtaaatttcagaaaactactactatagtgataaaactatcagtttgctgcaacattagcgatctatttcagtttgctacaacaacagcgtgggaaattattacaaaactgcaacttttacgtgatatgctgctacagttgtaagctacagttttgtgataatttccaacgctattgtcacctacatatactgtagcagcatataacataaaagtttgcagttttgtgataatttcccactctattattccagcaaacgactaaaatagatcgctaatgtggcagcaaactgatagttttgtcactataattgtagttttctaaaatttactctattataaatgtttgggtagtgatatgcttgccacttaattaatacctcctatgtttcatattaatatttcctccgtttcatattataaatgttttggtagtgaaatacttgccacttaattaatacctccattgtttcatattataagttgttttaattattttatagtcaatcttatttaggtttaacgtaagtttataaaaatatttaacaacattgtcgacgggtgatacccgtagaccggatatagagggtattggggtacgttggtataaggatctacgtaatacgacatcaagcaaacaaaagacgaagattatactggttcaggccccttgacaggtaatagtcctaatccagttgatatgggattatatggtggaaaacacaggttacaaaggggacaatggaacttgtagtcgagtcggatccggcgagatcgtagtcgagttggttcgactagatcccgatgacttggctccttgcaggctccggcttcgtaggctgtatgagttgtgttggctctgagagtcgatgccttaggccctccctgaggggtcccttttatatcgcagatctggaggtttacaagtagaactcggagatatcagaccctgtacgatacattaacgactcaatcttgtccgagtaggattcttcccatccatagattctgtgagggatttccttagagtacgcaggaagtatccgtatgcgcgtgggtataccataccgatatgtaacgtatatcgaagggtaaagggtatgcctaacccgtaaccctgacaaacatctgttatcaaatgcttcgtttgtatgaaaaagtttattttatcctcctcaactatgagacatgcggacgcatctttaaaatacagatgggacgaagaacaaaaatgttcactcgataaaagcaatcaaacataacatatatcgtatttatagttcaatcatataactgcctcaatcattgattatggcataactaatctgttggacgttcccacctacctaagtgacattaaaaaaataatataaaatataagtggaagccacatataagccccacaaacacgaaaatcaaccagctagcccctctctcttcctcgatggccacctactagaaacaaagtaatactgttttcagtcttgtgttacataacacatgcagttgaccatccaaatatttagtcaagcgacttaattaaatgaaattcacatgctctgtatgcgtacgtacacacaactgatcatccacatcaaccacacatgatcaatcaattaatccatgaatccatggatatactacctccgatctcttggagttaattaattaattaatggacctgattattgagtgagtggagtaaactaattatgctccttagctaaccgtagtttggtcgttattatctttcaattaattgccacatgccgatggacacggtccacacggataatgctacgtatatatatggttaagatatgcgtgaccaggccaatgtttgtccttggaatatactcccgtatgtcgtcgttgactttttttaacaagtttgactattcgttttattcaaattttttgtgtaaatataaaaatatttatgtcatacttaaagaacatttgatgataaatcaagtcacaataaaataaataataattacataaattttctaaataaaacaaatagtcaaacgttggacaaaaagtcaacggcgtcatacattaaaatggaggtagtataatttaattgtactatgacattttaatatagtttaataactatagttgcttcaattcctgatcgaagtgaaaagtcaaaaaggaaacttgacaaagtggactgcaagtctgcaagtgtcaccgcgtaccattagacgtactcactgctacgtgtttcttgacggacccgtaacaaatgaaccattaaacaaactaaaactgtcaattgaaatataaaaacaaattaaggggaaaacgtgtttctatcgacagggagcactcgatctcgtcatttgaccaaaagttagatcggcgcggttaaaaaaatgctaatgaggtcgaattattttaatctaagataaaatttactccctccgtcccataatataagggattttgagtttttcttgcaacgtttgaccactcgtcttattcaaaattttttgaaattattatttattttatttgtgacttactttattatctaccgtactttaagtataacttttcgttttttatatttgcaaaaataattggaataaaatgagtggtcaaacgttacaaacagaaactcaaaatcccttatattgtgggacggagggagtaccaattaacgttaattgataagaaaattaattttgtcctaataatattgtggttcagtttaatttcacatcgtatgaccacagtgataaaatctactagtgtcttaatagagtagagtagtacatatttatctattgcaatatatgcttattggtggacttggaccatcgctctaataatttaaactagtgatagagcttagcctgatcatacaaccacacctcaaacttcaccaccaccggcgtgtgggagtctcttttagcgtgtgaatggcttttgttgagtgttgagctcggtcgtcctgttcttgacttctcgtctacttacttggtagcttagattagttggtggaatgtatgagtatgatagttgtgtggtttttaccccgttttcgctaattaattctgtatttatggcatgatcatgttatctccttaaaatggaacactcgttctttatataaaatgtcagcaacagtctgaccgttcggaaaaaaaaaacaccaccacgtactggtgatatagttagcgctatatttttattatgaaatagtattgcccgtaatcaataaaaacacttgttaattttgtaggctcgaaaatactatttttatgggcttgatgatgacactggctctgcaacaaaagtaacactgcgactagtgttatccatgtcgtcaaaagctagctggtgcaggatgcctcgtgtgatcttctcccataccttgccagtgagcaaagatggcttccctgcagtgttttttgtttttatttttacgcgtgctcgcaaacaaaaagaagattccgtgaaatctatcgcaattttccctcccctttcattcaccgtactaactttatcttctctacagaaatttaaaagaaaagtatttcttttctacatacaaatcaatatttcttcgtcgagcgtgtcaggaaggaaggaatgttccgtgctgcctaaggaaccgctcccacctttcccactgacgcgcggggcccgcatcgccatcgccgcgtggtggcgcaccattcgcgtcaccacaactaacctcctcccctctcccctcgccgcgccgccgccgcctcggctcgatccgcccatatatttcccacgcattcatcgcgtcgtcttcccatctctcccagatcgcaacgaatccaatcgaatccaatccgaattcccccccatctctcctctcctcctccaaaaccctaacccccactccccatcggagagagatcgagaggtggttgtcatggcggagtgctcctcctccgacgactgggtcatgctcgactccgacaaccccgccgactcctcctccgacgacgactacgtcctcgcgctctcttcctcctgcaacactcccgcctgctccgacgaagaggaggaggacgacgaggtggggagcgacgctgacggcgacgacctctacggcggagaactcgaggaggaggactcgccgcgcccgccgccgccgaggccgctctcgggcctcttctaccacaccgcctccgacaaccagcccgggtacctcgccttcgacgccatccgcagcgccaagcacctcatccccgacccgcgcttctccgccttaccggagcacgtcgccgtcctcgcctccacccgcggcctcgtctgcctccgcggcgagaccaccggctcctactacgtcgccaacccggccaccttcaggcgggtgcgcctccctcgccacacccgcgaccacgtcgaccccgccgtcgtcatcaccttcgaggagcccaccgcctccgcctcctgcttcggcggcatcggcgtcgagcactaccacgtcgtcgtcgccttcaacctcgggggcggcgtctggtccttcgagtccttctcctccaggacatggaagtggcgtgtctcccccgggatctccatcgtcgagcaggtcgagtccttctcaggtgtcggcgcccacggccgcgccttctggcgcacctccatcggcttcgtctactacgacccggagaagggctacccccacgagttccccgcgccccccgaggtggaggcccggccgttctgggagatcggcgagatggagggcaacctctgcgtcacctgcatggaccagcgcgtcaccgaggtggcggtgctcaacctcgacatggacgtcctcgccgccgatggggtcgggtcgtggtcgtgggccggccagttcgagggcagcagcctcaggaaccgcgagggcgtcgagctgctccgctcgcagggcatggcggaggtcgtcatgtgggacccctcggaggagcgcgtcgtcgccatggacctcgaaggccgcaccacccgcaacatcggcccgctcacaggcgaggactactcgagaggtttcatcccctacgttgcctcaatcgccgaaatctccaggtacctagctactggctactgcattcgattcgaatttgccgctcctacttgtgaattaattctgtgatgtgttgttaatcttctgcatccgattcgttttgatttgccactcctagctacttgtgaattccgtgatgtgttgttaaacttctgcatccgattctatttagcagcgctactcctgatgtgttagatcgatgcgatcgacgagtcaattggagtttcgtaccaattcgtcaattcgtgtattgctatcgagttggtttggatctgtagcccattcctgattaattggcgattagttaggatttctgtaactgctacgtacgcgtcgtttttagctgagtttttgcagtgccagtacgttttttgagttcgttatagtcagatccagacaatactcgcaggatagcttgtgtatcgaggctgatatcagcctactacattcccaaacgaaacgtgttgttgacgctttaaatcgaattgggatcagttgtctgtaactgctacgcgcgcgtcattggtcagtcgttgtctatgtctagatgatgcttgtggagttgtgatgtactgaaatgtggacatggatgcatgttactgtggagtggagttgagtggagctgatagacaatagataagatctctgtttgaccattccaatggcttagctggtttgattttgtcagtcttcaatagactcccaaagtcggtctccttacccgagtttaattaatcaaccgatgataagatttaatggaatgagacccggcaaaaaagataagatttaatggaatacattgtttatgttacttccatatatgatttgttattaatataagagcacaacacactggaatcatgcattgcaatttagtttagttaatgatccaaattcttactgtattaaattgtccgatgtcttgtttcccatatgtgtatcctgtacatatatatcctggcattaccgcattagactgagaatgagtagagatcgatagctcgtcctgctttgtcatctgcttaggtgtagacattttaccattaattgctgtctgtttcattgattacttgaaaaggtgcacaattttgtgataatagtcatatctatttcgttacattataattaaatttctatacccatttgtatgcaataaatcatgcatgggcaaaatctgtactgtactgaatgacaatggtttgcacttgtgcttttgagttaccagaatttggatagttcaccattgcatagtctgagtaaatattcagagcaacaacttctaatgctgctgcaacagagtaacaagtactctttagctgaacttttctgcatttgtgtgatacatgattagttggtcacggactgtcaagcgcatgcagctttgcattcgttgatgttgatgtgttatccactaacagttgtgtgctctgcttatgtttatgttgtcagcgatcaaataagttcaaagtgctctgctagtgctgctgatgccaacacgcccaatcttggagcagcagatgcgaccacgctcaacaacctcgccgcacctgctgcgcaagttcactgaagcttcaactaatctgtaagtcgtatcgtatctcgtcaattccaattcagacaaataacataacctgattgattgattgataatataatctatctgtgagatatgatgatactctgtttgcattgcaatttatttatcggtggcatgcatggcttggcaggtaccaatagctagcaggcagacaggaagattcgttgacgatgaccaggaataaacgaggctagctttcagattgatttgtccagcataaaaaggaaagcgaaaaggcatccttgattgagtggcaactggactactactgccataagcattctttttgcagctactccgtatcggatatgaacactaagtatctttcttgttaggttttgcgtctgccttgtaaatattagcagtagcaggctcccttttgtgtccgtccgtcgaactatcattgagtccttcttgagttgcattcagtcagtcagtcagtcagtcaggtccaaactagttgatcgagtgggtaaactttgaaactaccaccgtctctggtgttcctgatatgtcattctggctgggctatgcaattatttcttttgcttaacccattcattcatttttagtatttcctttttgttattccggttgtttctttgctgtttggaatcaaccacccagcaatttttgctttcctgggttatgacttcttttcactaggaataggaattaccattttgttgtacagcgctttgttccatcttccatggactgttgtttgctttgttccatgtactgattgctgctatacaggagaatgagcttcatatgcaccctgtaattgactggtgcaaagcttgttgacgctgcaaccccaataattgtttgagatgtgtagatggacaatgctaatatatgtactatgcttggtgcttttgatttggttttaccaatcctaggatgtattgcggacattgcctcctcctgttgttgttgttagttcttagttatataatgtgaagcgagtaaaagtcagtcagtcaatttcaggaaactgaaatcaggagatttagtgaagaaggcctgattctacaaagcactgttgaaatctacaaagctgctttgctcaaatgcaaagcagatttgattgatttgagatattgaggtctacggagtagtggcttgcacttgcagcggaataagctgcctacattctggaatctggagattcagatacctcaggtacatctccaccgcgcagaccacaacgtaccacatgacacagtgccatatcaatcgtgacaacggaaagcccttgcaactatctaaaatatgttgttcgatgatagtttcatcaaaatttacatctatgaaagttattctagcaaattaacatggaattttttttttttgccacagtcaacaatagacataatatcaagcacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28824 - DNA, 16617 bp, Oryza sativa
  unsure (1)..(16617): unsure at all n locations
ctaaactcgaaattaagctaccatgaggcagtgttaagaaaggatagatgctctctccctccgttccaaaatatcttattttaagagtaaattgcattggtggtacataaacttgttagttgggtgcaatttagtatataaacttgtaaaatgcttgtttcagtacacgaacttgtctagttcgtgcaaacgaggataaaaataacttggcaatgttaattttacgaagctgatgttgattaggatatgacgtgcatacgtgtagtaagtatacataagacatgcaatatttataaatttggtctctaattttatcttttatcatggaaaagatgaatttggtatatttctaacccttataccattgctcggttttttaatctttttctactatcgctatatcctactctattttttattgaagcttttttattgaagaggtgtatttctaatagcaaccttctcagatatatgtttacatagtatcctaaccagccctaaatcaataagattagccatgttttattgaagaggtatatgtctaatagcaaccttctctcagatatatgtttacatagtatcctaatcagcccctaaatcaataagattagctatgtagtgtctttttcaccttcctccgcacgcacagacaagttcatataccaaagcgagtattttacaagttcgtgtactagattgcacctacctgacaagttcgtgtaccgatgattcaatttactcttattttaatatgggatgtgatataatcgtagtgttaaaatgtgtcacatattttactaggttaatttattttgatatgacacgaggataatatttaattaaggtcttgtttagttctaaactttttcttcaaacttccaactttttcatcacatcaaaactttcctacatatacaaactttcaacttttccatcacatcgttccaatttcaaccaaacttccaattttaacgttaactaaacacaccctaaaacacaccctaagtactgtaaggaattgcattcaccgatgacaggaagtcttgtcgtaggagaagcactaggtccgtctttttgagtgaatatgcgtttctgagtttgagccagccaagaggttcatggtaccaatgctctattattgcacaagagtgcacgtgaacacgtcaccctgaacggcctgcgcagtgcgcacgagagccaatacatttggttttgcacctttgcttatcacgggttaatcacaaattatttgctccacacttttaacaatacaatttcttaaaaaaaaacgttttctagtgtattgattaaactacttattctaagttatttgttaaatttatttattaaaatatttaatttatacctttaataaatatataatgtgcatcaataatacaataaattattaataatttggttcaatcactgccatagatgagcaaatgtagcagttgctagctagctactagctagtagtagtaccacttatatatgttaggttcagctctatgctagttgcagattgcatatgagggccattcctttggatccatatgaagccgtatatgagttataattgcactttcgcgcgcgaaatgattgttcttcatgtatatttttttaaaaaaacgaatgttcttcctatctcagaaaagaaatctatctcctttcaaccgcatataaatagaaatagttggttgtaactaaacaccgcatctacaaaccttaatcttcactaaaccaggatgatctaaaaaacggtgggcgcgacgcataacattgcttataaagcaagcaagaataaaatgatcactctaacgtgtctaaataagtttcagaaccgtcggaccaatcacagccacatctgatgcgatatatagggcccaccttgttagaactcgacgtagatggaccccccgaataacctataatatatataaaatattgttatccgttgtcgtcttgcaacactaaccatataacacaaattgtttgttgtagttttaataacttgggaataaaatgttcagacttcaaaatggttttgaccaatttcctcctatctcaagacatcatttctaataaacttaattaggtgacaaaagaggacatagattagagagtaaataactttgagagatgtggatatatatgcatccctgcgtttgttggtagctcaaatcattcgccacaaaggatcgccgctagcgattcctcgggcaactgctcttgcactgtttcaggctttggtgcagagctcgaaattggccatgtctggccaatggccatacgccaaccgtaatgactgcagccgttgtcatgtgacggccatactgataaatgtcgccatagtacaggacttgcacgttgcagcgtagcaaacgagcataggatgcagccttcccgatgtggcaagcagcagatgcagctagcggcaagccggccggcgacctggcttttaatttccgggcactgttaacttttggccatgctaaagtctcgtggattccaagtgtcaatcatcgtctgcatggcagagggcaaaaaaagcaagatcttgtccaacaaaggtaaccatcggtggttatagctttgaccatgggtgcaaagcacaacgatgagtatcgttggttgaatggttgtccagcgtttggattccgttctcttggtaattggtctagtagagcctaagtaaacatactttagagaattttgtggattaaataagtattaataatttgttgtttttaatagtttgatctggcacaacttaaaataaatcaggtagatgaacaaagccgtgcaagctccgacaaattaaagtaacctagctagctagctagtaagcattgtatgagtttagtagataaaagataagctttgactcttaaccaccattcaacaacatgttaacccatgacatggcgttcgagagaagtttctcgaaatataactgctatgcatgtgcatccaatcaatgagataagagaggatagcataaatattaacacgaatcaggtcaatcacgtgtgggagattcgcattgtcgataccctttatctgtatgaccaattttcaggctataggtttcctacttttgtcgatattgggccactctttgttttattaaaatagatattttaatttgtacaaaaaccaatttttagcacgactatgaactgcatcattatttcggcttgaaatctactatgtaaacattataaactttcaaataaaactatatgcatagtttctatatatatggtgaattccccctttaaagaaatgatgaccagactgggtttatcatgaatgctacaaaggttttaggccatgtcaacttaataattgtcgtgtagtgcttgcaaattcaagtggtatattttttctaatctgcccatgaccgatgctgtgtgcctgtgtggtggactggtggatcatcaaaacacgcgcagagaactggttgcaatggttaagtttccgttaatttgttaccgcaatgacaattaacagcacaataacgtgcatgagtatagtattttctctaaaaaaagattatgtattaaaaccagaaatatggtgcccactagatgagtggaattaatatatcatattaagaaatgtagcaataaccatcattaggcacaggatgttcttatcataaaatatgcattttggtaggacctttgattagaaatttttctgtttataatatatttatttgcaaaactggttataataatatcgaatagattaatcaaagataggaataaaggaaacgccaaatagtcaacattaacaaaccacgaaagattatagcatactactctaaatgaaaaactttaaataccacatggaactgtgctcttaattaattgtgtctttggcaatatataacactaggaacttctgctatatgttggactctgtggttgtgcagaaataatgtggtttttgataaatcaccatctattacatatatgcaggtaatttttagggcaacatactggctccggctctggactcaactacaaaggtctaatgaagatggtgagttcataaaagttgcatgccagaaacttgagacgatggttatgcaactctttaccaattttggatggagattcacaaatagacttcaataaatgtgttctccttatcttagtttggtctctctttaaacattggtgattgttttcgatgtctttgatgttttgttgaactacactcttctagagtgttagattgtaataattggttgtagctctttgagcaaaggccggaatgttattccattatctaaaaaatataaactaggatacgggcgctcgcgcactagtgtacctggtgcgtattatgtagaatctgtttaatatgcagagcataatcttttttgtgttttcaatataagaaaacttactacatttgttaaataggataaatatattcttctatttaaaagtatgtttgataaatttacattcgtaaaataaaatgtgtatatgtgaagttttcatcctacttttgtccttcatatatctatacatttaattatgagtaaagttcatcaccggtccctaaacttgtaccgatgtatcatcctggtccctaaactcgcaaatcaaccgtttaggtcctcaaacttgttcgattgtgttatccaggtccctaaacttgcatatcactcgtttaggttctccaacttgttcagttgtgtcaccccggtccctaaacaggacggtctaaaaactttatatcaaaaaataattcataactttttcatgtgaactctaatgaagacaaactttatatcaaaattgtagccctcgacgcgacctacaactttgtagttgaaaagtttttgaattaaaactgtttagggtcccaaaatattgttgcatgtttatagattttgaaattttaattttaatattacattttgggacaaaaaatgacttataataaaaaaaattcaactacaaaggtgtagatcgcgtcgagggctacaagttcgatataaagtttatcttcattagagttcacatgaaaaagttatgaattatttttaaatataaagtctttagaccgtcctatttgatccagatgatattcaaatccaagtttagggaccggggtgacacaactgaacaagtttgtggacctaaacgagtgatctgcaagtttagggacgggatgacacagtcgaacaagtttgaggacctaaacggtcgatttgcgagtttagggaccgggatgacacagcggtaaaagtttagggaccggtgatggactttactctttataatattgtctcgacagtttggatccagctggcgaatcaagccacagtgcatatttgttttaggtccgcttttctgacctaccaaatgggctgagaggtcgagttcacgtgaatagatgtgcttttattaatggtactcgtgataaccccctttatattgatcacctcaagttgatccgttccactcctatgccgcttgttaatgtacttgcttatttagatgagtgttttttcgttactatctccgcagatgcatcatgattcggtaaatatataaaaccatttctttttacatgactaaagctaaaacccaatatccttccctttgttttaaaataatcaaacacacaattacatagccatgggagagatcgaacaagctgtactgtgaatatgtgagtatcccaaacggttttctttgccaaactcacggcagtgcaggccataagcgtgacacagaggatcgatctaggactaggacagcagcggatccgtacaccggaacttttaatttgatgaagtagtactaaacatggcagctcgaacaaaactaggttttagagatccaattcatggtggaacccatgcatgtgagcaccacggggtgatgcctcaccaaaccgccgtgcttatctgactcagcctccccttaaaaataagagacaaagaccacctgatcatgtcgaaaacgtcctaagagaaaggataataatacagccagctgcttacttatagcctatctatcagctcactcgtataatggttaactcttcactataaatatatggttcacatgtctgtctcacagattttcttggttcctgtgcctaagccggctgtaaacttacagcccgcttctcatctctctcctcttttctcctatccacttcagcattcagctttcttatagctcactattatacttgctctaatctcgatcgatcgatcgcccatggtggcaatagtttaatccccagaggccacaagtgtcaatcatcaggtcgatgggaagaaaagggcaagatgacgagattgacgccgtgcaggggattcccaaatggggctgattcgtccttttcaggtgtacatttcccatttttatactgcctgcctggagctctgcgatgaacttggacaactttatagggaagctacgtatactttgccagcctctctctccggttatcgcaagtaataaagcctaaagcggcacgttactctgtaaggaagttgagtgttaagaaggtaaagatgccatctgagcagtgcattacacaattgagttgattggtcagtctctactatagtagtagtacttacctttttcttatgggaggacagttggtagtgctagctagcttaacaatattctactttgatcatagaaaacagtactagtactaagttagtactacgttgtcgaagaggaaaaaaataagttatctctttgggacttaacaatactctgtttcctttcattagaaaaaaaaaaatcagtactgctaaataagcttatcttctggtacacgcggtacaggttctccattattttttttcctagcgagtccagcttcctgcttccctacctaggaggtccaactccaacccaacgcctccatgtgccttgcccctcctcccccttggccgagatgatgataagctgctacgccttgctagttgctcccatgccttttgaacgcttttgagaccgtgaccaagctggcgcggcgctgcatgcggcgtgagaacgagcgtcgcagcacgacgcgcgggcaccacgacgactccacgagtccacgagcgttttcacgctcgtttcgcacaggctcacgcgttgccgcagcccgttttgcagaggcctacgcgtggacggcctangctcgtggtgcgcggagcgggccgggctttttcagggcatcaccggtgttagttaatcgcagtagaaggggtatatgcccccgtgaccccaaatctcttcgaaagaaaagaaattcccctttttcttcaagttcaaaatatcgagttacatttatttaactggatcatggtatagtagtatcaagaggtattagcaatcttccctgcggatgatggagcccaaatcgtttaccttacagagatcaatcacaattcatttccataaacaaaaccgtatccgaaaacagtttgaatcgatctacagggtcatgtaacaacaaagatccgtgtaaccaaagcaagaaaaaaagaaacaaggttctcaaggatgggagaattgagatatcctcttaggttgacaagctgccaccaccctgttgccaaaggttgatgatatcagtggcctgattcagaaggatgatcatctgtttctgagagatccactctttctcctccagctttgctcttagctcctcccaggcatctttccgtggccagaagtagtatgggcttaacggaatgctgccatagccgggaaccaactggtcgagggctatgccaatgttcttctccatccatatgaacttcagaacaagcattggatcctgcctttcaggcaccttaaccttgtactgcgatacaaaatcaattcgtttcaaatctcataatgctaatactgattttgcatatctgagtaaaataaattgtgcagttttaacacagctcaagtcgtagtaaaataaattgcaacaactactgtacgtgttccattgacaacttcatttctctacaaaaggccccatttttcaactgtgagggtaactcccatataatcaaaactaatccacttttagtgtacatctctgaaatctgatatagtgatgaaaaaggaacttattgtgcctgttaatgttgttacataatcacgtaaatagctgaatgaaaaaaaactcctttcatgaccaaaacctgtcaatgctacagtttgttcaatagttcagttcttgcttacacatacaaccaaaaatggcacacgctcaagtttgtggacatgctttcatgtgctcttcgcctcttcatcactagcatacaccttttatctgcagaagtgcaaaactgcaccaaaaggacagcccgagtgcccaaacatgctcaactagactagaacttctctaatttactctacttgtgacttctcttaagctttcagctgtgcattgtgtctaaagatttactctactcgtgaattcacccaaatgtacacctcgtactgtatttcacctatgagctcaagtaatcagttcggtaaccaaaattgattcaagaaaaatcaaattcatgcgaaaccaaatgtgattgaactccatcctcttcaaaaaacaacacttccttctgaaattgagctcgactcggtaaaaaaaaaaaccccgtaatttcagtcactggcatggtttggagcggctactagcccattacctcctgcgcttcctcgccggcgctcgcatccccacctccgacttgcttctcctcttctccctcctccgcttcgacggcgccagaagcggcggcggcggcgaggccacggagcgagcgaaggggaagcctcctgctgccgaggtggacgaggcgtggagtggaggaggaggaggtggtgcagggggaggcggcggaaagcttgggccgggagatgcgggcgcgcgaggcgagggccggcgtggcggcggggtggacggacatcgccagcatcgtgtccgagtccgaggctcctgtgcggataagaggaggaagacgatggtgcggggctgcctcctcttatctttacccttaataatccccttctcgtcagctattagatgtgggctagaaagttatggtaaagcccaatatggcccagcacaaaacggcccggcccagatccaatctaagtaaaaagctcacagctcaatcgtctcggttattcgagaataaacgaaatggcatatttgtaaataaaaaataatttgtgaataaatcttttatatatatatttttaacgatctaaaagcaaagactgaaaaataaaccttcgataaaaaaaataaaatcaaccccaaatttaaaggtaaaaatttaaattttgactgataaacataagtataagcgaaaagatgaggccgtccgtttgccttcagcagggtttgcaaaaccgtctgtaaccgtgcgattaccgcgcttaccgtggggtacggtaaaagggaaaccgcggtaacccccttaaattcaaataaatttaaaaaataattttaaattttgataaattttacacggttaccgtgtggtaaccccggtccggtggtttgggaaaccctggccttcagtagtgctagtgcccagttgccaaccgcttgggcgtagtaaaaactgatagtggaatgaaatgaaccgggtacaaagtactgaaatgatcgtaagttttgaaaaaaaacaagcaggagtagtaactttgcaagtaaggatgctacattctctgatagtagtttcagtgttttacacattctataagaacaccgaacaaaacaagcatcgaatttcaaatgtcgatacagccttgaacagttgaagttcttgcccacaagtttaatcgaaagcattgtcaggttaacccaagaacgtgattaataattactaacattaatattagtcccatcttattcgacaatcattgctaaactatttactgtgtcatgagatcgaatcaagtttgatgccggcgaggttttctccgctcagaagtccggcgccggcgagtacgcgtgggaggcgggcacaaccacggccgtcgacataggtgccgacgaggagttcaccaggttcagtatgctgttccagtagttcttctcctcctcggtctcctggaactcgccgtcggcttccgcgtctctccccgccggcctcgggatctggttcaaggagccttcgaggagtaggcccgtgaaccccgctccggcgccggggaagcccacgtcggcggcgtcgacgtcgccccagtgctggtccttgcacgcctcgtcgtacgcctgcatgggctgcatggcggcgcgcgcggccgccgcggcggcggcgccgtgcgcctccagcacggtggcgagcaccgcgctctccgagaagctcagcgtggacgtcggcgagtcgaggccgtgagccgccgccgccgccgccgccgacgcggggggtgccgggaggtgcggcgcgcccggggtcgcggaggccgcgagcgcgcgcagcttggcctcccgagccaagcgcgcctccgcctcgagccgcgcgctctcccactgcgccgtgtggctgaggtgcgccgcggccttggcgtgctgcgcgcccgccgcgccgccggccgcacctccgccgccgccgcccgcgccggccacgtcggagcgcggcttgtgcgtgaccgggtcgatccccatcttggccagccgcttctttaggtgcgtgttccagtagttcttgatctcgttgtccgtgcgcttcggcaggtgcgtcgcgatcgccgaccacctgcaaaacaacaacaacgccaacgccggccaagaaaaaagatcaggaaaatcgcacgtcaaaagccctccattcgcagtgacaaaattaaacaaacagcactcttgaaaacgtaaataatcggcggtgtgatttaaggcgtgcgtggcgtagtacagacagagggcagagatgatcggaagctgtgagtcaaaatgggaagaggggcaggtggcaacagtggaccaaaccccagttttggtccacaatgatgggggggctcgcctccttaaatgacgagcttgaatgccgaatcatatgggagaaaagaaaggaaaattctgggccgagcctctcactgcccaaccttttcacactttttcccttgttgatgcatgcattgattggtctgtgctcacagctaatgcgtggttgttcgacgggcaaaagatgagcaatgcagcattacgtgtgaacaaaacgaaaacaagtgatgattctgttctaacgtaagaatttttagcctagcttgtgtgttaatctatggacagtacggtttgttacggacaaaatgctgaagcaggtgtgtacggggacagcaagtaagtagcacggcctgcgaaatttacacatcccctggctaagctccgtgttccaacccttgcattgcataaccctttcataaatgtctgccaagactacggtgcagaatggtggctactggctagtgtgttcttgacctgccggtcagcaacaagtactagcagtcaaaattcgtgcaggagaatcaagggttccatcgcgattacggaattaaatgtgctccgggtgcgaggtgaagaacgagcgagcagctagcaggagggagagttgtgcactacgtatcttgtatgcatgatgcatccatgcgaaaacgaagtaatcgatcacctgttgccgagaagggcgtggagctggatgatggtctgctcctcctgcaggctgaacttgcccctcttgatgtccggccggaggtagttcgtccaccggagtcggcagctcttgccgcaccgctgcagccctgcacacgattgtcacggtttgcatgcacctcagatcagagttcagagagtagccagcctcgaggatcgatcgcctcgaccgaacattgcagctaggattgcagaggttgagaagaaatttaagctagataagcggcgcttaccggccttggagggtagcgagcgccagcagccgtggccgtgctgctcgatgtaggccagcagcttctggtcctcctccggcgtccatggccccttcttgagcccctccttctcgcagcacggcgatcgccccatcgccggagaaaagcaacagcagcagcgagctctaggaaaactcctccccgatgatcttcgacgccctctggttcttcctcctctcctcttctctcgggctcaagtagtaggtctatgtgtagtagtacgtgatcgaggcaattcactacgagagatcttctttgcagggagctgtggctctctgcgagtgactaatgcagcagcagagtcagtgagagtgtgtgtgtgtgtgagagagagagagagagagagagaggccaaaagcgaaagagtgaggcacattgcgctgcgtagaggcataaatagaggagaggagagggggtacggtgtggctggctcggcacgcacgactcgactcggctcgcgcgaacgactcgatatcttcttcgggcgccgcgatctcctgccggcaaagtggcctctcactgtcagtgtacgtaactccaccccgcgagaggagtaggggcaggaccgtgatttcaccccccacggtgtacgtgtgccccaccccgtcgccgcgggaggaacgaacgaaccatcgctgccaatcgcgatcccacttcatccatccacccgatcagagggcgtgcatttaactcggcgcggggctcgtctctgcctctggatccccttggtatatgtggacgctacactacacatgcctacatggtcctttcctcgcgctaccgcgagtggcgtggacggcgtacggcgcctgtgtcgtcttcccccctctatcgcccaatccatccatccatccatctgcgtgcgtgcgtgcagtgcagtgcatgcatgccatgcgctttcatggcgctgccctgaccagcgctgttgctgccgcaggggagggggaatctcgcgcgctacagctcgctgcaccaaagagtggtcaggcgcgcgaacccgatcgatccaacagtgttccagtacaggacgcaaattccaacgcgaatcgttagttcgaagctggcacagcgtgcgggcgcggcggccgatcgaagggagagatcgaattactggctggtcccgcgattgttcatatatcgcgcgatcgatcgagcgagcggaggagtgcgtgctgttccttgtcaatagtagtatacgcttggcccggcccccggcgtgggcaggtgaccagtagctagctaggcttaggctagctcgctcggcttgcccttgcccccatccgtttggacgattgacttgattgcaaatctcgcggcgtttttgggaacaatttgttttactcattcaattcggtgccattgccgcaagtcacgactggcggtgcatggttcatgattgcgtcgcatcgcatcacattgcgtcgcattgcatgcatgccggtttcagttgtttgcttgctagctcggtcgatcggttggagtgtgagatccccgcgccggccgctagctcctggtttctttgcacatttcgcttgccatttcggggcgctagccatggccgatttgtggatctctccccctgcagattgtgcaggcgatcgtcccagatttaatttgctgtttgttgggccctgtatgtgttgctacgagtcgcggctaaagtgatctctgaaattagctggttgctcgtttgtggtaggtactctattcctagcgttcccatttctcagtaaagcttttgctctcctggaaaaatgtttgtcagtttccaaggaggacaaacggaagtctccaatccattttctgaatctctgatctcgccatccttaatcacgtactaatccagtactgtttatcacgccatcaagtcctagtccaacttactacccaccagatcaacagcttactgctgcgaacattgtacgggaggctgagaaaaaggaacagtactggcagtgaagggtgatgatgatgtacggggtagagagactaatggaacactctgtaaaattccgccaacctgcaattgcaaggcctgagcgcagggatggcttttgccatttattccgctgttcccggtgcccaatcgcaacagtagtacagaaggaccaccgctgtgaggtgaggggaatcattcgatcgaaacacagccgcatgtgcgtcttccccaagaattcaccgtgttctttttaccaccatcactgtaaactgtaaagcaaaattagcttcgctacttcggacacggatcctctacggtattatacttacagtagtattggctaacaggtgaacccgatcccacgtgtcagcgatagctaatgtagatacaatatacttcagacgattcccactgtcttcacttgcaccatcacatccttcagactttagaacttgctgtgaatgtcagtatgtcacatcacggcataaaattataggcacctgccagttgcttatttactgtactagcttgatcgatggcatggctctcaacgagacttaatcgatgctttgcttttgtttgatttcgtatttccatggcctacgttgggttgcagatagatgctgctgttactattctacggctagctacgatgggtatatacttagatatgcatgctagtagtatcgatcaaattaagtcctgaacagtggaacgcacagtacgtgctgcggtgatttggcactggcaccggtgtttaattagccatgcatcagtagcagtaggcaaaaaacttcaattgcctactgaagtagatcgacgccattagtacgtagctagtagtatgtagtatgagctaacctgtgtctagtctgcaataggaaggtgagttaagcccatccgctccgctgccattgcaccgtttcggaaagacgatatggcctcgccaccagatcatctgaaagcgaacgttttctcggacggatctggtagaggttttacgtccaagcctgtgtccagaattgctccgtcctaggaactgaaactctgaaaaggcaatgcgcgagaaatgggcacggcattgattgaagaagaggatcgatatgatgatcgtctgtatgcagtggagtgcaaaccagaatgtttgcctctaatgcatggctctagctgggatgcagacttaattcatttagagtcgagtgattgcctggaaaacgcatcatggtttattacaaactctctatcgtttagcgtgcagacagaacagtacaagggggggggggggtgaagtttgagttaattcaactgttgatcgcctgacatggccattgctcatgccggctggaccagctgattgacgtcgagaggggaatctgatcatctttatagcgctgacgatttgcaatagcgcttgtactactgcagcatcagggcagaagtttttcatctaatgtttttgcagacagcagaagttttccatctaatgttttgcagagatgcgatcaagcacatatatttccattaatgttataaaatcttataggactactatgtaataagaacatgcaaggcagaaaaagagcagctcgccatttagcaagtctgcgtgagctttattattgcgcaaaatggtggtcctgatgaacctttttctagggtccttttcttctccggctctgcgtggttttcctggtttttggcagcaacgtagcaccctggcctggtagacaagtatttaaaggtgtgagccctttacattttcgtcctacgagtactactcatcttttcttttttttcttttgaaaagaaaatgatagcagcgtactgaagtccaatccggtacattaatactccgacctctgttctcaggcctggtaggaccgtaggactaaggccgagtttagatacaaagttttttttttcaaactttcaatttttttatcatatcaaaactttcctacacacataaaattttaactttttttgttacatcattccaatttgaaccaaacttttaattttagcgtgaactaaacacaccctcagtatagtacactttttggctgtgtttgcaaaatgggtttggaatatgattttccaccccttcaaagggtaagctttaatcttagccatccattcttctcacccatttcatcatatccctccattcatttctattttttaatcccacctctcctaacccattttccaaacattccaatccaatgggtttcagcatcaacgctgcagcaatattggtctttagacccgaaatttgacctagttcactcagccaagttaaaaaacctactccctctggtcataaatatgtggcatttataacaagatttgatagcactgttgatactttgtattgatacttagactgtaagtaacttttgaaatgcttaggtaaaaacgaataaaatatatagtttgtgtggctttgtctagaaaagtaatattaattataatatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28825 - DNA, 691 bp, Oryza sativa
ttcatgacaaaagaagaaaaagaacacctacgggacgggattgtgatatgtccagtctgaggctctgagcttcacactgtgtcactgtcgtagagtaaacggcataaattggctgtacctgctaggcagagagagagagaggcccgtccagcctgcaagaaatgagaaatgcatgtgactttctgaattgcagcgctgatgtgttcgattcagtttaggaccactcccggtgcaggccaatagtaggagtattacctttccttaccaatttgaccgataaatgctggaaagaacggccggtatactcctattgacatttcacatggcatttgcagagcttcagtgatgatgggtgaacagcctacagtttacagcacagagcctgtagtttacagtacagagagtacccaataaaacgagacataaatattgcggcttgcagaaaatgcagtttggaccacctccacaaccttctgatctagatatagctgttgctattactgatactgaatggaaaactgaaaacaaacataggttaagggttggtttagttcacgccaaaattagaagtttgattgacattggaacgatgtgacggaaaatttggaagtttatatgtgtagaaaagttttgatgtgatgtaaaagttggaagtttgaagaaaaagtttggaactaaactcggcctaagg

SEQ ID NO: 28826 - DNA, 8644 bp, Oryza sativa
  unsure (1)..(8644): unsure at all n locations
ttcctgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagacaagcagcatctacagcagcttcggccgccattactgtttcatcgagctatactagagtatactaccaagaaggaaggagggagtgggctacttcctgtctctgtcgtcctcgctggtctccgacacggcccgctcggaggacacctcggcctcgccgcacggcatgccgaacctctggatcacccactggagcgactcgatctgctgccggtcgtacatctgcttctgctgcgccatctcccggaactgccgcgcctcgcgctccaccagcgccttctcgttgcggaggcacgcgatcttggccatggcctcgtcggccgcggacgccgccgcgcgcctctccttctccagctcctccagcgcggcctccctccgcctcctctcggccgcgagccggcgcctcagccgctccacgctgccgccctcctccgcaccgctgccgcagccgccgttcgcgtcgccggccgccgcgcactcgtcttcctccgcgttggcctcctgctccagctcggcggccagcgacctcgcgaccggcttgtcggagcagctccccttggagcgggccggggacggggtcggggacgggggcaggccgcctttcttcttcagggccagtatcttcgtcccgcacacggcgcagacgacgccgccgacgcgcaatgcctgcaccgtggcgtccgcgttcccgacgagcccctccacggcctcgcaccgcttgccgaggcgccagacccccgtcgccaggagcaggaggggaattccaacaaacatctggggggcgctcaccgacctcgccagcgcaacccagcgctccgcggaggcccagtcgccgccggcctcgtcggactcggacgagtacaccatcgccaagaacccagcaccgacccaaccaggaagtagaacgcgcccaccccgggcataaacgcgaacgacacgccggcaagcggcttcaagaatccgccgccgccgccaccggagatgcggttcccgccgcccatcacttccccaaattgccacaaataaaacaaaaccaacgaaaatgcgatctcgcggtgcgtcgccggtggaatcgcctgcgaccggaggaaatataggaggagatcgccgtgggtttagggtaggcgtggtgggattggggatgcgaaaagaatttggtttaagcgaaaaaaaaaaaagctcaagggtttcgattcgaagggggatctctgcggataagtcgcgggtggcctcgctgccgtgtgggtctgggagttcggaaccgtcctcgcgtggggcccgcttgtcggttatgggccgccgtgttgtgtgggcccggcgagaaagagtgcgacatggatagagtaaccggatcggagtgaaaagtcgtttttgcttaacggtgacgatgacaggtggggtacaagttatgtgtggcccacatgtctgtgtaagatatgggttatggcgtgtgtgaagttcggagagaatctatgggaacggaaatatggaatacgtgggcttcttttgggagaagaccgacttttattactgcggaaggtgacgctagtccaggatcttttttttccctcgtgatattttcacggaaacgatgaaaaacgactccacatcatcaattggctagtccacgcctgactacccacttgagaatttgtaatttttccagttgcctgtgtatctcgtttgaaaactccaattcaagatctggaactcggcattagtaacaaggacccggtttaaatttgtggctccaaagagacgttggattgctctccaccgctacagaatcgccaaatcgattccgtccgcttatctgattgcgcgcacggttggattgcgcacggtatccgctatgaagaaggcctacgaacaaagcgagcaccaggcagcaacacggtcgccactcggcaggccggcagcccgtacgcgccccgcgtgggccaaaaccacgggagccgcagtggactgaccggacggacgcccatacacgctacagttgctcgctcctctgccgtagtgccgagcctatttagaaagatctagagccacttggattcgtagggtagtaaaaaacataggaatagaaaaaacgtagaaattgaagtagtataattcttcaatcctgtgggaattaaaaacacatgaaaagatgaaatgtgcccttgatagttctataggaaaaaacacaggatttctcttcccaagaggtcagacctctttctttttttcatgtgaaaataaactaaagggatgcaatccttaggaatgtttcctttcatttcctatgaatcaaaggcatccataggaaataatccataggattgtgaatcctacaaaaaatcctataccgatcatttaaatcaaaggagcccttagattctcatcaaaagcatcatctaagacccctttaaatcacaaaaatgaaaaacacagaggaataggaaaaacatagtattctaataagaatgcaaatgtaaaacagaggattgcaaaacgcaggaaaaacatagggatgactgtttaattgggccgcaggaaaaacacaggaatttgaggagagataaaaactcaatagattcttaccatgaggttctacctcatgttatatttcctccaaaaattgcatgggaagaggcattccataggaatttcataggaccattcctttaattcaaaggactatataggaaaaattcctatagaaataaaatcctctaaaattcctatgaattttctttgaatcaaaggggcctaagaatctggccgataaaaatctagagaaattgaaaaaaatcagcttgtcttttagtttactttttagtttttacaactatagcttctcgtaatctagacaggttgtttataagaactcttaattatgaaaaaaaattgtacatgctagaagctcccacaagaaaatcgcatagcatactagaaaaattcctatacactctagtctatagaattattaggctcgcccaacaccacaaccttttggtgcttgggcgcggggcgcctatgagagtggttgatatgccactatgcattttatgactcctctaaactttagtcctacctatgggcagacgttaagatggtttgactcagttgagctcgttaggagtttagtgactgatgagggaggaggtgaggagccaatgttctggcaccggcacaagacggcaatggtgatgtatggtcgtgtggcgccaatgtagcagtaatgatgagtggagaatagggtttggatcaatatgaactttagtgttctttttagacctagtcaatcggtatagcatggacttatttttgtctagtagagaattgtaccgtatgctgccctagtggactattggttcagctcgttaaactcatgaatactccataactcgtaacctagctcactactagaattcaacgggttccctagagttaaaattgttccctagagttgttaaagccatccaagggaaaccaaaagtatccctagggagcaaattgataactctaagggaaagaagtattcctagggaactttggctgaaatgacacgtagctactccacatcagcatggtggtctgattacttccaatattttttttcaatttttttccttgctgcgaccaaggaacgcgccctcgacatacaaaatttctgcccaataaatgttgggcccaccttatcttctccacagctcaagcaaaccacatcctctcgtttttcttcaccccaacggccggccggcgtgcggcggccggccggcacggcggcccctgccctttccttgaccaaacctcgagctctagcaaccggtcgccagcaagcacccgacagctgccgctctcgacaagctcgacggagcctcctctctcaccacacgccgttgtctccgtcttgcataagttgtttcgatccaattttctcagctcctttcctctccttttttttcttcgtagcgtgcagcacaagagcgcactccagcaagcagcgagcaccacaaggttgctgatgctccagcctccatcatgatgctgaccagcaatggaagtacaaatccaagtaagtgttgtttcaactgagctcgaactgaagtttctttcatatgtgtgcccatttgcatattatcttgatctgggctgttgagcatgctatttgggttttcttttcaagaggcaagggctggaagcattggagaacaaacaagattagttccacttcagttctttgcggatgcagtttttcaagtttccactgttgttgcagaagcacgctagtatcaagtggtttagattcgttttcaagaacatgtgttgtcttttatgtttttatcgtttcgatctgagcgatgatagcatcagctcatcagcacatctgaagtgtgtatcatatgtttgtgagaggaattttttgtcaacttttcagctccactttgtactacaaaagtatatgtaaactgaagaatcaatgtaattgagtatttttctattgataatagaatggcatttttatttcaactaatgttttagctttgatgttgaggcaaaggaagacagtaaaataaagaaaccaaaataaaacaatgaaatatgcaattttatttaaatggtaatatttttcctaaatttggctgaaaaccaaaagaaatccactttacacgtcagattcagtttgcgccacatgtacaactatccctatggagtgaaactctagggaacggaatctttccctaggttctccttgaaaaactctagggagctgtgttgttcccgtagaatggatcccagggttcaccctaggggaatctgttcgccagagtttttcccctgatccctagtgtatttggctctagggaagttggtggattctagtagtgcgcttgagttgagccgttaaggtaaacgagctgaaagcttcatgagccacgagtttggcgataattttctccaggtcatcttatagctagtgaaacacactagattagctataatatgatgggtcacacaatactattttattgttttatacccattagttttctctcccgggtacttttcttccttgggtttgatgaggttagcatgcatgtaaagagcttattttggtttctgtgtgtagcccggctacaaattaatcgctcattcaccctctctctctctctccccttctctcttccaacttattttgcagcctgctgatatcttactgtacatgctctaatacgaagtacttcgtctgctccaacagttttcagttaatccctcgtccttttttaatgctcacgcaatcgtttcgagatcccacaccgggcattgatcttagctccagttccatactcctacatccatacttcttgttccatggatcttagacagggacagcactctctacctttccctagcagtaggctagtacagctaggatctcgtttccgcgcgatcaatgcttctcactgattggacaatgattgccacatcacttgatcaacaaagcatgctggctggctggatgcacgaaaccagatccatgctttccatcacgttacacagtgcccctacgtcccaacaaacgcagccaagaacacacacatcaaaaaaagcattaatcgatccatccatccggcaataaactccaagagatcttcgatacggttgcacgcctatatactctataataaaactgtcgtttatcgcacaaaacgacggtggatgtgcacatctaccaccgattcgtaaatcctaaaccgcgttttaggaggatgcagacgacgaagattatcatcggttgttgatcgcactcaacagaatccatttcggttctgcaatacaatatacgcagcggttgaaggagccccaccatgtaaccatgttcatacagaaggtcagcgtctccacggccgtagtgttggcggatgaccaaggtccaaatgacccccaatctttagtcgtttcggattctttttggcagccaatctccggggtctgatctgtattgtatctgtgctttaagccatcctgtattacgcgtcaagaagccagacaaaaagctctcttcctgcccaaaaggtgacacaaaaaatgaaccaactattgtctactgcgggacttccatttgcaagtgaaagttttgatctaaaaaaaagtttggtgcctaggtagtagttagattcacataagggaatatatccagcaatggtgacaacttgtacgtggtgtgtacagctgatcactgcaggagaattgagaccactctgtcgtagctttgcgtttttttgtgcgtgtctgattatcagtcgttgttcccgttggcttaagcgagccttaattctgtggtacagcaaagataggtaagttggtgattcaatattactgataaataaagccttttgcaaccatcgatggttgacacaccgctacgataattacgccatgatggcatctacaggccaccgaatctgtcgacggttacggttccaggacctggtcgtacgtccgttgtttactctgtcgtgtggcatcgcaaaaaagaaaacggaaactctgcatccagctttgtgatgtcaacatgatcctaccttcagctaacctgaattaaagattcttgatcaccgtttacaggtaaggagtagctccagctaacacctgtgttcgtgaaaacgaccggtaatacgcagatggtaaaacacactgttagccttgttgcaaatctaagtcagctacagttctgtgcaaatcttctcaggcactattgttgtacttctggttgttatgctatcaaaatcgcaacatcaacactagtacgtactgtacgtaggagggagggattcaggatcaacgcccggcaaggcaaagctttgtcaacgtgcatctctcgatctgagccgttggaaatgtaatcggacgtacgagatcgcgccgggatctcgtagcgcggttgcgaacttgcgatgtcatttgtggcatcctccgttttttctccttgtccgtaaacaaaagcaatggaaagtctcctttccaaattccaatattctgcttcgcttgtttgtttcttccctcctttcctcttctgcttctcctcctcctcccaccgccgcatggtgtgatcagccaagaaaaaccatccatccacgcagcgatgctgccaccgccggccgccgcggccgccgcgctcctgctgctcctggcgctctccgccggggccaacgacatcgcgtcggacgccgcggcgctgcaggcgttcatcgcgccgttcgggtcggcgaccgtgtcgtggaacacgtcccagccgacgtgctcgtggacgggcgtcgtgtgctccggcggccgcgtcgtggaggtccacctcccgggggttggactccgcggcaacgtccccgtgggcgcgctcgggggcctcgacaagctcgccgtgctgtcgctgcgctacaacgcgctctccggcccgctgccgtccgacctggccaagtgcgcggagctccgggtaattaatctgcagtcgaatcacttctccggcgagctccccccggagattctggctctcccggcgctgacgcagctcaacctcgcggagaaccgcttttccgggaggattccggcgagcattgccaagaacgggaggctacagctgctctacttggacggcaacctcctcaccggcgagctgccgaatgtcaacatgccattgctcacctcgttcaacgtctccttcaacaacctcacaggcgggatacccagcggtctcagcggcatgccggcgacgtctttcctcggcatgtcgctgtgcggcaagcccctcgccgcttgccgaacgccgatttccatcccaccgtcgcaggctccggcgctctcgccagaaggcgcggtctcggcggtcggccgcgggaggggcggacgccgcctagccggaggagccattgccggcattgtgatcggctgcgcgctcggcttccttctcgtcgccggcgttctggtcctcgcgtgtggcgcgctgcagcgcaagccaagaccgcaccacagccgtgacgtcgcggcggagctcgccttgcacagcaaagaggcaatgagcccgagcgtgtacacgccgcgcgtctcggacgcgcggccgccgccgccgccggcggcggtggtccccgcgatacaaccggccgtcgccgccaacgtcgcaggaaagaagaagctcttcttcttcgggagggtgccgcggccgtacgacctcgaggacctgctgcgcgcgtcggccgaggtgctcggcaagggcacgtacgggaccacgtacaaggccgcgctcgagaccgggccggtggtcgccgtgaagcgcctcaaggagacctcattgccggagcgcgagtttcgggacaaggtcgcggcgatcggcgggctggaccaccccaacgtcgtgccactgcaggcctactacttcagcaaggacgagaagctcatggtgtacgagttcgtcgccatgggcagcctctcgtcgatgcttcacggtatgtatgcatg

SEQ ID NO: 28827 - DNA, 7653 bp, Oryza sativa
cgcttgcttttctctccattttcagttctgacttgagctggcgattccaggaaaccgtggctccggccggtcgccgctgctctgggagtcgaggaggcgcatcgcgctggcgtcggcgcgcgggctggagtacatccacgcgacgggctccaaggtggtgcacggcaacatcaagtcgtcgaacgtactcctcagccggtcgtcggtggacgcgcgcgtggcggaccacggcctcgcgcacctcgtcggcccggcgggcgcgccgtccagccgggtggcggggtaccgcgcgccggaggtggtggcggacccgtggcggctgtcgcagaaggccgacgtgtacagcttcggcgtgctgctcctggagctgctcaccgggaaggcccccacgcacgccgtgctgcacgacgacgagggcgtggacctgccgcggtgggcgcgctccgtcgtgcgggaggagtggacgtccgaggtgttcgacacggagctcctcaggcaccccggcgccgaggacgagatggtggagatgctgcggctggcgatggactgcaccgtgaccgtgccggaccagcggccggcgatgccggagatcgtcgtgcgcatcgagcagctgggcggcgcgggctccgcgcggaccgcccggagcgtgtcgatggacgacgccgacgaccggccgctcaggcccgccgggtcgacccgcgagagctgaagcgttgatcactcagcatagttgctcgttcggtaactctatgaaaggtcctgaatttttttttccttcatttcattttttttggctgcgtccttgtgtttgtcttaggaaattacttacggtgtgatgttaattctttgaagtttcatgaatttcttgatacttctttcatcggatttcaatcgtccggttagctgcgtgtgtgtgtgtcttgagatgagatgttggtgataggagaagcacactggtgcaatatgtaattaccactacatggttgatgtcactattgacaaatgagaaattactcccccttcgaggttttgactcccgcgcgatttgaacgacatcgtcccagtcgatctcgtttggatcgtgcgggccactcgtgtcgatgtcatcatctagccgctgccgctacatgaaattgccatgcacacacactggagacagtgaaaaaaaaaagctgaaaaaggcgtccttcgcacgcatcctgctcatgctgagctcagtgacagctacagggacacagtacagctctgatctcttttttacacgacttgttccgaacaaccaaaccaataggcgtcgcggtaaaccatgtcgtttaagggcatgtttagatacatttgtaatcgcaaatgacaaaagttttagtgggaaagttttgacattgcaaaagtactagttggtgtttagatgtatgttaaagttttgccattctagcgctaaagtgagagagagaaagagagagggagtggtcccaaagcactttttggcacaatttgctactatggactagcaaatgccaaattgccaacttttgctactagtgtatagatccaaaatggtaaaaatgctataaaatgataaaacttttgccattttgaagtatctaaattgagcctaaatacccctaactaatgtcaatttggtgcgcttccccctttctatattgcaatgtgcgactaggattatagaagagttgtgcgagcaagcaacagcaaagaacatggctacgagttggcagcacatcaagaggcgttgtcccgaagatacgaactgctccaaccaaaacaacgcgttaatgcgccgcgtgccttgctcgtacgtacttgccgagcacaactagtttagccccgagagaatcccaacttttttttaaaagggcaagctagcccgagagaatcctaacctgcccgaacaaaataaagggcgagaagagaggaagatcaatatggttgtggatcatgcaacgccctgcctgtcattagttgtcatcgtgctctttttataaaaggagaggctgatcgatcactcgagccggccggggtcgcttcgcaccgctgcccccactactagagcacgaaggaatgataatcagtgggctattctctgaacaataatgtgtgacgtgaattattggccgccggtccttggaaaacagctcggccagcgatcgagcagcgattcatccatccatccatccaacccatttgcaatccatgtgtgcactgagctgagacacgcctttcggcagcaatagtagctctgctatgagcctgcctgcctcagctctactacactttcatccccacacaaggccccattgttatgtccatttttctgtccggttttgatcgctagatttcaggatttgggcgtgacgctgtaggggtaatggtggtgctaggggaggggatcaggggaggcacatgaagatgaaggcggcgcattgaagagaacactttggttgggagtaaagcaggcaagcgtcgtggtgcgcgttagaattgacgcgatgcgggcctgcccagtgcccacccctgcccgtaccagagagagcagtagagtgcagggcagatcgatcaaccgggcgcttttcgttgcgcccggtccccgggttccggccagttaggtggcccggacgaaaggatcacgtcaggacggacggacggacggacggagaggagaccgctcgatcgtcccgtccggcctcggcagttgcactaattagctcgccgagtgcgtaccaccacatgccgcgccgcgccgcgtcgcctcgctcgcaaccgcttctgcagttgcaacgcgactatgcgagcccccgcatgcgcgttttcgcgttcgctttgcagaatcgcactgcactgcactgcacggtggtgcgcttgcccgcgcttcggccggccaccttgacggcacgcgtgcgagacggcactagctagcgagcgcgtcggtgatccggagaagtagaactgctcccccgatctccatcccacctgcgggaatatgcgccgagttgggtgaaaccgtgaaaggcttgggccttatcagcgagcttgagcccatttataacggccgttctggtccaaatacgagcccattacacggtcttcgaatttcgcacggcccgttctggtcgaaacacaagacggcaagttttctttcttctgctccaaaccaagaaaaagacaatgggccaccacctgtcatacactcggaccggccgcaccttcttctctcccaagaaataaacccctccccacaaaacccactaaaaacacactcctcctcatcagatccacacccatcctccccaccccccaagcggcggcgagaccaaatcccccacttctctctcaatctctctctctgctagggtttatccctccgcgccgccgcccccggaagacgagagagcgccatggccggcggtcccgcggcggtgtcgttcctgaccaacatcgccaaggcggcggcggggctcggcgccgcggcctccctcctgtcggcgtcgctctacaccgtcgacggcggcgagcgcgccgtcatcttcgaccggttccgcggggtgctcccggagaccgtcggcgaggggacccacttcctcgtgccgtggctccagaagcccttcgtcttcgacatccgcacgcgcccccacaacttctcctccaactccggcaccaaggacctgcagatggtcaacctcaccctccgcctcctctcccgccccgacgtcgtgcacctccccaccatcttcacctccctcggcctcgagtacgacgacaaggtgctcccctccatcggcaacgaggtgctcaaggccgtcgtcgcgcagttcaacgccgaccagctcctcaccgagcggccccacgtctcagccctcgtccgcgacgccctcatccgccgcgcccgcgagttcaacatcatcctcgacgacgtcgccatcacccacctctcctacggcatcgagttctcgcaggccgtcgagaagaagcaggtggcgcagcaggaggccgagcgctccaagttcctcgtggccaaggctgagcaggagaggcgcgcggccatcgtgcgcgcggagggagagagtgagtccgcggggctcatttctgagccaccgccgccgctgggacagggctgattgagctgaggaggatcgaggtggccagggagattgctgtcgagctggcccgttctcctaatgttgcatacgttcctgctggggacaatggccggatgctgctcggcctcaacgctgccgggttcggccggtgatccgtcactccaattttacccttttagttgcccaggcatccgctctgtgttacattaaactggaatgatggtatggggaattatgttatctgctacttttggtaatatttagtctggatgtctttgaacggaatgtgctaatctttgtgatccaaataagttctgggtctaagactcatttatgttttatgatttgtctgctgattaagctttatgttgctgttcaatacgcatgctagttatgcttcttcttgtttatggattgttcttatcattgcaggggtgtatctttggttactgatgttgccttgctgaattagcactgccttgacacttgcagggatgattatctagttgccctgtggcatctcgaatagtcatgtaccagttacctgacctttcggtgataatattctttgatttgtggccgcatatgctgttgttcttaagcaaccgtgtcccgtagctcatctaattaacctggagtttgccagtgttacgggagtcaattttggatatggaatggcagtgcatagtcggttgatgctttgatatttgattttagcttcacaatgcgatttaggcatacattgtctaatttggtccattttattgttagagtttatccctaaaatttggtctatatatagctctttgatgcttgtgaagcactgacagattctgatagtatcgatacatgatgaaaatgttggattcatgttgataccatttatattttattatgacatgtaggatcagtgttaagctcttatgtacaatctgattgggattgcgttttgatcttagtattcataagtgttgggtggcgtattatatcactgtagtcccttagtttgtagcctcacgcattatccaggatttttatagttgaagccttgaaggctggtatcctctcaaaaatcttttgctgaatttcatctgcactgctgatgcactttgggattgcttgtctacttggaggccttttagttgaggaatccatgcctgcatttcctgcaatttggtttgtagtttttagttgattttttatttcccctcaagaaaacgtagttgtagccttgaaggcctatcgtggaacttccatcctgaatcttgagatgggttgacagctcttaggcttttgagttgatattaagttcatgtttactctgcatgccccttggtgcaaagttgttcacttgatgagtcccactttgtgattggtggtatgatacatgtgaatttgagctttcttaccatataattgttactgatgcttgtgggagttcttgatctacagtcttacactgctgctggtaatcaaggttttgctctgcctctaggaatcttggttttacccagcttctagaattagtgaattactttgcaaatgcttgttgctgatatatattgctgaaaacctaagcataggttattcatgctctcttggtgccgttgcccggaagttctacgccggtatatgtatctacttctatgtgcctatcttgcttatgctattcgcatgctataagcctatcgtgctctatgctatcctattttgtttgatatgaatggtcttgccttatcatttttttcctttccagcacttgttcttgccaacgccttcctaggggaacttgtatcgcccaaacattttgatacaagtctgttttgtgagtggcatatctgagcaaagtggctgaattctttgccgcaacgctgcgttggatgagtgcttacccggacgcaatgctgcagattacaagagcatgcgtagtctgtagtagtagtagcagctttgacagcaggttgccatgtagaatgaactgtgtggagtttctcctccacccaaccgctgtggtgctttgacaggttgccatggagcgtgaacttctcctgcacccaaccggccaaccgaagccttccatgcatctactgtcggcacggccctcatgtggtaggatgctggacaaaggccggactccgcgcgcgatagtacccatctgaatatctgatgcagctgctgcatgggctatctgaatatctgataaagctagcgcaaccgcggaacgaatagtttgcatccctaagccatagtatcaaaatttttgaaccctaacttgcgaaatcggactaaattagatcctgtggcaatataaatgtgtggtttcattgatctattgcaatataaatgtgtggtcgttctaaacttatacgtggtaaaaacaaaagtgacctcatatgtcctcatcgttctaaacttatactcctacgtggtaaaaacaaaagtgacctcatatgtcctcactctcttcctctattcactctacctctcttccccctttcctcgctctctttcggtatcagtagcatcggttggtgccacggtcgcatttctccatcttttgtgacgactccgccttgcgtcccccgagagtcctatcctggataacaacatcgatcccgacaccgttgtccctgtaaggttgcgatgatgccgcccccatcctcgggagccatatctcgtatggcagtgtcgatccacgacgccgctgtcctagctccgcctcgccgctagtgaggtcgtgacagtgtccctcctggtgaggtcccagctccgcctcgccccttcatccttcttcctatcggcctctccatgtcatcgttgccgttgcagaaagaaaaggggataaagaaagagataagagaggagggcagcacaaccggctcaggatgtgaaattaggacacggtgatggcaccaccacttgagctcgagttccaccattactgccgtggcgcttcgtccccatcccggctgctccatcccttccagcttcccgacacaactaggcggcagtagcgagcccacccctaccaggcacatcctcttcgacctctcctcccccattgccgcatatagccgtggtcccatcctctctagtcgtccactgccaccgcctccttcctgcgaatagctagcgagctcgagctcactgattccctcgccttactcctcttcttcttctccgccgtggaccatcgaagccctcctgttgccaacctcccatcactgctgccgtctcactcggacgagctctctggtgccgcttttccttagcacagcctcgctcccatcgcttgtccttcgcccggcctcgctctcatcaggcatcctcgcgactctcctccacattctgcccgtcctctctactacactcttccccgctgccgctccttgttacccctcttgcgatcaaagctgacagagggagatagagggataagaaggaagatattgtctcactaacatatgtgatatgtatagttttttttccttctggtgccacgtcaaccaaaacctcctacaatatcgtgggatctaat

SEQ ID NO: 28828 - DNA, 1837 bp, Oryza sativa
ttatcacgagatgatagctaggatgaagaccctctcttcacagtgcaagtatcgtgtgtgggactcagaaatatctgctagtgggatccataaactcccaagtcccaactccccaccggctcctcctccctcgtcacgcaatccccaaatccactcctccctgccggctctcccctcctcccttcgctgacgccgactcccctcctccctccgccggcgccggctctcctctcctccgggcggtggctcccctcctccctccgccagcgccagtgccggctctcctctcctccgggcgtcgtcctcgaagaagcgacggcagcgtcctctgagccgtgcggtggcgtcgtcctcggggccgagctacgacggcgccctcgaagacggcggtggcggcgcggatctggagcgcggaggacggtgcaagcgcgggacggcggcggcggcgcggatctgggctcctcctctctcggccggcgacgaggagacgaagccgctcgtggtcgttgtcctcctcgctttgtctccactttccgccgccggcggcgaggagagaaggacggcggcggcgccctcggcgacggtcctcggcgacgtctcatctcctcgcaaagtgggccccgcgcctgactttttaagcgaggttgctcgttcctctcctgggatgcgaagaacccagtgtagctatgggccctaccaacttttttcgccacatagactaggtaacacaccacgtaggactaggtaactcccactgtgaaaggcctaagcactacaacattttgacatggactccaccgtttctacataaataaacattcccaatactgaatgcacatttgggcgtgtttggttgcctggcttgtccctagctcgcatctcggatgcaacctgtagactgtttggttgactgcacgtgtcccacagccaggcccaacagatgcaaaaagtctctcgcagccatgctgagcaggaacgaccgaattgagcttcgttgctcatcctggctccacgcatgcagcggcgccgcacccgcgcgtgcagggagagccggagagacgatggggtccctgacaccaccctaccttcttcctcatttcttctatcttctcttctcttcgctatcgtcggtcatggccaccagcgacgaccatctccatctccgtcggccagatcaggctagctgcaagtcctgctcctccctctcttcttcagcaaggggtcgccaagagctctccgccggcggatccggagggcatgagctcgccactgccagatctacctgcacagagatgtcgaagcatgagcttggcttgagctcgtcgccgtcgccagcggcaccaccttcctcgccggcttgagctcgtcgctgcgcggacaccctcgccgccacggacagctacctcaaatccatctcctactcaccttttttttttcgccaaattcagaggttagaagctcgggcctgccagatccgagtagccacaacaccctcccggccgctggactcgctgcaccgacggcggcgaacatgcctagctgggtggcacgagcggctaggtaccggcggcggcaagttcctctgcgagctctgttctcctttttttttttctttctttcttttttccaccgaatgtcattaaccactgataaatatggtttatgtacttctatgcaactgtatatgctcatccgatactgttttcaattattgttgttaggagctccgaaatcaatgctttgtatattttgcatgtactattaaatctgatatatataccataaataaatacgcttttatttcgacggtaagaattctcactattaattctaagtg

SEQ ID NO: 28829 - DNA, 8237 bp, Oryza sativa
cactccccacccggccaaaccccaagagaacccagccggcctccaccacaccacacaccaccaccctcggacacaagaaccgcacgcgcggccggccaccgtcgatgccccctcgccactgccgccgctagccgacgaaccagcatatcttcgccgacctcgacctccatggaccgggcctccgaggagctggagcgccgcagccgctacctcagttcgctcgtccgccgcaccaagctcgccgacccgcccgagccggagccggagcctgagccggagccggagagggagagggagagggaggtggcggcgaaggagagcggtggcggtgaggggaagggcggtaaggtggtggaggagaaggaggtgaaggcggcgaaggagaagaaggagaaggagaaggaggcgaaggtgccgaggggggagggggggaatggggaggaaagaaggtggcggtgcgcgtgcgggcggcggacatgccgccggcgctgcagcgccgcgcgatccgggtcgccctggaggccaccgccccatgccgcggatcgacagcaagcgcctcgcgctcgcgctgaagaaggtatcatccatcctacgcttagcacattgttaatttcttccattcatttcctcgcggaattgttcatcagtttaagtcggggtcgaaacttgtttagatcatttgtaaatggccgtaaatgggggcatatgttgcacactcttaagattaagatctagagctgtttgttctactagcaatgatgttagctttctgccaacttcgggaaagcgtgcttctaaatttggagcatctggaatggttcgagaagctctttggtgttggcagtgaagctagatgagaatgatatgttgacctacattaagtgggaagtaggatggtgccaggtcaatttgttcatttatgagagatggtccactatagggctcgcggaatatttgtgagatttggagaacgtgacagtagttatatttctttgctgctattggtgctttaccacttccaattccaaccatgttcggagttgaatatggatgatatcatgataactaagcatcacatgctctagagagcttatggttctgtgcaatagagctagctttccagcttggtttaattagtaaatatgctagtttctcatttgatgttgagtgatcaagcataattgtgaacaactagttgtgactcatgatcaggaatcaggcagctgatatcaccttttaatgggatttcaaggaatttcttgtggtagagctttcttgatattatcagttggtacctttatctgatggctttccctgaggcggacctatcccttctgtcatttcctttgttagagtcagtaattagagcattgatcatgaaattggaaccctgctacgagtgttgtgaactactgaattagattttgtattcaccattatattttggcaggtagtaagtacttatgtctgtacaggaaaaatacaatcgcaaaaatagggcaagatgcctttgaataagttagttccaaatgttgacatgtttattacacgataaactagctatgaagtaaatggatatcctggagagttgaataagagaatttgcttgctgtatgtgcagcaagcttgttttttgccaaaaatattatgcatccagcttggcagcttgttgtgcaaaagatttgttccttatgacttctagcaagaatatcaagtttttcaaaagatattagtacgttaccctgatgatgaaccccatttcactagcatcctaaaaatacttctatgtaattgatgtgaatgcaaagcatgaatacttttcaagttttcatacattatctccccattctttaaacaaactaatgttgtgttacactgtctgggtgactgcttaaattgctgctttgttttgttattaccttttctctatgaactaagtgatagtgcctacttgtgtgtgcttgctctcttgctattacgttggctggacacttgaggatgcgacgttttcttcaatggccttacatgcattcacagtccttaacaatcaatggctgaaaatgttcctttcatttgctcacaggaatttgatacaacatatgggcctgcttggcactgcattgtcggcacaagcttcggttcctacgttactcactccttgggaggtttcttgtacttctctgttgacaagttatacattcttctcttcagaacagctgttgagccactaagctaccaacgataatgtgcgatatctctatctactgaaacaaaagtgtagattcgatgcaatttgtaattttgaactgaagttgtattagatgctcaacgagtagtaagcttgggtagaggtaaatggccacttctctacatgctaatgctaaattgtaagacagctaagcttatgtaactgccatgtaccacgtgagctcctgctgtgtaagctcgcttttgacttgcaaagctgtagcttaactgaagtttccaaagctttcctgtgtctgcaacaacgctctgtcaattcagctttcaagctgttcaatgttctctcatgggctgatggcctcgtgggagctcaaaaacttttttggtcctcctgatccgtgttaatccaacaagcacggataataatactaaaaactttcttggtgctcctgatcggtgtcaacccaacgctcacggataatactgacaatactcatggtaacattgataattagcctgacagaatgtgctacaccgagtggtgacagaaagcattctggtgagtggcgacagaatgcgctacgccgagcatggacaggcctaggtacaccgtctctgtggagagtccacactataatatagccagctaccttacttgttgccagcgtagaaagaaaccccacaaaactgaagcagcacgcagttgttggcttgttgccagcgtagaaagaaaccccacaaaactgaagcagcacgcagttgttgcccagtgtagaaaccccccaaacctgaagcagcgtgcagttcgttgcccacagcgaagaaaccccagaaaaactgaagcagagaccaagatatagacacaggattgaccataacaataaacaccaataaaaaggcaaacagaaaaacaggaagtgccaccaagcagttcaagaggctcccccacccccaaccaggcctggctccacagacccccacctgctctgctacgagtagcttaaaggcgagactgcaaaaccatcgctagcaacctcacatacgggggagccccagatttcccgacaacaatcacagccacataggtgtcattacacagtagcaaagcactagctacaagcttctagggcacataaagccggctttactgcccctcgctggagtcgcgcttcggagcttccctgatctcttccgcggtgtcctcctgaagccacaaggcacgattggtacagtttgttcagtgatcaggatgattttgacgaaacgggggtaaagatcgcgtgaagagattagtggtatttgagaaatggaaacgtaccgagatgtctgaagtccacagggtcaggttatcacggaggagttgcatgatcaaagtgctgtccttgtaggactcctcgctcagggtgtccagctccgagatggcctcatcaaaagcctgtagaaattggtaagaggggaacatcatgatgccagcattgtctcaaaaaaggtagaagcctcaaagggaccaaagttttctttatggggaggtcaaacaactctctaatggacttagttaatgtacaccacaagatttaactgggttgcaatcaaataacatgacatgaacaggctcagggaatttactactaccatggagacaaaatcaaccaacgaggagttgcatacaaaaggtgtggtaaatactcgaatttgcaatagggaaagtattgtttcttcagaattttttcacttgcaagatggcggataagtcaattagtaccaagtagctacagagcctacaactgaagagcgtattttacttttgtctactattctgttcaagccatatcgatggctaatgtaaattaataccataacatgcaaggatagattcatcttttaaaaaacatgcaagaatagatgcagactcaagacagctaatgcaaggtcagggtcaaccaaaaagaagtgtgatacttaaaacaccaattatcatacaaggtactacacatatagtatagtatggttctcttggattttttttccctaggcatcactataattgaagaacaatgcaaatattttgttctctccaaacaacacctaaacactgtaaattatactgttctacaaatccaagacagaacatcatggtagacaactaaaccaaaaggtgttggctgttctgtccgtagcataattgcatgaacagaaagtgcacataactatgactgcaacttttaaagttgatgttgccagatagcgaagtgtcaccaaatgaccaaaacacagtaaaggaggcatgcggtttagaaatgtaagagcattaaaaatagtacatagtaaaatcctgtgtgcgacgtatctacgcccactaaccttttttccttttgtggactaaacaatgctaacttttcaaagcagcatttatagaatagctatggaaggaaaggaatatgtgacgtgattttttaaaatattatccaaactactgctaaccatatgtattgtgataatcgaattatgtaatcgccacaacaaacatcaatacaccatcaagaagaaaaaaaatcaatgcttaaaaataacatgtaatctctccgttttacaatgtaagattttctagcatcgccaacattcatatatatattaatgaatctagattcatatacattcatataaatatatgaatctagattcattaatatctatatgaatgtggacgatgctagaaagtcttacattgtgaaacggaggaagtaggtaatttacaacaccaacctgctttgcgaggttgcaagcacgatcaggcgagttgaggatctcatagtagaacactgagaagttaagagctagcccaagcctaattggatgagtaggaggcagctcagccaaagcaatgtcctacatcaaaatcagtttgttgttaatttccacaaaacaaagaaagtataatattgcaccaacatagttctgttttttttttcccatagcgtgatcaaggaatatgaaaaaatattcacctgagcagccttgtatgccaccatggtattctcagcagcatccttcctctcagccccggtcttaaattcggcaaggtacctatttattaaaattgattcagcatagcaaaagcaatcacaaactagtaaatgcaaaaataccaatacccatcatattacctgtagtagtcacccttcattttgaggtagaagaccttggactcaggggcagtggaagaggggacaaggtgggattcaagcagcttgagaatgccgtcgcaaatcttggtgagctcagtctcgatcttgccacggtagtccttgatgagtgtgacacggtcctcgttaccacggctttcctccttctgctcaatggaggagataatgcgccatgacgcacggcgggctccaatcacattcttgtatgcaacagacaggaggttgcgctcctccacggtgagctcctcagagtcaaccgtcttggccaccttctccatgaattcgaccatctcctcgtacctctcggcttgctcagcgagcttggccatgtacacattctcctcacgggaaagctccgcctgtgccgacatctttgctatctataaatctaaaaactctacaaatgccaagtctgcaagatcaaagaacaaaaacggtgatgaactaaccgttctttggaggatccatacaaacaatttaaagagtaatccacgatgcagaataaaggcataaattcagaagcaaaaaacagaaaatgatgcattgttgggaaatccatccaattcctgtttcaagtgggcaagccaatgatctcaagtttgatttttgaatttggtaccgtagcacatttcaaagagcaattttgaattactgccccgcaatcgtagcttcagtattcccgagctaactgtacatcagagtcaatctaacaatagatcaagacgagaaaaatcaaaattataagcaaaattctgagaagcaaacatggaccagaaccacagaacccctacagaactcaggtttttgacggatccaaccatactccgtaaaatcacatcaaccgcacacagatcacttcaaaaccaccagagacccacccgattcgtgcagacaaacctaccactaaagcacgcctagcaaaaaaaaatcgctacgaaaacagcagggtttagctgagaattcagatggaaaacgatcccaccaaacggccacagatcacgcgggggatcatgctagcaagtactaccagcaccgatccaatcgaacggaaacacacacacacgaagcgaaaattctacgggaagagatcaaaattcgagagggggaggagagagatcgcagcgaaggaatacctctgtgtgcgtctcctcgcgctctggcgtcgaaattttggggggaggcggacgcgaggaggcgcccggggcccctagaaatgccccaccccagccaatgagcgcccgacgcgtgtccactccaccgtggcatgccgggcacgtggcctcacggccccaccacgcagccgcacaagccctactaggctacttccacgcgggggggacgtcagccgaaggtggggcccacatgtcagcgtcgtgtacggtgggtcccacggccgcgtcgtgctgataagctcggctccctcgcggtgacagcctggactccgttggaccggggcggccaagggcaaagcaaagcggggcggggtttgtttttttttggcacaggtttcggatcttacccgcgagggaggcgtgacgctgccgtgtggggcccagtgacacggtggccacgtgctacggtggtgcgggtagagagggcggtgcgtgtgtggccgtgtgaaccgggcggcgcggcggacagcgggacaggtgaggtgaggcgaggagaggcggcgatcgggggcgaggtgaaggcgtggcgctgagcaggccgcggggcccaccacgaggtggtgctcgtggccccgtcggtgttcggagttttgcagagaagacaccgaatttcgcagacaaaagttatttttgtgctgcaattggtggacaaacgtctggcaaaatttgtgtgaagtttccaaacaagcctgcaattaacatcccaaaaaactgcgtgttttgcgtgggaattcacttcctactacttttgaaacgttggttatttcagctaatcatacggcacagcgaggagtacagagtactggagctgtattgttctcctataatttgcttataaaattcgtgtctaaattgatattttccgcgtatttgccacatcgattctcctctcaaactggactgtcggctaatgacgccgtacgccacggctcgtcaaagtcgtttcgttctaatcctgccgatcacgtctcgccgccggatatctccacgtcaagactagctcggaggtcgcagtcgtcatgcaccgggaggctaatcctgatggaaaagaaaatttgataaatcgatggaggcctaccaaacacatccgctaattaaggcgatggtcgccggcgagaaaaagggcttcgccgatagaaaatttgcagcaacagttggtaggtcgccatcgttctaggcttctattagccctgtatgagatgtgaatctcgttttaattagaaaaaaaaaacagctacgcgtatgcaatgtatttgccatgctgaccgtagaatgagcttaaagcgaatttaatattttgtcatcttccgtgatgtcattcgtatgactttacgtgtaccagctccgttcggttaggctttgatctccaaaggaagtagcaggcgatcatttcgacactatacttggccaacttggcaacttgatgcatccatcactgcatttctttcttgtttttttcgtcggggacgagagaccaagtcggaggctacaaacacgaaatgaaaacaaataaaatcagcccaaagtcattagccgagcgtatgctgacatttgtacgaaattggcctctcggaccatttaggccccctaatagcaagatgctttgagagggccacggattccactggtgggctgaatcgctggcaagttcgacaaa

SEQ ID NO: 28830 - DNA, 2619 bp, Oryza sativa
ctccccgagctattgaaaccagtgcaatttgaatcgctcagcggttttgcagggcggttttgctgatgtggcaccgacatggcaatgttgacctagtcttcgtcccatgtggtgctgacgtgacattagaattaaacaaatatatgtgggacccatatgtgattcacacataaaaatatattgtgggtcaactgacatgtgggccccacatgtcatcctccctctctcttctctctcccttccctctctttctctctcatggcgcaataagccggcaggggcggcgacgacgggcgggagccggagtggcagcagcgatgggcgagggccggagtggcgtcgggcaagcagagacatcggcgagcagtggagacacgagcatggcgcaggggcccgttgagcggcagagacgcgggagtggcgcggcgttggggatgacgacggcggtgctcagcctcgatctccgccgcggcggcccccgctccggctcaccaccgaattgcgccaccgctgcctccgtcgcccctttcacgcccacctcgtcccctccatgctcgcccgctaccccgccctctcccgcctcgatctctccctctgcccgcgcctccccgatgccgccctcgccgcgctcatcgccgcgccgtccatctccgccgtcgacctctctcaatctcggggattcgctgccgctgcgctcgttgctgcatgcccgaactcaatgacctcaaccactctaatggcccaacgccgctccggcccttgcccgctgccgctgccgctccggccatcacccgccgccgctccggctcccgaccgccgccgccgcccctgccggctgattgtgccacgagagagaaagagagagaagggagagagaaggaggatgacatgtgggccccacatgtcaatggggcccacaatattttttatgtgtgaatcacagatgggccccacatatatttgcttaattctaatgccacgtaagcgccacgtgggatgaagcctaagtcaacatcgccacgtcagcgccacataagcaaaactaccctccaaaaccgctgagggagtcaaattgcactggtttcaatagtttggggagtcgtcctatccggttttgcggttgagggtcacggattagattcgggtcactttttagggagtcaaagtggacttattgcccacaaaacctttcatagcaaatcagctcaccaagtatgatgggcccatggccaatgataatacctcgccgttgctttgcagcctgtccattccattggattcattacttcagcctgtcatcgtcaattcgtcatcagttcatcgctcgtgtctgctctgtttagacattcagtcgtgtttggattcataaaatcctgtttagattcatgatctacggtgtttaacctaaatcaaccatctttcctcaaacgtgttcattatctaaaccaaaacacatatggtcggcatttcggttcatgtgccacgattgatctactcgattgatatttaggggaagcagacacaaaagcgttaattcccaaatgcccaaagaatccatctagatgggagattaaatctaatcatcgaaatcaccatcatctcgacataacagaaaccaaatcattgctttactgggggtcatgtattgctcggaacggggccaagattccaccggttctattcggcacccccttttgaaccgcgataagttttgataaactgaggatgaacagaggcctctccttttgtttcggcacctaaccaataatcatcgctcttaattatgatctacctactttatgtctgcacccgaatttttgggacttcttttccaacatgtgtcataaccaggaaaaaaaagcatgaaccccccattggtttagcttctctataagtatgtcctgtaatcaacagctgtttgcgtgcaccgatcagacttgagtatggtcacttcttcagttcttcctaaggtctgcgaataatcacactgccattttttgtgaccaaaacgtgccgaagctgactagctagcttggaattagtgtccgtgatgttgtaatctagtggatcatggatggaacgaggcgtatatgaatgtgtctagaatgcgttaatggacatatatatcttccatcgatcttctgcttgatctaactctacacgcattttggggtctttttctttctttctcaggtggttgatgatgccggcgagggcgaggccaaccctcgccgggcgaaatggtggtacgcgacgttccacagcgtcaccgccatggtcggcgccggcgtgctcagcttgccgtacgccatggctcacctaggatggtaagtcaattatactgtacgtacgcgcgccatggctagctggagctgtgtgcatgcagcgaatgactgtggtaatcgatcgaacgatcgagcagggggccggggacggcggcgctggtggtgtcgtgggggatgacgctgtacacgctgcggctgctgatcgagctgcacgagtgcgtgcccggggtgcggttcgaccggtaccgcgacctcggcgcgcacgcgctgggcccgcgcctggggccctggctcgtcgtgccgcagcagctcatcgtgcagctcggctgcgacg

SEQ ID NO: 28831 - DNA, 12471 bp, Oryza sativa
  unsure (1)..(12471): unsure at all n locations
ttcctgcagccccgtctccctcgccgccgccgccatgtccgtcggctactcgacgatatcatgggcggcgtgcttggcgaggggtactcccgcggcggcggagggcggcggtgggggggtgagctacgcgtacaaggacgggacggcggcggactcggtgttccgggtgtgcagcgcgctggggcaggtggcattcgcgtacgccgggcacggggtggtgctggagatccaggcgacgatcccgtccacgccgacgaagccgtcgaggggggccatgtggaagggcgccgtggcggcgtacctggtcaccgcgctctgctacttccccgtcgcgatcgcgggctactgggcgttcggccgcgacgtctccgacaacgtgctcgtcgcgctgcgccggccgccgtggctcgtcgccgccgccaacatgatggtcgtcgtccacgtcctcggcagctaccaggtgtacgccatgcccatcttcgagaccctcgagacgattctgatcaccaggatcaggctccctcccggggcgctcctccgcctcgtcgcccgatcagcctacgtcggtaagaatcgatccgatcgaccaccacccatcgctgcaagaactgatcgcatattcgcatccgttcatggctgaatcatatctgtcatggcacgcagcgttcacgctgttcgtcgcggtgacgttcccgttcttcggcgacctgctcggcttcttcggcggcttcgggttcacgccgacgtcctacttcgtaagacgcgattgcccatccgaaatgaacactttgccataattctcgtaacattcggtcttcaccatgacaccatggatgaaaacatttaaatttcttttgaatgcagctcccctgtattctgtggctgaagatcaagaagcctccgaggttcagcgcgtcgtggtttgccaactgggtaaataaagacacacatttttttccgtcttccggacactcatatgaagcaaaaactaaactgaatgcatgcatgtaactgtagtagtagagattcaggtttgacaggttctgtttgtttcttctgcttcatctgtcagggttgcatcgtcgttggagtgctgttgatgatcgcttccaccatcggcgggctacgaagcatcatccaggatgcctcgacgttccagttctactcgtgatgggtgatgatgcatacgtactgacttagtacatacagaacgtcaggatcaactgtaaccaggccaagaaattagaggtatcaagagtagttgcaaacgatggccatattattctgtgactttcattgatcgttggcctcgcttgcagcgtgccggccagcggtccttgcgaaatgtgtaactgaagacgaattacagtagtgattcagtgatgcgcatcgaccctgtctgtgcaccagatgtaatagaccttgctgacacacggtttcgcaatcctcatgctgaataacatcgatggcgattgcagggagaaaaatatatataaacatctagtaatacaagtttactatcgcagtgattgcgaatcttctattcttctgtttcgagtgcctcgtctttttcgtttatgtttatatttgtcagccaaaatttgaattttcaactttaaatttgaagctgattttaaatttcttttcattgaagtttatttttcagcctttgctttaaatcgctaagaacacatatataaaagttttattcacaaattactttttgtttgcaaatatgccgtttcgcacaatggctccgcgagtgttgtaactttaaccttgaaaaaaaaggggaaaaaaactcagaattgtcttgtacatactttatctgtattataaaaaaccaatctagaatcggatatgatatatcctatgtttagattcttagcacttcctctgttttataatataaaactttctagcattactcatattcatatatatatatatatatatatatatatatatatatatatatatatatatatatgtctagattcactaacatttatatggatatgagcaatgctaaaaagtcttacattataacatatatatgtcacatcggtattaggttggtgttgacgaaaaaatcgaacacactggcctgggagatctgcttagctcctgtgcaggtccaaatcttgatgagatgcgggcgtgccagtcagtttgatcctgtaactgacaagatatgcaaatagtagatcaaaacagccgatcgactgacaagccgatggagtagttccagccgatagccaataatagccgatgccgataccagccgatagcgatagggtttaagcaatcggctatatgtccaatgtagatgatgatataaaggcaatcggctgatgacgatgtaatgaaataacaatataatccagtataaaccaatcggctagcaatgatatgataaataagcatcaatctgaaggttaaagcacacatcggctggaggtccgatgtcatgaaatctacaagattagattaaacagtgaaacctttattgtcatcggctaaatccaacttatatgtatatgcaatccttatgagccaatgcaacgtccagataactcaccggctgaagccctgatgaaacccttattggcaatcaagaagcagactagagattatggttctaagcacgacttagtagatcaaacttaactgatgcagcactaagtatgaaaagaaacataatatctagacaatcaagccgttgactgagttttcagggtggtagatgtctaagctaatctaatctagcaacgcgatttagccgataccggcataaatcctaaaacgagaagcagccgatagagctaaattgatatgctaagactagattaatagagacatatgataaataggtaggcaaatatatcatccaaaccagagcaatccaagaggtcgaatgtactgatgcagccttgaacgacgccaacgtaaacgatacaattgcccgggccggtggaacattggacttaccctttagccggagatcaaacaccgatgcagccccgcgtcaggtgccaagtcccgccggacgataaaataaagtagaaaaggtaaaaggtggcgatgcgccgaattgtattcatcgtgaagatagattacatagaccccaagtgtacatatttatacccatgggttgatacaagtctttgtcggacaagaaagaaactttactaaagataaaaggaaaagataaagtccttataggacactaaacacactttactaaagataaaggaaactaacaaactatttctaattaatagataactgcattatctttgaactcgatctcttctggataagcttcctttagtagattaatttctttaaccgaatatagtaagaatccgacaactgacgacttacaactcttatcggctaatctcaggactccgaagccgatgctgactctaagccgatgactactccgggcttaccaaatttctgttaccagttggtttttcctgagacaaaatccatcccgttttataagttgtaatatgccgtgaccatataggccacgtatacgacaccttgttccacacaaatcgtgcgccgcagcgtcgcgcccggaaaaaagcgcttatcccccgcccctctccaccccgctccgcggccatggcgatggcggcgcgaaccctcgccctcgcattccccctccccctctgcgccgtctcctccccgcgccgcgccaccccactcgccttgccccgccgcggggcggcacgaccgctggcctcgctagcccagtgccccgcgcgtggccactccccctcgccgcggcgagcagcggggcgggcccttgcgccgtgcgcggccatgcgtggcagcggcggcggtggcggtggcggagagtttgcctcggacgatggcggcggggcgcgcgcgctgcttcgggcgacgctgtggggcgccgaggccgcctacatcctctggctcttcctcctaccatacgctccggtctgtacgtaaacacgaactttttttgctcctgtttgtgtagatttcgaagacaccagattttggacattgcttcaatgaactggattaaaattttgccgccagtaatgcattacagtacaggcttacaacattagttcgttccgatgtacttacaaatagggattactagcattttgtgtatgactatcttttgattactcaacatcaattttggtacatttgcatctatgaattgtatttgtacagtttaagaccaaaatgcattagtgcttcttcgatgtagttagcaacatcggtgtatggcaatacttttgattcgttcattagtgcgtcccgacgtagttagcaattaacatcgttgtatggcaaaactttgattcgttaagatcatgcagggtgacccggtgtggggtatctcgcaagcaacgatcagtgacctcattggcttgtcgctcaatttcttcttaatcctgccattgctcaattctggtacgcctgtaatttaagaatctttagaggcactctaatttgaagttcacagcattacggccattgattctattggtgagttttctgggcagcgtagctggagttcacctgctcgaatccccggtgttgcacccagtaagaaatcgatctgcatccacttatcacattgtgattgttgccatgacttgtgggtacagcatttgtgctaaatttggtattactcgcctaggtggctgaaggattgttcaattttgtgatcgcttggacactgctctttgcgccgcttctcttcacggattctaggagggatcggttcaagggatcactcgacctactgtggggttttcagatgttcctcacaaacagtatgatctaaccgacaagaagtgctttgcagctcatggatagatcacttcagattatctaacaacaatttttatttgtttagctttcctgataccttacatggcaatccgactcaatgatcctgacaaggacaagtctccaccacaaacatcaaaattgggttcagttatggtaagaggtgctccaattgtcggcctaactggtggcttggtctgtattttgtcgattgcttgggcactctttggtcgcgcggatgctagttttgggggcattgctgaacgctggcagtatgtccaaagttatgtcttttcagagcggcttgcttatgcatttctttgggacatactgctgtattccatattccagccatggttgatcgcggacaatattcagaacgtgaaggcaagtgctactgagtttgtgaattcagtaaggtttcttcctgttattggtcttgttgcctacctgttctgcttagaggacagagatgattagctgctgacatgtcataatttctgtggccaagtatggagagatttatgttaaatgaattcttcacttggtggcacattttctgctctcctaatgttcatggcaaggaaaaaaaatcgatggcacaaagtacttcccttgaatgcctcaactgctaaatccatttgctatgaaaaaaacaacaggggacaactaaataacttctctacggcacaattctaatctcccctaagtcttcagaatgtcagagctgacaccaacgccataaaaccaagtgcgacaggaacgcagtcagctatcagcttgagcccgctgctgtattccggcgtctggctgcttgtcttcggtgacggtgtcatctgttgcggcggcgcccgtgtcaccgtcaccggcgtcggcgtcgatggagcagtggagttcggcgtcgagcgcgggacgctcaccggcggcgatggcgctgctccccctagatcaaaccctacaagagagagttggaagaaatttttcaggttggtcgccgacgaagaaagacagggaagaaaaaaactcgggacgccggcatgcgatggattggacgcggcgcacgaccgaggctgcacggcgacggcgagatcatctcggttacctgggcaggcggtggccgccggcgggaggtcgaggcggcagaggagaggcagctgcaccgcgcgcgtccggttcacgggcaccgggatcgcgccgccgccgccggactggctgagggcctggcagaggcagagcggctcgtcgtgcaccatgctgcccaggttggcgcagcacgtgttcgacggcgcggcgttgttgccgccgacgaagccgaggcatgggaggagccggatgaggccggcgttgcagccggacccggacgacgcgccgccgggctgcgccgccgcgccgggggcggtgaccagcagcagcgcagcggcgacgacgacgacgcaggcggcaacgacagctgaagaagccattggtactggtacgtactacgtatcctctcctagcttagctactcctttctcggctgatttctatgtagattcattagttgctttgagatgctaggatttatataggcatatagcactggaggaatcatttaatcacaatgaaaacgcgtggttgctatgcatggcagcatgggaatggtgtgcttgatcttcttgggggcgccgattcggtgattcctgtgaagttgaacgcgccatgcatcgcatgcaggatgtgcgttctgtgtgatcatattgtagcgtttaggatcgagttggcatcgtgcatggtgtgcatgtagtaccatgtactgatcctctctaggtcggtgtgatttctattgaaaatttggaatcagctgttacaacttaccagccgcttgaaactgctaccttgcatgctgctgatagctaagctaaggttagcagagtttagtttgatgccaattttggcgatggctacctcttatcaagctttgataggagtgaattgatttgtggagcatttattttgccgctaaaatttgggaatatagcttcctcacttggatctatagtttgattcatccccaaaggtgaaccattgttgggagtaaattagtaagcttggtttggcagacttgccaatgcatttcccaattggtcagtcgctctcctctagctcactaactagtgagaggtactgggccacgggttttgctgggccctttccgattgaatgctattatgaagaaggccacatcttcgcttgttgggctgtcgtagggatggcaacagggctgggttgggcaggaacgcccccagccccgctaccttgttcggggcaaaaagctcgaatttttttcgtttttagattttttttaatatttacagaaataatctatcaaccaaaaaaattgcagaaatagcccctgccgcccacctctgggacggcaagctgacgtggcaaacgggggaggaacgggcggtgacggagggagggttttttttgcaggaaaacccttgccgccctctggtggggcggcaaggggcccgaatgcaaaaaagccagtcggggccggctattttgcaggcggccccttgccaccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttagaattaatacattaccgttgcattggcttacacaagaagatattacgttgtagatgtttattgcatgaaagagtaatatgatctagttatttcgttgacagatatgtcgaacaaacaaatattccaagtttaccatggaccaagaaacgtccgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggcgaggaaccaagtgttgaagtaaacgagacttctgtggaggaggtcaatgcacgagaggacgggggcgtagtagctccagtgggcattcaaccaggtggagtggccgacgagggggagactgtcggtgccattgtggatgaaatggagagggaggattctgacaacgagcgtgtaaaggaaggtgattcgtcagatgatgagacggatattaatccagcagaatgggctagtgaggatttttctgggctgatcgtctctgaagaggatagtgtgagatgggagttcaaagaaaatgaggttatccagggagcgatttatagtagagcagaagatatgaaggaggcggtaaaacattttgcagtgtcacttcatagagagttttgggttgccaagtcgaaccggtcgcaatatgaagttcggtgtgttaaggaaaaatatggttgtccctggagagtgcacgtgtataaggggaaatggaaggattattggacagtgtcagttgttaccaagcatacatgttttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgctaaggcctggagggccaaacagaaaataatagagatgagatttggaacttacgaagcctcgtatgnnaccaattctgnnccacgnnncctgncttggnntgttatcgagnngaaagaaannncctgggnnagctcttacnngaaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaagccaaatgtatgtctgatacatgataggcacgctggcattctgcgagcgataggagagttgcagtttgggagtatggaacgaggataccccggtgtttgggaagatgtacagagtaggtggtggatgcatcatatgggagctaatttcttcaagcaattcaagaacaaggagctcatgaacatgttcaagaggctgtgcaatcagaaccaggagaaaaaaattcaatgagctttggaagagattaggtgagttgacagccaaatgcagtgatcagcgtgcagcggctccatcgaccgccgttgctgaccctcctcaagctcttggacctctcccaacggatagtccaacattagttagaagaattggattggagattcggaaattttctcagtggattctgcatgaaccaaaagagaaatgggccaaggcttatgacacaggtggtgctagatatggaataatgacaacaaatttggcagaagtttacaactgggtgatgcgcggtgtccgtggactgccactagttggcatagtggagctcattttacatgggacatgcaggtattttagggatcggttccaggcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttcttaaagccgacggcacatgtcattgctcttgtgcaaagccgaagctgctccacaggccatgcacccatgtcattgctgtcgcagcggagtgtggcataccagatgcagtatatgtgtcacagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctagctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacagtaatattttttgaattgttctaacacgaaacactatatttttcagagatggcacgtcaggatacaccttagttgttggacccggcgatagatcaccgacaccggtctcaccttactgcggtgggtgctcagcttgggacgttccgggcacggacgtgcggtgagctactcacggttcacgactcctttgtcgagaggtacgaacagtgttttactataagttagttgcactgtagagcagtcttctctttgtttacttgcttcactttccagtactgtatgcttgtgtaatgactacgttgttgttatatatgcacgataccttttggcgcatgcacgatacctttcggcgcatgcactactttctgccgcaccgatgcagcctcctttattcgcgtgtgatacgagtatttgcccgccatttggcacatacgaccaatgtaactttcggcgccgatcatgcatgtatctttcggcgccaatcaggcgtacccaccataccccaccacgttcacatgtcaggggtatcactcgattttttgcgcttatataagtcgccttaacgagtgaggcctcacaatctttcagaactaagtcacattcagtactctcttccccacttgcttcattacaaatccgaccggctttcgtcaatggctagacgccgagatgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcagcttatgaacgacaatgtcgtgaacaacagagcgactggcgggtgctaactacggcactccctccatgggaagcccgtccaagatgcaagtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacaccaaaagggttctaactccacctagccgtgttgtgcagcttgaactaccagagcaatacagggttactaaagcgcggtttgagagaggagagggatcctcacgtaggggttagctattatcggacaacttagcatattgaaatttctactgtcatgcttccttgtccca

SEQ ID NO: 28832 - DNA, 12383 bp, Oryza sativa
tgccacgtcagcttgccgcccaccattaggacggcaggggctatttctgtaatttttttggtcgatagattatttctgtaaatattaaaaaaaaatctaaaaacgaaaaaaattccaaaaagctcacccttccccggctccggtgggttcccaaactctgaccggggcccctcgggtggtgaaagaagaggagaaccgacgacatatcaggctaccagtgacagcagattgggttggggcgagggatggcaaactactggcacctcgaaaggagacgtaggagccagaggagtttcgaattgtagccgaggagcgtggtcgacacatgtgttggaatgttgcaggggaggagccccggacgctgtcgggaagatgggagcagagaaggtggggaagcttcgtactgcaggaaagaactttgcgttgagctgggaagagcgccggctgtcgcgggaacaaagcttggtgggggcacggcatgtgcgctccgcctcttcgagaggcggacggcggacagagggatggagacatggagtcacggagagatgggggcagctataaaaaagagatatacagatagggttgtgctagtctacggttcatatttgggctagttgttgtgggctttcctctctaaattgtgatatttgggccaacttgcctctaccaagtgggtctcctgggcttgcagtgtactatattttaagtgctaacaaataccccggggcctcgcgggtaagtttcatcccccgtcccctcaaatgaccgggaccctgccccgacttccccatgggttagaaaatcccccgtccccggtccctacgaggaaattgccacccctaagctgtcaacagctctgtctcctttcggctgatgggtggtggcggtgaaggggtagaggtattgtaggaggtaaaaaaaactggagtaataaacaagcatcttagctcactgcatatatagtgaagagtagcaaacataccaaaaaaataaatattaatccaacatttagattttttttgtccgtttgctactctttactccctccatctacttttgatagacatatttttaaatctgaaaaaattatttttatagacatattttaatccaacaatctatcatcttaatgactttctcagatataatgcgtgactctccattccttcataagattggctacatgtgcatcgagaaatgtaaatattaatgaatcgcttgtttatgagaaatgactggtagcatgtttaaatggatgataagtagaattacttatccttgatctgtgtgccaagatgaaacatgactatcaaaagtagatggatagagtaacatatatggctgagattctgatttattactccatatttctttttagatttttaccttatcaatctcatcaccgcatgattagcaactattacggtgtaggggtggagctgcctacctgccatagtgccatcaaatgctggtacgagatggaaatagttacgttagtttcgtgcttaggattagcacttcgcgcgattttgatacttatgattagtgatgcaatgctggattagacaccgaagtcaacacacagtactgaaaaacatgatgagatatttggtcacaattaatcagtaaatgaaattgtttcagttttgcattgaaataatgaaattgttttgagttttgcattcaaatgaaattttagcgggttgcaaaatgaccaatgatttttcttaatgaaaatctggtgttgtggcccctttctctaaaagcaatgaggttgtttgaaaataatgtgtaggacttctaaatccacttcacatatgtgcatgctctttacacgtacttagcgataattggaggcgcctaaagatccctcctgaaagacatgcacatatgtgtactcttaaaattattaattgtacggaatacagtgttgctgatgccatagatttggcattgttggcacagtgcacatgctagctatttggccacaagccaacatcgatcctagttaaatcacttacagtagatctttttttttaaaaaaaagaatactatcgccggtatggattctaaattgtacaattttttttcgcggacaaaagcttatataaccacccaaaaaccgcgttaaattgatttgaattggagtaaatttcaaggggaaaaaacgtgcattgccccatcttctcataaattctgtgttttttttggttaatttgatcttgtcattgcaaacgtgtgacttttacagtacaatatacaacaatagtatatactgcaagtatacatgatctaacggtgtagattgatttgattttttagttaattagattacagtataaaatttgaaagagtaattttgtcttttctttgttattctatcaaatcgtgctatcatcacgtgtttcgtcatcaaatggcggtcaggatgctcctcctctagtgcaccataagatccaggactaggtactctcaattagagtcgctcagtattttttttatgctttcaaaaaaaagtgtattttttattttctatcaaatttctaacatgtcattctatatactaccagtatatattgatagtatattgtaccataaaagttctatgataaatgccattacaaattacctattcatagccgtgctactcaaattttataaaattagaaccataccatcaccgtgacgtttttcatcttcttccccatctgcacgtggggtccacccctcagattcatcttcctccttttttttctttcttttttctcattccctaaacacatttgcaatggcacggatcaaatcaatctcttttttttttctttttgctctacattgtcttcagtacaattatctgttcggtcctacccgttgtcggtgatcggaccacccagctttccggtccttaaaacggagtagaagaacgggagatatcaacgtgaagtacggctaccggagtagtagcaagttgcaagctctccccggttgtttgaggctggccggatggccctggctcctcgcatcaatcacgggctgcgccgaatcgtcaagaggcgtatcgttgacggatttatgtctgatttgatcgagcttgagatcgcatgtatatttgtcgtaaaactacaaggccccctcgaagcttgaatgctatcaatgcaaagggaaggagccaacgaaggagaggcgagagcgttgagtttggtaagaaaaaaaaaggaaaaaaaaagaaagctaatagaatcgaccatgcatgcaatgcaaccactttttgatactgatgtccgaatagaattgaaatcaacattgattgatggagggaattggctagagagtaccccctgtcttaatgctttggcttatatggctaagtaacaatgattagcttggaggttaagcccaggaggtaaggtgactcgatcttccctccatatgatgccctttagaccctacttaagtctcatccaagagaattatgcatcagtatcatcactgtattcgctagtctgtcctgtgccgcgtgcaactgatgcagtgccatgtttgggtgaaacatgtcttcagaagttcagatgtatctctggagagaggagcctgccactcatcccatgcacttcaccgacttggagggcactcaattctatcccaagtttccaaccacatccagggcccggacattcttcaaggatgctaccaatctaacaacacagatacacaagggtagggcatatatggtacagtttgttaaaaacacacctcctgacagcttgtatgtagtactaccagtagctgtaaagaccaattcaaatgtgtgaggccaagggcattgaattgttctcaggggagaataatggtctcagatcagcaatggtaaatgggggtactgctgctgataatattattgcttgcatgagggccatagcccatacagccttggggtaaacttgcatgagggccatagcccatacaaccttggggtaaaaaacaaggctgcagagagcacacaacaaacttgcaaagggacagatgaacaaagacaacaggagcaactggaggctgctataaaaaaaaagtgaatttctgtgccagattgctttactatacatttgaatcttactgaccatggtagtagtaataaattagtaacaagttcaaactgagctgccatgtaacaagatctagttttggataagctgtggtccatgtttagtgataatgatagtatattacctttgggttatatacatatgacatggatagcatatagtgatagcggttatcaagccccctttagaacggagaaatttcacgggaatttcgaaggcaatgaaccaattcatgtaaaattcatgcattccaaaagagcatcccagatttcttcagatattaatttgtgcctcatgtagtgtacccaacatcgtgaaatcaaaccatttttctatacccagcttcgtctttaaaaaagtaccaaatttgccaacgactcctttggaacaaagtaatcttggaggaatttttatagaattcaaatcctatggaaagtgtcctataggtccttttggaacaaagcaatggctgtttttggaggattttcaacataagacccaacctaatttaaaaaaaaatcactctctttctctctctctctctctccatctcctaattcctacattttccatgcgttatatccaaacaattatttatgtagttttgatgtgatttttcattcataggatttgaggtgccaagtattcccgtgtttcggaaatttcggaacactaaattaaaaagaggagtaattgcccaagagagaaaaaaaaggaagtttgatacagcaggtcaagctcaaggtcaaaacccaatggggcaggtgcgtatggaggcggtgacgcaaagcatatacacaggtacatacatgcaacaatgccgtcactgactcgccgctctgctgcacggacctgccattgccatgggattccttggagtggcattgaagcctagctagctctacgtttgagctgcccccgtgtgtacgtgcctgcccgccgatcggccatccccttggatctcgcagctttctccagtttcagcttttgcttctccttctcccacgtcctctctctccctgaccctgagccaaagaatctctccatcctccatccttgaaatggtttgatgcctgcaggcatcagccatgtccagttcagccagaggaatcaccctcctctgcctcctcttgatcgtgtcatccactgttctccacttctcgatcggcggcggcagcaatggcgagaagaggagagacgatggtgatggtgacggtgacgatgagaaggtgaggttgttgcttggtgccaacgctctgggcgagcgggataggcggcatgggcatgggcatggaggtggtgtctcttcggcgccggcgccggctccggctccggctcgtgcccacctgccgccgccgctgctgcacaagaacgcgcggctcccggacccggtgcccggtagagtcgggctcgggcacaggagggggaacgccaccgcggcgcacagacggcgcagcgagcgggaagggaagaagagcacgccgcttgtcgtggtcgccgcgggcgccgcgctgtccggcgcggcggcggtgctcctcgtcgtcctcgtggtgttcctggcgtgcaggaggttccagaggagggccatgccgggcgctgaccagagcgggacaaacaaggtgagcttcgatcctggccccgacgtgttctacctggacgccgtcaagccgtacgtcgaggccgaccatggcggcggcggcggtgttgtgaagacggcgccggagttggccgggccgaaggaagagcccaggtgcgaggaggaggacagcggagttgccctgtccgacgacggcgccgactccgtccattcctcgtgctgcttccactcgtcgcacttctcctactccgagctccgggacacgaagccggggagcaatggcgtgtcgccatcgccatccggccggtcaagacgacggagctccgcccctgtgacgccctcagagaagaacaaggctgcgagcccttattcgccgcagtgcccgcgcacgccgagcaacagggagcgatcgtctcgcgcccactccccgagctcgtcggtttcggacttgacatcggtgtcgacatcggtggtcaaggatcatgaagtccggcgagccgtccattccctgatgtttccagaagcgcagagcggcggcgcggggcacgtgaaggaagacgaggcagaatcaggcaatatgaggccgcctcctcctcctcctccgccgccgccgccaccgccgccggcagtaacacagcagcaggatgtcaagacaagctgtggaccggccgttcccccaccgccaccgcctacgcctccgccgccaccgccactgctcgcaccgaaacagcagagcagcggcggcccgatcctcccgccggcgcccgcgccgcctcctctgttcaggccgtgggcgccggcggtcgggaagaacggcgcgccgctgccgaagctgaagccgctgcactgggacaaggtgcgcgccgcgcccaaccggcggatggtgtgggacaggatccgatcgagctcgttcgagtacgtacacccaaaacccaccccatctcccctacgactacgaacgagctcgaggtgttcgacacttcgaccacacgagcgtacacgttttcgcgccacacgctgatcaaaccacgtctgattcgcaggctggacgagaagatgatcgagtcgctgttcgggtacaacgcgaggtgttcgacgaagcacgaggaggtgcagagccggagcccctcgctcggccaccacgtcctcgacaccaagaggctgcagaacttcaccatcctgatgaaggccgtcagcgccaccgccgagcagatcttcgccgccctgctgcacggtaaccaaaccgcacggcacgatcgagcacgaatcaacaccgtcctgcacggcacagttggtgtgtgtgtttaatttgagttttttctttctttctcttggtttggatggattggtcgcagggaacggcctgtcggcgcagcagctggaggcgctcatcaagatggcgccggccaaggacgaggccgacaagctgtccgcctacgacggcgacgtcgacggcctcgtcccggcggagaggctgctcaaggtggtgctcacgataccgtgcgcgttcgcgcgagtggaggcgatgctgtaccgggagaccttcgccgacgaggtcggccacatcaggaagtcgttcgagatgctcgaggtgaatcttggggtgttcgtcgcaatggcggtcttactgattctgcagctttgtgattatactattaagattctgagtttggaaatggcgtgtcgttcttggtgtctggaaggaggcgtgcagggagctgatgtccagcaagctgttcctgaagctgctggaggccgtgctcaagaccgggaaccggatgaacgtcgggactgcccgcggcggcgccatggcgttcaagctcgacgcgctgctcaagctcgccgacgtcaagggcaccgacgggaagaccacgctgctgcacttcgtggtgcaggagatgacccggtcgcgcgccgccgaggcggcggacatcgccgcggggctcggcgccgagctcaccaacgtcaggaagacggcgaccgtggacctggacgtgctcaccacctcggtgtccggcctgtcgcacggcctgtcccggatcaaggagctggtcgggagcgacctgtccggcgacgagaggaaccagtgcttcgtggcgttcatggcgccgttcgtcgcccacgccggtgaggtgatccgggagctggaggacggcgagcggcgggtgctggcgcacgtcagggagatcaccgagtactaccatggcgacgtcggcaaggacgaggcgagcccgctcaggatcttcgtcatcgtcagggacttcctggggatgctggagagggtgtgcaaggaggtgaggggagccaagaattgccatggcgggaatcctgccctgaacctgaacaatgtatgataccgcaaatattggggtgaaagaacaacattgtaattcttggcttcggattgttcttgacatgatcttgccagattagaacagatcagttcgtttagattacaagcatccagctcttcatctatccgaagttccgatgtgcattgcacaatcatgcaagtatgccaaaatcacaccgtacaagcgttcctggtaccgcaaagcagacagtaccactactatgtctgatacactgaatatcactcttgatctgggggaaccagtgtttgaacgttgagggagttcaaaacaggaacacgacaaggttgagatgagatgcgcgaaatagcagtggtactggtcgaagccgtttgtttgctcccgcgtttcttccgcttttgtctctttgccatgattcctttttcccagcagaatttgaatccgtttgcgtcacctgcagagtatcagaggcccacgttgttatcagaaccgctgtttatttccactgctgctgtgtctgcctcgtgcttcttcaggcccccccgaggagttttactgccgactatataactagtatacgacaagtgacagtatagaaaactaccgtactcatgttagtgttgtgataagatacctacgagggatatcattatcacgggagcatggagagtttgaacttttgtatccgtaagcagagacagtacgcatgatatgtgctaaaaaatagtactagctgaaatatacatcaaaagaggcatctgaatcttggagaccagcctgaggtaacagcacaatggtcttcagttatatacttcgatttagagagtaagagcttttcgtgatatactgtatttgatcttgataacaagcagagcaagcgtgccaaatggccttggccggaaccaatagccgtcggaataattaactatttgccactcttacgagcggtgctaaattatttgcatccggtaactgagagctcggcccatgagctacaattgtcaccactaagaaaaaagtaccaaaggtccctcaacttgtcatcgggatataaaaatgtcctcgaaccgcaaaaccagtatgcggggtccttaactatacaaaattggtcacccgaggtcctttggtggcggctgagtcagcgtgggacccacgtggggcccacatgttagggttatccacgtcagcctcctctccctctttcccctcttctctcccttcctcatctctttctctaggcagcctcctcatctccttccgccgctctgggcaggccggcgccccgcccaacgggtggggaggagagcaaggcggcgacgcgacgcggcggcggcgccaactcaggtgacaagttggactgcgagaccatccgctggctcacccgcgagctagggcacaagtccgacagcgagaccatccgctggttcatgcagcagtcggagcctgccatcgacaccgccacggggatgggcaccgtgcccgcgatcaccaccattgtcgacggtatcctccgcatccccactgagtcgccctccgccgtcgcggcggctgcccgcggcgatgagcccaccccaaagcggcgtagcaagctccagccgacgcgcgcggcgaccgacgacccggtggaggcgctggccatggctcatcccccgcggtctactacccctttgttgctgcccccctcctccaagccaacggcggtggctcgatctcaatatccagcggcctcgcccccgcctcatccgcaacagcacccacagccgctggaggcagcacaatcccgttcatcgccatgccggcagccagtgacggcggcaagcaggtgatgtcaccggtgactgtgtggatgctcccgcccggcggcgcgggcgtggtgaaccagccaatgcaatacttggcgttccaacccaaccgcgactaggccaacttcgccagcagctccaactcccagcattagccattctacaacgtggggcagaatcccggtgtccagaattcctcggttctcctctccgccgggctcctccctcgccagtcgccggccgcgccggccctcccctccgccgcgccgcccgcgccaccgtgcgttgccgcctcacctcgacggacctccagctgctcccccgccgcccgcgcatggagaaggccgccaccgctcttctccccagcatgttcccgcctcaccactgctcttctcccctgccggttgccggacctcctcctctcccgcaccaagtcggtgccgcaccaagccgccgccgcatcgcccgtcatcggccaaagtgagagagagagtggaagggagagaagaggggaagagattgtcctacgtggcatcatggcatgtgggacccatgtgggtcccacgctgactcagccgccacgtaggacaaatccagcgtcaatactgccctaggacctcgggtgaccggttttgtatagttaagggacctagcatatctggttttgtggttggaggatgttttttatctcgctgacacgttgagggacctttggtgctttttcctcaccacgaactgacgtcaaggcccaactcgttttcctgtcctggtcggtcaaatacctgaaaagcaggccgtgcacaacaccccaaccagagttcagtggcggttctcctacgacaggcttatccttagagcagctccatgcgaggataaaatcgaaccatgtgaaaacaaagaccgaacatagcaattgtatcagtcgactgctacgaatttgagaaaaaatccacctccaaagaggagtcgaaataaaccgattaatgccccgcccccatcgggatggctatatggctgtcgactgattttctatagctggatcattcgttttgttggccgtttgatttatttgagattcgtgcaagctggtagggcctttgctagttgggtctgtgggctttttattctgtgtgggcttttggttctgaatttgctttgggcttggacaattgcttcgggtgtatagcttggacttttggtctaccatgggacccacttgcactgttgacagagagagactgagtgactgtgtctgtgagagagagagagtgagagcatacagggcgagaaaatttcttgctctcatcgtcccacgcgatgcggcgattgtggaaggcgacacaacatcgattcgccggtgatctccttctcctcttctccagtgaatttagttcccgtttgtttactgctttgttcatcgacgcgtcgactatttgtattttgtagtggtgggtttttgacgctgatttgtgggagtcatcgacgattcgttggcaatatcgttcttcctttctccggtgagtctcatagtcgttgtgtagtgtgttttgtgtcctcgtcgtcctcgatccgagcttgtcgttgtttccttgtgtgctgcaaggttttagttgtttcgatttggatatgtgatgtgttcgattttcgaatgtaactcggtaaatccccttgtttcttattcaaatctgacatggtgatctccttgtgtgagtttttcccttttatttagggtattttagtttttttgtggggatttgtgctatgcaatgtttcaatttcgagttgtgtggtgtgagttgtcacggtgagccccttctgtgagtttttcccatttgtttagggtattttagttgtttcctgcggggatttgtgctatgcgatgttccgatttggatctgtgtggtacaagttcctcatgatacatagagtagaagatgaggagaagcctttgcgatgcattgttcagccttgctagcatgctattgaccttctctgaatcagaattaacacatgttattttgatgacagtgactgaatctcttgaagcatccatggccttcttatgctaaaagtctgcagatgctatatatgctatgtggaatctagtttggtatttttactcttcggtgaccaccttagactaattttattagatctgtaaagagcacaagttattgaaaattttgaaatgcatcaatgagtttccaacattttagtattatcatgcagattgtctgacattttcatgaccaagtctgctataaatatatagtgatgcacttttgctgcaacaataaattgtataaaaatgattagtccctcatgtcaaattagaagtagtagctaaacatgattttcttctagtttgatttatatgtaagaccaattagtgggatatgattatgtatggttctggacaagagcttctttgcttcctatgagcatttttttcttgagctgattgtccaggattgagaggaaaaggacacatggagaaatgggctagtctaaaaaaatagaaagcatacatatatgcacaactgattga

SEQ ID NO: 28833 - DNA, 7347 bp, Oryza sativa
agtgttgcatagatagaattgacaagaccacgatctataatggtttggagaggtttggaaagatatttcatcttggttgttgtttacacccaaatttggcacctagggtcgaaatagaaaaaattgcgaaagtttggggctctgccggtttcctccagaaagggccggtctgaccgccatatgtgggccggtcagaccgccgccggagagccggtcagaccggtggcatgtggccggtctgaccggtagagtctgagttagactccgttttcgtcaggtctcgggtggttggcgactccatatcaccgcaaggcgtttaggtgctgcgatcgtgcttgttgacttgtcacaaaaagttgctcttgcctttgataccagctcttgcccaaacaccatatatattgcataatcatcccaattccctccttccacaatatatacttcggacccagccaatagcaccatgtagaccgtgtgcctacaaagattcttaccaaaagaaacttaaaggccaaaatcccatgagtaccgcatatgaatatctccaacccagattgagcttcaagacagagcaaattttatcttgctttgggcaagacatcctcgaccttgtttggcaaaagtttaaagagagacaaatgaaaatatttcaagattatttctttcatctcttataaggcagagaaagaaacccagccatacaagtaatcatatacatgcttcctatcttaaggttagatgatcatcaggtaatctctgacccatcctatagattcatggttctcaaagccgaaataaatctccaaagattccgaaacttacccacatacaaccatgatgaaatatctctccaaaccattatagatcatggtcttgtcaattctatctatgcaacactagatcggattcttcaatttgatttaggaagcgctgtaaaagatgtctgtagaagacttagaaatggaagatacaggattatcttctcctccataccacctaaattcacaccacatgctcgtccagcaattcactatatatatatatatatatatatatatatatatatatatatatatatatatatatatatatatatatatatatatatatatatcatgaataaacaatttaattttcaagaaggcggtcctagcaaattatcagatgaacaagaagaaatgtatacaatgattgcaaatcatgagaattggagattattttctgaagctgcagaaattgaagaagctattaccatagattatgaatatcagttggttttccaaaacaagatcacaaggatttttattagcagatattataaccaaagttgtgaatatttcaagggagcaggacgtataattaaaccagattttactacagaagcctggctcagtggtatcagaaaacagagccatcaaaaattgacatgatgcaattggcacccatgatatacagtgaagataatgaatgaagatcttgtcatccccgacaaaaaacactattgaagataaggaatctacactattcaagataagatatgcctatagtcaaaaggcgatattatgatacttttattgaaggtcaaaagcgtcatcaccaaagattctctccgtgaagtctaaagggataatcataaaaccccttaaagtcaaatggagatatcataaagattcttcaccgagtcctatataaggggctcaggaacacaaccacaacacatctcactcaaccattcctcttcacctctccaccagccatcacacttcactccatctaagtgttagtagatagttatagttataacctaaataaaagacttatgaaattctaagtgtgagagtctatgtaagagtccttgtgagagtcatgtacctgtataattacgaacgtgttgtaccaagtccttggtgtaatcttcagaaggatctaccttcaacctatcaaggtatatgaatgaacacatggaccgttctatataaaactactatgttctaagtatctaatttacattatgtcttgtacataattggtatttaccgtttgtctttactttctatactgcatttatgtttgcatagaactttaaaaattcaacaaactggattaccatccattatgttctaagtatctaacattcttttctctaccccacacactattaaaacttgattaattcactccctttgacacttgtctccttgtagatgccatcatactctactccctccgtcccaaaatataagcatttttagctatgaatctggacaactgtgtgtccagattcatagccaaaagttatattttgggatggaggtagtatgttaatattattattggaactgttcatgaatgttactttatttttgaaattttccatgtctttgcatgcattatttcattttcatatctcgggggattaggcgctcccaacctagtgaagtacacattacaaattccaagaattatttgaaacaagttatgatgtaattattacccaaggtctcgtgcctagtataaaatagtttttctgatatacataactaataatcattctatccggtggtataagttagtaacatgaaagtgcatgggtatttaagaggcacaattagaggtgtaaggtccaagttcttgggtcctggacaaaatgattctttcgctataaactttctggacatattacattgatgtgcttctgattattttatgtgtataaagttttgctaaaggtactatttgcgagcatttcttagaacagtaagaaaagttttaatgagcacatgtgtctaaaattattaagaaagattgaacgctgatacccagtggcgaagccaggatctaagtatgagggggcccagctttataagtgattaagattataaaaaaaatagcgtagaaaagtttatgctaatctaaatgttccccataggtaatataccgtatcagtataaaaaaacacacgacaatttaaaacacaggcaggttaatttagccttatgagcagacagattataagcagtgattgtaccattcaagctaaaagtgtaggtaaacaggaaaaaaataaacaaaaaataagaactagattatggcaaaaagagcaacaaactatccatctgttacaagtattaactaatattttagaaatttaaaatttcaatgttagccacctagtgatgtaaataatacaaatgattagtacatattactcggtattctaaaaggaaaaggaaatagatggtgttgtgtgcctacaaggctagagtaaagaccttatcgctcttgctaaacatacatacgtgcaagcacagtgcctagctaatccatcagcagaatagaagggtggagggggtgggaagaggccaggcccctccgccccctggcgtcgctcttgctgatacttttcttgttctggtacatctgcacagataaattataatgccttttcatctcttctgtctgcttatggctttttaagataaaacagagcattgatcttgcatgctctacacttcgcgcactgtttgtttttgccaataagtttgcacacatgtagctgtcatttgggtaaacaaacttgcagatagtgccaaatagtcataagaaaataattttcatgggctcttcagataatacatttttattcgaatagattttacagtatcagatattaatcatccaagcatgcaaactgtgtcttgttatgtgttagcttctttatgaccaatacattttaagagctctgaactgtagcccttaagaatagtgaaaatataggcaacacttccacaccataaattgtcatggatgcaattggagcctgcaataatttcattaagttataattgatgtttcactaaagaactgagaatggatagatggatcatgtgcagaaaatctgagttaccctagtttaggaggtgtggtttgctcagcatcattttgttggcttgggggattgagttcaagacgagcaggagtgttggcttcctcgataaccgcaaagttgtatggagttgttgaatctcgattcgcttcattttctgcccctgtctcatagagctgaggagagagattagctgtcatcatataatgaagcgtatatcctgtgaaatcatctatctgcatttatcaagtaccttcttgtacagctcagcattttcttggcgaatcaggttgacctttctgtacagttccatgttttcttggtggatgagacttccctgcaaataagccagcaatagagttagcttactagctgattcaaagatttagcaattgtacatgatgttgtagaacctttcgattcagttcgtggatttcatcaatcatgagctggtcctgaaaacaacaatattgatcttaagttaatccattatataatcaatcaggtgcccaacaaaaaaatatggttagtaggttgaccttttttgtccggatgcagcgtatgctcatttctagctgattttctagagtttgcagttccttgacacccaatccagaaagatcttgccccatcaactgcctgccatcaaccaatggatgttatagtgttgttctgatgatatacagagtgaatattgacacttaattttagctgatcaacagacagctgttaattgataataaaaataatttgtacctttctagtttaggtattgtaaattaggcctgaaggacaaaatggagtgtttgaacaataatttaccaggcagaaagcacaggtgaagaaaatgtgatattcactctcctttgtaaatttggtctgtccgcctttgatgggtgctcagttctgtttttcttttagagataaccggaaatgcataaaaatcgaatggctgaaggtatatatttcttacttttaaatgatatagaaaattcacgtgccttcttcatttcttttgtttgtgaaggttaaacaatgcattatctataggaaatttggaatcagcatatatcactttcatactctgttttttcttcttttttctaagtatcatatacccaagcactaggtgcttgtttttatgatctggtactagtttatatttactatacaatcaggtgctggaagtattattgtcgctagcagttgctggattcatgagcaagtccccacaaaaaaaaaaagttcatcatcaagggttcatgatgcatgtatttcatagtagtagatatatgatggtttatgtttttctatcttgaggaattttctgatggaacattgaaaaacttgcagggttttatggccataccgatgattttcttgcaagctgtgcagttgttgtctcaagcttgctgcctccctttgccagaactattggatatgaaaacagagtcaagaaatgcagaatccaggtttgccaaaagcagcaatataaatatgttgtgtatacccatagaaacatgctgggttatcaactcactagtttttttttaaaaaaaaggaaactcaattacattagacaagaagactatttgaactgaggaagttattgtgtatggtaaaagaagtaacaagaggcaaacaaagaaatttgttgtaaacaaataagggaagtagtattatctttccagtttgaagacagtttttttttccagataagacgatgagctaccaactctattgaatttggtactccattatcagtcctcgttttgcggggtgttaccccctattgtaaaaagcttgtttgtctaagcaaaatgcttccaagtcccaccaaagctagattaactacaaagtatctgcagagtgcacaagtcaggtaaaaaacttgtttgtctaagcaaaatgcttccaagtcccaccaagctagattaactacaaagtatctgcagagtgcacaagtcagataaaaaacttgtttgtctaaacaaaatgctcccaagtcccaccaagctagattaactacaaagtatctgcagagtgcacaagtcaggtaagtgatgattatatcatcctggtacaagctttattgcggtgaaagataagcagttagtctgaaatctgtacagatctgtcagctgttaccgaagcaaaaggttcaatgtgaacttaaagatgcagtactgatccttttaagaggatttaacacagatttaacaggtacgtgccccttgtgattctttgttagttttcttgttataatgatgtttttatcctctgaattcaagcagggtgttctgtatgcgagctgtgatgggatggttctcttcagaagcattttattttaactaaattcagaagcatttcgatggcatgaggactgttcgattgacaatttgtatgtacatttccaccgtttacgcagcttaggaattggaccataattagttgtgtacctgcaagttttgtatacgaattatcctgaagggtgttcggtggattgaatattgcccttttggttgttttgcgcatcgtggatgcggctgctctacatttttcttataggaaatcagcttctgataaaagggattattatctgtgtgatctactgatcgatattttacccctctagctgagtttattaagccaattgattatcgagtgggatcctctcaacgacacatgagcatgagcatccggctgtttgttgattaaggccctcttttgtttatgtttaaacctaaataaatagatattttttcgtttgtattttttaaggtcataagtcactctatgttaagctaaaagctaggttacagtagcttttctggtctatgtgaagctaacagtctactacttaaggtttaaaaaacagcggcttaaacaataaaaatattcaaaagaaccaaagcgagagggcttaaatggttcagccgtactttaacggaaaattttttggaaagacaaaatggcaaagttgattgtcacccattattatccaatttcgacgtttggacaaatcctcaaattttaaatgataaaaagtactccctccgtattttaaacgacaccgttgacttttcgaccaatgtttgaccatttattttattcaaaacttttatgtaaatatgaaaatatttatgtcatgcttaaagaacatttgataacgaatcaggtcataataaaataaatgataattacataaattttttaaataagacgaatgattaaacgttgaacaaaacgtcaatggcgtcatacattaaaatatggaggtagtaatttagaaggtaagatattcctttacatgtgtggtcgagtctacggaatgaggattagcgacccacacctcgtgtggtagggagtatcagatcatctgcccaggagccatagctacgcatgctgatctatagtggttcacccataagttctttaatacataatcgagggctgcagga

SEQ ID NO: 28834 - DNA, 3674 bp, Oryza sativa
atagacattgatatgtgtaacactaagaaagcggaactcacatataagtgaccgtaatggtatagtgatattatggtagaggatcctcacccgatttgttgtcctctttatttccctttttttaagaaagatgacgtgtgtgacttgttagttgtaagatagattcacttgttttaggcgggattatttctcacactacagcaaaagagggggagcaaacacctgattttggtaaccttggtaaagactagaaatgtttctattttctctcaaaatgaaagatagcgaaagtggtgatttggcaaacccaattcaatggcacaagggctttcgccattgtgaaaaggtgagctctcagaagattttggggtgtaggtggatgcatataaatggatgaggttgtttattttgaagttattggctaccatctttgttgctgtagagactaggttttattctattgttaaaaaaaacttgattcaagtgtaatcaactaagagttgagaaggccaatacatatttattccttaccattgtcaatgtacatttactatgcaaaaaaccacatcactaacatttaaaacaagagaaattatatgtttcgttattgacaaactaccgattttaaaagttgccattagaaagctcgagctctagaaaaatatcatcgtacaagtgttttttttctcgttttgtcactgccattaggtttccatccataaacctccattaagtctttagaaaaccaatttgcccctagaatttgataaaaactgtatgaaaaaaatgtttgcacacttaatggagatctttttatgagcagaatggtccttttagaagaatgcaggtctatggatggaaacctagtggcgatgataaaaagggacagaaatgcttgtaccaaggtattttgtatttcgtagaactcacgttcgtcgatgccaatttataggacatgtcgcttgtcaatcgtaaaacgtagaatttctcttacaacaaacaatgcttacttttttcatcacaaatgtagttagtaataaaagttgtaagccttgttattccttgggtttatcccgagaaaactcacaaataaattactaagtctgagttgagctactagctatagtttttttttttggaaaaaaaaaagggttggcttactaactagtgtcaacatcattgagtcacggtgatgagaatgcaatatgttctgcaagctatgctaccttcatatagcatgcctctacccattacatgcctatgtcataattttgcacctatgaagggatgagctagatatacttaagttggcactacttcttaagataactccttatataccatccaaagctaccttatatcccaatagggcaaaaccaatggtagaatttgcttgcacggtaggcattgttaggtctatcaactaaggaaacatttcgcttattggaaggttggttgaagagtaaggacagaggagacaccactacaacataaaagctcatcgtggataggctatcaagaactatttgaaattcctcttatatgaatatagagatgcttggttaccatgtccatctacatttgttgataccaagctaaagattgtctttggtgagaatattcggtacttataaggttcatcatcactatatatagttaatgtaaatctcttcttctctcctgaagccacatcatcctagttatttgtagcctttggatcattcatctacgatgtaaattgtctatgttctctaggtatacacacatctaatttatttctagcatttttaatacaccatctcaattatttgtaccctttgatctcatatgaagatacattatcttaatatttttagcatgatatataatatataaatgatatttacttatatgatgtccaatcatttaaaataaagcaaatctaatttgcatctcatgtttacttatctcatacattttttccgcggcaacacgcatgggggttcccctctagtatacctaataaacacgaccattgtttttgtatatgcatacatgcatgcagatcacgcgaattataacgtagaggatgaagcaatgtgcttacatgcaataatggtgaaaaggtgtcactaatggaccaaaatgggaatgcatcctgctaagtgctagctaaataggcaatagctccgataacaaagttactgcaatgtacacatgcagtaggtagttttttttttcctggcctgtttaaattaaaagcctagctaattaaagccattttcctgtactttgtgccttagttttgctacgtataactacaaatataaacttgcctaactgatgcacagtaaaattagagaaccttgattgtgttttcttttaagataattgaagtgaacactcccgctctacgtataactacaaatataaacttgcctaattatctcttattacataattcactcaaaacaacggagattttaactgaaaaactctgatgtgtccttactcgaaaataatttcttggtaacagttgagatgatgtagacgaaggaaaataaaggatgttgtcaacacgatgaaaatattgaacatttataagtttgtgcatgtttgaaatatcaaacagtattagtgggaaaattaattatgcatatcatagacggtcagatatcgggaaactatccttcagacatactgtcgcagaaatttgtgaattctgaataaacagcactgacaaatttatctccaccggaaaccaaattaatcaggctttcatctgtgcgatgatcaaatttatcttgttcaattacgcttgaaaagagataaatagtattccggcagggggtgtagtgcatgtgcatatgtccaaccaaaacactggaactaacccaaatgaatagatgatgtcaaaggattatttcgatctctgttcttatttttagttaagtactgcattaattagaacaacttgctagctcctgcatgctttttttattaatctctgttgagttaatttctctcaggttagagtttagaaaggttagttctctgttatatatatgaagacgctacaaaactcctaaacaacacaaatgacagagatcggcagaagaagaaatatgtttagttgcagtcatcaaggcataccttcagctccgagttggggtttgcgacgtgctgctgctcctccttagctcgcccatatcgatcaatcactgacttcatgctgcacaaaacgaatggccggcacaactcttactaagattatttttgtaatctgaaagcacatgcatgcgtgtgctagcttttgagtgtaagagtacggcaaaaagggtaaattaacaattatatgaagtgagcagaaatcatacgtataagtgtacagttatcacacaattttattccaagagtgctagatcaattattgcttcactgcaaagcatagttgacatatttattccttcgaaaaatatgcatgacaaaatagtaaacacacaactgacatatggccatacatagggggaccctagctagaagaaggttaaaaacaaagatgaacaactagtagttaatctgagactaacaggaaattgaagaacctgacacatgcattagttcttaaacacttatggccgatgtatatgtatacatatgacagggaataataggtgcaaagatgcaaaaaaaaa

SEQ ID NO: 28835 - DNA, 740 bp, Oryza sativa
ctctactatggctggatgcatgctgtcatcatttttccatgggcaatttaaaacataaagcctactactctctctgtattttaatgtataacgccgttgactctttgatcaacgtttgaccattcgtcttatttaatttttttgtgcaaatataaaaatatttatgtcatgtttaaagaacatttgatgataaatcaagtcataataaaataaatgataattacattttttttaataagacgaaaggtcaaacatttattaaaaagtcaaaggcgtcatacattaaaatacggaagaagtacaatgtaaaattctttacatgtactccatccgtacttgtaaaggaagtcgttttggacagcgacacggtctccaaaacacaactttgacttcttgtttctataaaaatatttattgaaagtgatatatatgtatacttttatgaaattattttttaagacaaatctattcatataatttttatatttttaaactcaacaacttgagagttatttctgatttatatttccaagacttgacttaaacattatcataaacgactttctttatgagtagtgaaggaatacatgcatgttcatccatgcacttttgtacatctaaatgtagaacttcatctccttaattagctggtgaggtcaggcatctctatcatagctaatgaggtggtcacacaaacctcggcatctctccctaattaagctccgtttcgtcttaaacaa

SEQ ID NO: 28836 - DNA, 7985 bp, Oryza sativa
gggacatcatagaaccccttaaagtcaaatggatatatcataaagattcttcaccaagtcctatataaggggctcaggaacacaacacaaccaaaacacatctcactcaaccattcctctcacctctccaccagccatcacacttcactccactccatctaagtgttagtagtatagttataacctaaatagaagacttatgaaagtcaagtgtgagagtctatgtaagagtccttgtgagagtcctgtacatgtataattatgaacgtgttgtaccaagtccttggtgtaatcttcagaaggatctatcttcaacctatcaaggtatatgaatgaacacatggaccattctatataaaactaccatgttatggtatttacagtttgtctttactttatgtactgcatttatgtttgcataattattttttaagaaaatcaacaaactggattaccatccagttgccacataccaatctcacatccaacattgcatctagatgctgcattcctatcctcatatctggtgactagacccctagcactgcctgggcaagagctggtatcagagccaagtgctcgtaacctccccaagccatcttctccgaaagggggaggggggaggggggggagagaggggtcgggtagcaaatagtacttttagcaaaactttatacacacaaaataatcagaagcacatcaatgtaatatgtccagaaagtttatagcaaaagaataattttgtctaggacccaagaccttggaccttacacctctaattgtgcctcttaaatacccatgcactttcatgttactaacttgtaccaccggatagaatgattattagttatgtatatcagaaaaactattttatactaatcacgagaccttgggtgataattacatcataacttgtttcaaataattcttggaatatgtaatgtgtacttcactaggttgggagcgcctaatcccccgagatatgaaaatgaaataatgcatgcaaagacatggaaaatttcaaaaataaagtaaaattcatgaacagttccaataataatattaacatactacctctgtcccaaaatataacttttggctatgaatctggacacacggttgtccaaattcatagctaaaaatgcttatattttgggacggagtgagtagagtatgatggcatctacaaggagacaagtgtcaaagggagtgaattaatcatgttttaatagtgtgtggggtagagaagataatgttttggtgattaactacactagcaaaataatttagcgatagtaataataagacttacgattttcttgcaagatatgcagttgctgtctctagcttgccgcctccacttgcagcaactagcagagaaggcaaaggaagaattagtcagctggatcaaaagggtcatatttgaaattagttgctagtgctattggcagttaaaaaaattgcaaacatacaacaaaaagttcattggcatactacacaaatatttgcttaacaaatttaaatgttgcagtaatgcagccttcccctttcccttactatgaaccgcgagagttcgtgttaaaaacaagtttatgtttcagtaaaaaacaagttgatgtttgctcaaaatgcagaactagaaaccttcagttgtagctcaaatggcatggaaaactatttccatacaaattgttctacaaactagcttttgcattgcatgtgtttctagtagcggtgcagtgctactacaaagtacaaactgtcctgaataataataatcatcaggaaaatagcatggaactagcaaaggttttgtatgggaaacttggttaatacaattgtatattcagtatttcttcactgaattagaaactttagtaaagtggtaaatgctcaaaagcagagggcatacaatgtgttcatcaaagcatacaaaagctcatatcagcgaagaaagaaaaactaaaaatcagagatatgaagaatcaactgctgttctcagctaaattcaccccatagtaccagtaggtcaacccacccccccccccaaaaaaaaaaaaaaactaatctatttggcactggtaggacatgctcaaaacaactatattcataatttagtgactaatttgactggcccatcaaacattaaaagacaatcatgatacagggctgtaaaaatagaaggcctgatcatgttgcaagacatgagttcacaaccaaacagacactacaaaaactagtcaactcaaatgctctgtttcaagaactgcataatgcaagtgctggtccaaactccaaaactgtgaagataactttgacatcagataaacaacacattgggtatgcaacttagtatctcttttgttttattatcctgccaatagcaaggatgatatttatatgatgagacatgtattaacactaaccagactccatcacactagtgtcatgctcatgtcaaaaaagaatccaataatagtatagcgctaatggcagaacaatctgccatgaaattttcattaagctcaatttgtgcaaggagaaaaggttgatatataacacagtcacaaaaatacaaccttgagcacaaaatatttttcaacgtgtctgtaaaaactaaatgtttccttgtgctgacagcagtggggataggaacatgaaagtcttttggcaatgggctattgagaatggagtatgtttgggccaaggcccatttagtggttgttataatctgaggtgttaagatgaggaccatacaaaaactgagcactgctttgtccaaaagagtagatgaaataaaatagagttatttctgtatactttgcttctcttctatcttctcaactccattctgtattcacattggtattgttgcattgcgattgggctcatcagtcatcacctcttgggacgtgacacaaaaatgcggcaaagagatcttttagacaatctactactagtatccccacatcacactcatacatccaacctaaaattcacaaagttgttggttatgtttcaaattgttcaccataattaccatccatcacattcttttattactggaaaggtattagtgttacggaatcctttccaagttccaacagtgaaaacattttggaaataataatgaagcaacaagtctaagcatgaaaaccatatgctttatatttttactgaattaattcatcaattctcaaatggtcagcccacatgccaatttgacctccagcattggcagaatattttgcatttttaactatttattcatgcacctctatgaaactattgcatgcctatcaacaaaagtaaactaccataagatatactgcataaactcttgagttctacaaaaccaccaaatagacattctaacatgcagactgaaactcagtaaatgcatctgaagaaatgtaactacagccaggaagtttcagaataaaacattctcttgaatgaattgtactatattatgtcatatagaagggagtgttaaactttagcagcatgcaagagtataactttagcatactcatatgtccgttacgcataatgaacacatacatccgacatatacacagatcagataaactgtgtatacatcctcagttagaaaacatatgttaccacacttcacaagccaaaacaattataaattagttcaaacttaagctttcattatatcagagtggatgtgcagtacatgactacatgtagggcgctgacactaaagtctagaaagaagtactagaggcaatctcgttagagaccaatacaagagttatccacttatcctaaccacggttaaaagcagcaaaatcctcccaaaacaaaactaagtaatggcaattctagtatcagtgcaactctaaaaaaacaattaataatgcactccctgatcaagaaagaaaagaactaagctaacattaacactggcattgacaaccgtacatgaaacaaaacgcataagctgcttgtaatttcatgctacaacgaaactaatcaaacttttcacacaaatcacaccaaaacgaccgcacagctcggggcattcagttaactcagtatcagcaattaacaacttaactatgcaaaaaaaaatacatatatatgagagcctgaggagaagctgtaaaatcggtggaacgtctcacctgagaagccggctcgaaggttgaaccctagatgaagagaggcgggtcgctaggcggcacagaatcaaaatcaacgcaagcatatcggctggggctacagcctacaggagcggcaatgggagaagctaatcggggagccaacggccaccacgatccgagggtcgtggtcatgcgacgggcggcagcaagctagatagctacctcctacggaaatctagggggggggggggcagatgccatggaggacgagaccgcgattggcgcgatcctatccaatctaagcgagggggggctccgagagaacgacgcgaagacgacgaccgccgcgaggggggggaggcgatgatggattttgcgctggatttggtcggatgcgacggagcgtgtggtggtggtggtgctctttgtagatgaagagagagagagataacccccaaagcaaagcaggcgcccccacgccaagtggggtggggtttccgggggagtaataaaaaatgcggcggacgagcggcgctccggcggccacgtcgcccccggcgccattttcagagggggggcgctgctgcggggcaccccgacaggtgtaccgtccgcccacccgccaccgccgatcgccggcaagtgggcgcgtgggttgggcctgcgcctcctgcatgctctgcctgtcgagaaggctcgcgaagacgcgaagggggcgcgtgcgggaaatcgggagccgtcggatggggaggtggatgggcgagatcttcactggcggcgacacctgtccaggagagagagagagaggggttagatggtcgaggaacgggaactaccaacgcgcacggtgatgtttttggatgacattttaaacatttcgccgtacgtatattattttgtttgcaaaatgcaacttgccaatttttgattatgcattttaagcctgtttcgagcgtacacacaggaaactattgaaaatatgatgaataggcactattcatgtcgaagaaaaaaaacatagggctgctatgcgaaataattctatgtgagccaattatttattttgtatacatttctactctattcctacttttttttctatttcctgtgatttaaaaatcatcttaatcgaagaggcaatgctcaccatatcaacaaatttcaagtactcaaaatgtaccacctgcagctaggaatttgtggtagataattaattcaggggcccaagtatatattgtcgttgaattttttttcatagtaagaggaaatataactccccagctctgcaccaactgcacacaactaaatttagatatcaaaatttaaatcccaataaatgaagtcatgcaggtaccacaactataacaccaatagtgataatttccttgttttgcctttcataatttatcagagtatttgattgggcttggatggtacaagtagctagattgttgatggcttcatgtagacatgttcacccatagaaattacgaactcatcgtataatttacttcctctatcccaaaacatacaacaaaactagtaaaagatgtcaagggcttttttttcatagttcttcaaagggggatctcaattctggaaaagactgcatgagtgtagagtggtgttggagagattagtaatgaaagaagttcataaagggatggtgtatatttttggacagatgtttggtgtggtcagtcttctctaaaggtgttgtttccaaagctttttgaaatcggctgtcatcaaaatactactgtgaaggatttgtatgatgaggggatatggagtttggagtttagaagaaatctggacagtgttggggaggctgagctggaagtgttaagaaatatgatacaagattatgtcctagagggggacagagatatgttgatctggcctcataacagcaaaaagaccctcacaactagattaatatatagagagattacttttgggggtgtaagggatattgagacggtgaatatttggaagagtgaaatccctttaaaatttaaatgctttctatatatggcagacatagaaaaacttccttgtacagtccaattgattgaataaaagaaaatggcaaggaggggatgagttcttcaagctctgtggcaagattgaaactactaatcacattttgtttaaatgccctttagcaatgtttacttggtgtgtggtgagagatgctttggggttaacaagtaatccggtaaacattagagattgtctgggcttggtgaatgtgtgttggatgctctggttaactaggaatgaccggtttttttcagatattttggtcaagtcccctttacagatcactttataaatctctgtcttttattcagtggtggtgcattctgctaagggaaaaagatcaagcaatcatgaaaagggcggtgtgagctgttgatgggcaaactgaactggaaactgttttaaacactcgggtgaacgttcacccgtttcttacatgtcatctaaatggttatgcaaaattttcaaaaaaattgacatgataggttaatatgtaatatatcatatcacaaacatataagttcaaattcgacttctacaagttgtaataaaaataacaaatttgactgtgaatatacgtatactagttagagtttaatttgttatttttggtacaacttgtagaagtcgaaattaaacttgcaagtttgtgagatgatatattacatattaacctatcttataattttttttggaattttttcataattatttagatggcatgcaagaaacgggtgaacgtctccccgagagattagaatccatctcccaaactgaaccaattgaagccgtgctgccttcctgcagtagtttagctgtgaaatttgcacttggcttctttgttatgtgtttcgagctctatctagggtgtgatatcttcgctaggatggatggtgcttgcttttgatgagttccagcgctgtttgttggcgttatgtttctgttttattttgttgcttcttttttttgtgaggtattttgttgcttctatatctatataagactctggttgtttattgggctttctaccaaagccgggtcaatgaaattttgatatgttttaaaaaaactagtacaagatatgatatctgtgtagatttatagtatgatgtgtgtattaatttcatctattttagaacagagagagtacacacgcgagagtaagcctcacgctaaaagcctccagcatcttattaactgaaatcataaaacatactacatattgatccagtagtcttaatacattgcctgcatcatactactgctactactcatcagatgaaagacataacctctttgcaatttttacacccacgcaaatctggctgacactgttgcaaaggcacatatatatagacaacacatggtgggtgcccggccgagggcgatgacgacacaatattgccaatggaaacgcacacatcagagctcatggctctcgcgacaagatgaaatatagcagaagctaaaaacaagtttgacgtcgaccttgcacgtaggcatgccctgcctactgcttgctacgcttcctacgcacgcgctagcttgatcggcgcaacgcaagcccacatgcccgcggacgcagacgcgcactagcgagtcatccccgggtgcatctgcggcggggcagtcgcgacgcccttccccatcctctccatgttcccctgccatcctgaaaaattcacgaaccgacgaacgaatcaatctcatctgcagatcaaagacgacgaaccatggcatcgccgtggacccgtagtgtggctcgatcgctacaaatcgacgcgattccccctcttctctaacata

SEQ ID NO: 28837 - DNA, 685 bp, Oryza sativa
gttaccagtaagaaaaaaaatgctcaatcccacaagatgactatcaatggttgggttttaatcagggattgataccacaagaagaaccatgctgcagtagcatagctaaaccacaacagaaaccagggagtaaaaagcagacgagtaataagggttttgcaaaacgcaaatggcaacagcatagattatgtatggataacgctttcactcatgataccaatcagagaaaaacacccagaattcatgtttcatttttacccaatatttgcaatacagaatccctaaactcaaggatctgtagcttcctcacctagcctggtgcgatgccattagaattgtagaaatatgtcttaggtctcatcaaaattccaggttattaaatcatcacagcaaagcaaaatcgtatatcagttctttcctcatcacaaatcttccagggctactgagcaacttttgtgttgcccctttgcctcgccaggcgaacacatgcttcaaatctcttgactgcctcagcacacttgagtgggtcctgtgcattgctcacgtaacactggcggcagtttgacctctcctcagtgcatggcgtggggttttggtacggcagcttgaactccttgtcacgcaggtcttttgatttcttgatgagttcatcacgcatcccagcatgctgcttatccagcttctc

SEQ ID NO: 28838 - DNA, 1487 bp, Oryza sativa
atgagcacagaactagaagcaatcatttgttaatcgctcgggattatactaattgaagcacagtaggatccaagccagcctcctaaaaacatgtggccagggatttttgggcagcaaaacccaattttttttttgtaaggaagatgagaaaaggccaaggtaaggtgagggtgggcccgtgatagcatgcagcagatctttctcttatttttattgtctggaaccctctggagccaagagggcaagaggaggaggagaagggacacgtgtcgtgaggaggagtgacgtgtccgccaaaaagcgtagagtagcaaaagaaagaaatcttgtggctgcgctttgctctcctctctccgatatttcccaagctggaccaacaacgcccacccgtttttgcctgcagctagactatgacaaaagtttatacaagtggataattattactagtactatatctcattttgtgtgcttaatcacgcaattttccctttgtggttttttcatcaaaaagaaaagaaaaatccagtcggttgtttctggtcacaaatatctctctatcgattcactcctggcctctcctgtttgaacggttgtggatattttcagcttattatctgtctgtcttctttttccccaaccccaaatagtaacagttttccgcatgtgcaaaacgccaaagcatatacatacatatatatatatatatatatgtatatgtatatatatatatatatatatatatgtatatatatatatatatatatatatatatatatatatatatatatagactgagaccttttcttttcttcctcccaacatttttttttcttccttccaacatctttgttatgaagtttttttttctctaaaaacatttccccccccccaaccttatcgtggtcatagtactgtgtattcactcatgatattttctttgattaatgccatgcgtgatgccatcaattccattgtctcttgacatgccaagagttcagagggacgcgggagctccttaggtaatcaatcatcctatgatgaggaagatatgaatttctcaataccgtagattaaagaaatgctgaagaacatgggtacagtttagccactcgaatctagaaccagccacgacacaaacagaattcaatctgatagtaattgatactaatataataaatttgtagcaacatcaaaagaggtgttcagatttcagctgctccgtttcttggccaagccaaactaatactaatctagtggtacagattcagtgattcctccttgtataggtctaagccattccaaaaacacatcacgttgatgcatctgccttttgcttcttgtccgtcccatggaatttcctcccggcttcaaccgcctccctgtcaatcagtttaagtaatcaacttcacttgtcgcatggaataacaaacacatacacacatgagttccaaaccaatcataacgacaccctatatatgtctatgtta

SEQ ID NO: 28839 - DNA, 1733 bp, Oryza sativa
  unsure (1)..(1733): unsure at all n locations
cagcaatatgtaatggggttgctccaccagctctgatattcggatgtgcacctgcctgtgtagcagattatatgatcggttttttatacgaatcatagatgtaaggggtgtagaagcaacagagcatcaaacaaaaccaagaacagaaacagcatatgacaaaagtaagaacagacactttgatcctcttatcaaaatcttttgatataggtagcacacatataagaacgtgacatactatgatttgccatgcagcaatctaatcaataacacgaaaaatgagcttgtctgaacccccattgcacaagccagattactaaacaaggaaatatagcatacagaaaccatatgaccaatgaatggcatcgaagtggataatatcctaaagtaaaagcaacagattttggtattttactcttgaaattagatttgtgtacctgaattagaatatccaagcatgggagggaacccgctgcaacagcagacaacaaaggcgtaataccatcatcgttttcagtatttggctgccaagcaataactagcttcagtaaaaaagttaaggaaaggccacatgaacggctgattgaaaggtggttgagtgctaaacaaagagaagcctgtccaattcaaagaaacataatagatacagatgctattagaaccaaaagatagcatcttcttaacaatagcaagcttgagaacccttggtggttactgttaaagtgtcagttgctactagtatttgacaatattaaaaggcgacatattaaaatttcagcataatgaagatttctgaacagaatgactagaagctcaggttcgttaaatcagtgagatatgaagtgagataggagatagtggatttattgaggagcaaccttagcatcgtgttgaagcaaaagtttgactgcctcttgctgtccatgaccagcagcccatatgaggggtgtgccggcatcgctttctgattcaacatcaacccccttggagagaaatagtttcataaggtccaggttccctgcagatgcaaacaaaaaaaaaaggagagtggtgttggacgcatttatagaggcgttggcacaatcaaaatgggagaaaaaagaaaagagtatagaccatcaatccatggaaagaatgaagtgaaatggcaaatagatgatgaattttacctatgccggcagcatggtgcaatggcgtggctccgagggaagaagcaacggaaggatctgctccatggtgaagcagataggttacagtttgnagatgggcttggcgcgtagcatggatgagtggagtttcacctggtggagtggatgtaaactgatggatgagagattgtgaagaaatcagatgagagtaagagatagtgatagttagtagtaccatcgtcgtccttggggtcgacggggagggcgaggtcggagatgaggaagtgacagacgtgggtgcggccctcgcgggcggcgaagtgcagggcggtgcgcttgttggcgtccttgacggcagcagcgacggcggcgacgcccttgccctcctcgtcgagcgccgcagcgagctctgcaatggcgcatgaggagaggagatgagaagaaacgcaaggaaagcaaaggagagagagaggaaggcatgggggcacctactcttgagggagtcgagatcaccggcacgagccgcttcgaggaaagcttgcaccttgctccgagctgcagccaatgaattcgaagcgacctcag

SEQ ID NO: 28840 - DNA, 362 bp, Oryza sativa
ccatgcttcttctatgctttatttaacaaaaccagttgcacctcaactataagcatattcttttcctatatgcttattctgaagagatgtttttattttcaggtcccagcagcatccgttcctccagctattggatcttcagagcgagttgttaggagggtaaaggcttgcacttttcccagctttgtcatggtcggaacatgccccagtttgttgacttgggttcatgtgtttctggttgcaggtttcttcgttgcctcaatctactgctcttccagctctgccgacaaccgcacctgcagctgaaccatcacctagggcaaaggtgccacaggtgtggtttcagtttgatgttgcacttt

SEQ ID NO: 28841 - DNA, 290 bp, Oryza sativa
ctcggtacccggatgttgtttcgttttagtggagtatttctttcgttggttggttggtttggttgggtcaaacaaactcaaacagacatgccgctagttgcagtataaattgactacgagtagggaggaagagtagatttcaaatttgcttgattattagtcccaacgcccaacggtagcaagcaacaatgcggcggatgatgatgctgctgcttccgacggcggctgtgtccggcggtgagctccctccgtcgaacaaggtggtgggggatcctctagagtcgacctgc

SEQ ID NO: 28842 - DNA, 2631 bp, Oryza sativa
actcttaccttgtttttcaatagatacaattatattttgtataaaactgtgtcaattaatctacatcaacacaatataattgttaatgtggtagtttgtaaacctcaagagttatctcgtactataatagggagatactaataacatatagtcagcagaggcagtttaattaattgctgcaagtgcaaccaaaaccattgggagtgcagggcagcatcagtacagtagcagcagggtcccaaggaggaagaattttggtggcattttgcgtggcacaatggtaatggaaagcatgaagtagttgccccatcgccattcacagcgactgccctggacctggacctggaactggatggatgtcaaattaagttgagctacaaaacaaaagctacacattatgtgcacaagacaaccgactgaccatccatatatccatcctattctattcctgcaaccaagcttcaggatatatcacacatctatagagtgtagtatttcacaatctatattgaacaaatctccaagaattttatccgtgtggtgtggtgtggtgtggcgttgctagctccacccggaactgaattaaatttggtatctgcctagcataataatgattaaataaccagaaaggtactggcagcataacgtagcatctgaacaaactgaactcagctgctcggtccatcttaatcagagtttcagctgaagaaagttaatcgatttgttaatcatgttgttagattctaaccaaaaactaaatgctcaagcctgctactgccagccgctttgcttgacctctgcagtatgcttacgcggattacagttaagagggaaaacaacaggttggagaaacgtaagtgaattaggcaggcgatcgatccagacgaaaggtggcctgagattagcacactgacacgacatctcggctgattgcatgcgtcactgagctgcacattttccatcctgatatcgataatgaatgtactactgttgtctctactcatctcacaaatgcagttggattatatcatctcttaaattaatggttagttggagaggctgatggagatatatatcttcttgtgcaagcagcctaggcaccaaaaaaagattccttgctttactctcatcaattcatctatctgatgatttggtttaagaactggcttaataattttcatcttaatttccagagcaaaggttaagtagttatgatttcattcagatgaagcaacacagacccgtcgatcaccacgaatgcgtcataaaagggggggattaatgaaatggaacacaccatatatatatatatatatatatatatatatatatatatatatatatatatatatataaaggacaaaaatatatggatgatgaatactatgttttgcactggtatgaaaatgtccatgcattattgattgaggtactgcttttgaatggcagcagcatatccaggtcactccatcgattgtatttggtcatcttctcctcctggaccagctacaacttaacttgatagctcaatccatatgttccacacatacttggggcttttggtttcgtatccgaccttgatcggcttctttttctttttcaacgcacaaaagtaaagaaaagaaaaaaaaatttgtttgatctgtatatcctgttgcgctgcaattttggtccggccatagaaagaaaaggctgaaagcgagacatgaaacacaagcacttactagagccacaagcttgagattggttgtaatagttccctctatctaatccgtccaagcatcaaaaagggaggagctcctgctgctgcagctagctagatagcaccatcgaacagtctgtgctcctctctattactagcaactaattagcacacgcaattactacgcaattagcagtagtgctctcttcaaatgcgtttgagcttgttcagaaaggaaaagaagatcgagtgtcattaggtgagcactagctgagtcaggctcaggcatgcaagaagcatttaattttttactagtttagtttgctagttgagctcagcatgaaattatatatattcattcattgtgtgtccgttatcaataaatgtaaaaataaataaataaagacgagcgatggtactgctgcctattgtgacaggagtatatatgctatatagacaggagtccgtccttaattccgggtaatcagcaaaatgatgactttgacgaccaaagtaatcgctgcaagtgcaggatgaaatcaatcaacgagatatataagcagataatacatacacatatagtaataatactatagattaatagatgggatgtgaatagagaagtagtatagtaagtaacagcagtagatggttgctgcgagtattatgtggagaaagaggaaacggtagcaatgagtcgcaagcagcatgtgcaacagaaagcgaagccgcaccaaccgcatacaaccggtacagaaagaaatatggaatggcaatgaaagcatgatcaacaagtgcagttgcagttgcagtgtagagcaggcaccggtcgaattcgagcctaataacctgcgcttctcttctcttctctgctgtgctttccatccatccactcccacgaaccgcacctcaccttctttctctttcat

SEQ ID NO: 28843 - DNA, 737 bp, Oryza sativa
ttgccaatactagtacagtgagtgagtcatttgcatctgcataccctaccttacctgctcctactactgctcgcctcgcttacttactaccctcctgctcctaacaacaacaacaacaacaacaacaacaacaaggaagctctatcgggaaagaaataggaggaagaaggattaaggaaggaaagcaaagcaagcattaattaaaggaaattaggaaggatgtcagactgggggccggtggtgatcgcggtggtgctgttcgtgctgctctcgccggggctgctcatccagctccccgggaggcaccacttcgtcgagttcggcaacctgcacaccagcgccatgtccatcgtcgtccactccatcatctacttcgccctcatcaccctctttgtcatcgtcatcggagtacacatcaccaccgattaatttttacttcttctttagtttcttcatttctgcagttcgtctgccctgccctctgtaatctctatcttcttctttcttgctcatcctgtcttctcccctcctccatatatatcctacctcatattaattctactatctacatggtgcttccttgatgttcagcacatcaaaccatgcataaaccaagactgttttaaattattactgttttctactagtattatatatgcatgggcagttggcactgctatcaaattcagatctcatagctagcttaattgagcagtttggcacatatattctcccaa

SEQ ID NO: 28844 - DNA, 1669 bp, Oryza sativa
  unsure (1)..(1669): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattgcgctgttgctggatttgcgtccgatccagaattcgcacactttcgagggtacggatgaagtggttttctctttggcctaggtggagggatctcaatcgcattattggaaccgggctcacgcaccacctgctaaataaagcccccgcattagaaacgtttgagcatgccatttcaagtttactgttaccaattctgctttacaagcacatgtaatatatatatagagaaaaatatagcatcggcagtgtagtaataaatcaatcagattgatcaattggtacatgaaggattattatatcacctttgagaaaaacttctgggcatggctccgaatttggacagcagtctttgtgccaatgtgctctagagaacagcttggacaaatcagacatactactcactgaacttgtttaaagcctaatgtaaggcaaaaatatgaagagagagagagagaggccaaaacgcaccttgtatctgacgccaagagcgaccatacagcttcaatgcctcaaggaacttgtcgtgctcttcttccgtccacttctcccgctgcttggtgatcgtgtaaggcttccgaacctgcttcaaacattgggttggagattgttaggtacagtgacaacgctgtaagctagaagtacaattttttctgttcctctctgccagtaagacatgctagtgaagaaggatcggcttgcatagatgtcaaaagtaccttgacagggaactcctccatcccctcgttgggctgcattgcagttacagttgcagatgcatcattcatcatcaagggagatttgacaagatccagcgacgggcctttgttgattgccaaatcggatgaatccttttcctagatggccaggagaggaacacaaagttcagtgctttagcaaaagcatacacaagtactcgtataatttgcaattgccgcagacagtttacaacaacaactccgtagttactagtaccacttaccgctgcaaagggagggataattactagtaaaaagtagtagtagaaacagaattgctacctagtgtagtgtagtactccagtaagcagaggcagaaggatttgttaattgaggattcgtgccgttattggagagagagagtataggaggagtattggccatcccatgtcgttctggaagcctctaaagatagataattatgacgtgtatccgccccagaaccaggagagaagcatctagaacactcccattttttaactaaaaaattgcaatacatttggttttttaggcaataataatggatcggtccaagaaaaatatatttttgcaaataaaat

SEQ ID NO: 28845 - DNA, 13765 bp, Oryza sativa
  unsure (1)..(13765): unsure at all n locations
nnnnnnnnnnnnnnnnnnnnnnnnnnnnnnnnnnnnnnnnnnnnnnnnnnnnnnnnnnnnnntgtcccttctcctcctcctcttgccctcttggctccagagggttccagacaataaaaataagagaaagatctgctgcatgctatcacgggcccaccctcaccttaccttggccttttctcatcttccttacaaaaaaaaaattgggttttgctgcccaaaaatccctggccacatgtttttaggaggctggcttggatcctactgtgcttcaattagtataatcccgagcgattaacaaatgattgcttctagttctgtgctcatctaatctgcctgtaatttttaaagatctataagctgcgtatcactatagcttttaccgcccaaaacttgcttatgccctagttcaccaattactagctccaagcaactccaaaattgctctaaacatgttctataaagctaaatatcgacaactaagtaaagtaccacgtctctaccaggtttccaaacagttggattgcctgcggtactggtgctctagcaaacacttccgcgtggccttagacccatatgttagtcatcgttattgtatcagtagtgttacagaggatatatgtctgtttttttaacacaattacgctattgtaagtaagaactagttggaagaggacctacctgccgatgttgtgccatatttcaaagtttttagaggaggggagattttttaacttttttttaaggatagccctgacctaaacttttgagagtcaaatgttatgtcaccactagttgagtttggagaggaaggcataaccaccaaggtcaactttttaattttaagaaaaataaaaattttactaagcatatgaatcaacactggagtattttcttagcaaatgaagctactggtaacaaaggtgactataatgggcaggagagttgagtgcacgtcagacatattaattccatggggcaatgcaaaaaaaaatcaacatatacatgtgtggcctacattatattgcgttgctttcagtattccttcttagtagtagtattaaacagggaaataacgacggcccggatggctttccttgaaagaaattagtggacaggagcatgaccaagttgctgactgtattgcacacaaaagctactacactagttgtattagggagctggctgagatttacgatatgcttgtcggaattgaacaaggtgctcatgacagggatgggtttgatgctaatcaacaataatatccaaccccctcaaacaaggtttccttctactatatctttttttttgggaaactaattgagccaagctcttttaaccactatgagtaagtaaagggatgaagtaggctaaatcatactcacagtgcactccagggagctaaatcaactgctaaactacagcacaaaaagcaataatactgtcaacgatctctcttttattttatcagtattggaagaaaaatactatcagtatgaagaaaggttgcagagtgtttgtatggtagcggaaatatctagcggctgatattgatcgagttaggcaagaaagagcgtgacgcggctgctacggataaacaaatgcaatgggccacccacaacacaagcaaaccacgcgtcccctctagaaaccaccctaaagattttcctccccgataatccaatccaatatgcgccagctgcaagctctcacgccagccactcgctcattttcttcccttcctgcatgccatgtcctcttctcttctcttccctctatgcttgatattattagtacagctcaccagcaacaggttcacttgaaaagaaactccactctactggattttcctaaggccccttctattcaaagaaaattcatagaaattttaaaggattttatttctatagaaatttttcctatatagccatttgaatcaaaggaatgaatcctatgtaatcgcatgaaattcctatggaatgcctcttcccatgtaagttttggaggaaatttagaatgaggttctacctcatgttaaaaatcctttgagtctttatctctcctcaaattcctgtgtttttcctacgactcaatcaaacggtcattcctatatttttcctgtgttttacaatcctctgttttatacttgtattcttgttagaattctatgtttttcctattcctcggtttttttattcctgtgattcaaagaggccctaagactatacttctactagcactcagttttcctttttgaaagcaaggcttaattggttaatcattattagtactcctgcctccaaagttatctgaataattaagctatttctaaactcatatatggatcccacttgacagtcgcgagccacatgaatgatggtgttggcccgttttctcaatggcggcagtaccagcaaggccgtgtttagtttcccacttatttctaattttctatcatatcatatcacatcaaaaacttttctacacatataaactttcaactttttttttaaactcttaactttcttcaaactttcaactttttttaagaactaaacacagaccacataatgggacgagatccgctaatttactacagaacgaacacagaggagaatgagagccacaaagtgcatcgtatcgtgctagcctctttctttttctgctcccacagtccacaccttgatttgttcttttactattttgatctctttttttctaattatagtttgtgtctactatgatctaatgtttcttccattttgcgtaggtgtgaacatcaggcgttttggataatgggttacaataaatagaaggtcaggaaaaagatggatggttcagattaaaactttttttaatggtaaaacccatgcattaaccaagcatgccctgtccttccaccagtggaacgtgaatttctgtaatgtgcttacactaacatttatgcttctccattttttttagcaaataagtcaccaccacttagctccaaacatgcatgtattgagcagtaagagcagtcaaaacaggcggtttagtaaccataccgtcatcagcgtagggctgtagcaatttagcggtgttagttggagttgtgggttcggtggttggtgcacttcatcaaagcagaaaaagaacatgtatgctatgcatacttggtcagcaatcgccgcgtacattaccacccactcaagcaaacagctttcccatttgtctgtatcacctgaaaacttagtatgtgcatttcctttttcttcttttcttggaggggagacacatgcatctgcctgccaatgatccatgctcacaagtcacaagccgttgcccaggagcatactccactttatagcttaatagtagctttgctctctttcttttttccctggaacacatgagcatcgtgcacaccacaagaacatcaaaaactgctctgatgccttaagagatgcaagagcaggatctttaaaacatgatttgctcccacaaacattcaatcaactctgttcaccagatatattactactaacccagaagacatctctaaattagatgctccgatttgctaatgagcgatagagatttacataatggagaggtgcgaatgttgtgaatctgcagatacactgaaacatgctgatacgctagcttagcgtacgcctcccccggtctctgaatctggtgacaatcagagcacacgcaaaactgggggcggatactcctactaggataatgcatactactacaacaattggtttggggggagccctcgccgctcagtctactccttgttccgggttgatcggtctttcttgtgcccgccaaggatacgggagatctgcagacctctgctgaaggcctggttgaagagcatcctggtctggaactcggacacgaaaggaaaccaagcaaggaacgctatgggtgtgaataacaggagtcccattaggatctcatagccccgggcaagagccttgattgatccccaaagcccaatagcctggacagcaggtttgatggcttgcgcaatctgatagtgtgttttatcaagtcagacattagaatttctttccaaaccaaaaaaaattgtaataataggaatgataggagacaggtttagttgctaaccagaagcaagccccatccagttggcatgaaagcaaggatgcaaacgaagatatcaagaactgtcatgtgagggatggcaattaatatcacaacaatggcgacaaatgttatgaatataaggcccttgatcaaccggaagacaagctggaactccgcactgaacctcctcctaccgactgaaacagtctggaaagaaaatcataactcagttttccagacaagaaaggtatcaagcactgatcagttaaacttcaaccgtaaaattctaatataagatacataaggagggcaaagtccatatggattcaccaagagctaaggaacaggttgttaccttcatgacaagtaaaattacgaaaatcacaacccatgaaaagcaataaacctgcaaattgcattaattagaagaactgagtatgaataaaacggatgtgaccaccaggattaaaaagaaaacaagggacaacttaccagtacactgcgagtatgcttggttatattcaaatgatacacaagcccatattggtagacaaagaagcgcaacgcgagcagaatttcaagaatagtaccacgctttccagagtatcgaagaggctcctgctctttttcccaccatgattcccaactttttgttggtgctactccaatacctccacggttgctgatccacttattccaatcagtccagtcatccacaatcttctgccactcaaatccagaaggattgaataggaatggtgcaaagagccaggtgcccaccataaaccacatggaaacagtgatgaaaatgtatgtgatagcccctctgtatgattgcccaaagatttcatacacaaccagcaaaatcatcagctcaatacccttgacaaaatggctgcgagaataaagtcggtagttgtcagcaaacttggcatgaaacaccacaaatccacgcccagtggctctatattcagctcctccgtggagtaatgtccttccgtaataatgagttttggtcccaagtgaaaatgtaaagaaaacagatgccaactgaagttgcataagtacaaagtcgcttagtgctgttctgaatcccctctccagaccaatttccatcatcatgggcaacgccatcaaaaatccaagttgaacaaaagactctgatgcaagagcaacttggaggggtgcattatgcacaaacttctttccagtggctagtgcttggtccagtccactgaggacaagatataagcgcccatagaggaaaacatatacagtccatactgtaatctataacaccaaacagagaaacctgggttaagatttgaccaacatatcaaacagagagaagtagagtttatatgccataccattgtactaaagtagaagccaattgttgtgtaatagcatgacagcattctgaagaaatcaaaccggtgccctagtcgataaatgtcacggctcagtgtttgttcaccattaccatttgctatctttgcctcaaacagagcaatttggttgagacccacatctcttcccttgccaacttgcatgtactcatgatgagtgacattgccttcacgcaatgttgaattgaaacctgcagcaacacaagtcacattaacaccagagcagttccagattccataaaataagcatcgatagggaataaatcggtaccggcaaatatatcttcactaagattgataattttggatgctttacttacaccaccccttgtgaggtggaaaagacgatcaaagatatcaggatggccatagtggaatcgaaccctgcagattgatgttcagaaagaataatgtcagagatgagcatcagcaaaccttgaatcatagttattgagactagaccagccatcgaaccggtcaggtcctcggttcgatggttcactggtttgaccggttgaaccgtaggttcaaagtggttcaataaggttaaatatataactgattcactccagacacaaacaacagcatggcttggtggttggtgcgccatgactccattcaacccatcctgggttcaactcccaccatacacccctttttcctatattctctcctccttctcatgcgtgcacgtggtctggcagagtagcagctcacggttgagcggtcgagtgctggttttctgaccggcttttaagcggaaaccgggcggcccaaccggtttataccgggtcatttgcacagacggtcttttaactggaccaaaccagcggaggccctggttccagttttttccggtccaaccgccggtccagtccagtcctaataactatgccttgaatcatgaataatagtacttcccacctcgctccttttgatttcacattttagaacccaactatcagtatgtataaaattatcaggactgattgtatgcaaattatattagtatgttcaccattaaaactgctttcagatattatgattttttagtatatgttagtgtaattttttttataaaaaaagaaggtaatgctcaagttacatctagagagccatgacaagtcaataatttcaaacaaaaagaatgggatggtaatatatttgaaaaaaaaatgaataagcaattaatgtggttatcatgccatgacaacgcaatacctcagggggttggcaagcacacgctgtccaatagtcacaaaactggtctcctgatttgacatgaaccatgcaagggatgaaacactgcacaaatttaacaaaatgaaaacaattgagcaaattgaaggctagataatccaaaatgatgacagaagcagttagttacaaatgaagcatgccaaattacctgccagtaaatatatgctctcttactccaagtattgatggatatctcacaccatcatgtttcttcagaaactcatccagcagatttctcattttcaaagcctcctccatataatgctcctgttcgatagtatgacataaatacggtaacaaaaagctaaaagaacacagttgcttgaagcagcaaacacaagaaacttacctgattcatatctatagtttggaggcattcaccacgagtaaaaataattgcatgattctgattttctggttttccttcacctaaaatagcattacctggaagttttatcttgtatatgacctacacaagaagtgatggcaattcatcaaattttgcaccaaagaggctgacaagagaattcccccaacagaaaaaaaaaagagcagtgtaaataagactaaggatatctaaacgatacaaagtatttctatactcctttaaaagaccccaatgctggtggagagtggtgaatctgcccacaacccatcaccactgccatgtgggtcccccaaacagtgaggtatatggaccttcccttccccaaactcaagccatcaaacaaggaaatttatttaaattgagataaaaatgatgacgaataatatgacctaaagatttttacaattagaataattttattttaatttttgaggcttcaaagtgtacggcggggttctcttttttaattcccgtcgcaaagcacgggcattcagctagttagaacaaaaaccgaaagatcagactccttccagcttccatacaatcaaaacaagtactccaatgaaaaaaggatcaacatcagttaattgtgcaaataggttcacctcagcacagcaaaaaaaaaaaaacaaaaaaaaaacataatttgtaaatgtgtgctgctaagctttagctctgcagagaacaaacatgggaattgtgtatcgaaaaagcgttttactatgccagagccaacatggggatcctttacaggctacagcgtgtatacttgatttagatttccttttattatacaagggaaaaaaaaggaagccttgactttatctccttccaaatgggataaaaaaagaggaattggtcaattaacctcaatcaaagtatactgtaccattttcacctaaaaaatacttcctccaatcattaatacatgcctttttaacactaattaatggccatagggagtacttattttacatggcattttgacttacctgatcaagactttgtcctggttcattaggttttgtaacggaagctttcaccaatgctgagtagtaaactttgtcagtcttcttgtttctatcttggctaggtgcttcaacctcatcaatataagcaactcgaagtgatggatatctgcaaaaaaggaccatttctacaagtgtctgacactgaatagacagcaaacggaacagtgataatattaagctgcggatgtttgtcctgactcctgagcaaatataatatctaacatgtcaagctttgttttttgttgtttcttcaatagatatgaaattagatgatacaaaatgttacacatggtactcccagcatagtaaataaacaaagcttacatttatttcattactcgctactaaaaataatgcacatggtactcattgttttaacccaattcacatatactcacagaaagacactcgattgcactgttgcactaagaacaatcatgtgtgctccaacttgattgcataaattataaaagaaataaagcaagaaaaaaaaggcaatttgtgctacatacagataacatatatccagatcattgcaatatttgattaaaacttacactatcacaacagctctcctgcgcattcaagggaaagaaaaacttacactgtcattagcctcaaaatatcatgcgcacaggcttcaccagaacgtttctggattccatattgctggcacgagacaacatatgtaaatttcatgtcagctatagctttgcattgagtcatcaattgcgagtcctcagacatcagttcagttgctctgtaaccttccataagatctaatggaaacaggaagatgagtcattgcataggtcacagaggaaagttcagaacatatagactgaactattagaaataccatcatctttggccatgtcaaggaaagcctgaagctccaacgcttttcggtaggacatcattcctctcactgtaaaaagagcaataatgacaacataaatgagaatagtacgaagtactttcactgaaccactacacatgatacctttgagttagattttcttgtgagaacaaaatataaaaggaaaacatgaggtggaaggaaaaagaatccagttcttgtcaatgtctgtcccctatatgatgcccaaaggcgaagctcctcttccaatgtttcatcctcacggagctcctcctcgctcttgcggtccaccctatcaaggaaatttttccattcatctttgaaaattcaaagagattaggaaacacgatattaattatgatggtcatcaggaaaccaaaggaaatgcacatgtaccttaatccaagaaaagaattgcataagggaggaaagaacctgggtagattttttgtaagtagaaaagtatggaaaccccatcctcatttggctcttccagattatgagaggagaaaagaacatcttccttgtaataaggagtcaagacactagcattgcagaaagttgtttcagcaatcaagaaacccaatcaaataattttatcaaacagtacagatgtctagttatcaaccaaataaaaaaaacataagatatgaatgtaccaacagcaagaacacatactaagcaaagaataagcatggagagtatgagatcaaaggagtcggtgccaatttgagcatgatattacaacacacttttgtctaaaaaatattacaacacacagaaaagtagtaatcaaaacttacgagaagggcaacatatgccgcacttttggagcattaggcatctccataaaaagagaatttgcaaagaacgatatccgtctcctagcatcaaggttcgtagggacatccatagcagactctttcacagtgagaagaaggtgaagcctctttatctgattaaaaatgaaacaaaagtatatatcattatagcaacaggaggaacacgagcatcatatcatgtattcacttcaattaggatataaatcaaaccttttccgtccatgcatttgattcctccacggggaacctaatagctttagtgaacaactgatcttgttgatcaagtgaagtcattccttcgtgttttctatttccaccatgtacagaatccaatagtctggaaggaaaggaaaacaataatatacataaaaccaccgcgcaaaataataataataataatatatatataaccagttaccagagtagttcaagcaaaatcaacaaataatctcaatcaccatactcttatcagcaaaaggaggtacattaatcaccaaagttcatttagagacgttaataagactcctagtattattaaacaaatacatggaaaaaatctgaacagtgctggcagagtatcaatcactccatacttccatagaacaatcagtattttcatttttctaagtgataaatttaggcagcaagcagatgtgttagacaacaacagaatggcattaactaaaaatatgaacgccaagaaagacaccatgctattatctctgtgaaaataaaaaaaaaaagataacatgctgttatgacagaaccaagctatcctcacccgcctagctggtcttgctcatccattatatcccttgtgaccacctcaagcatatcttggaataaaatgacaacttggcccaagtcttcttccttattcttttgctgtattcagaaaatggatacagtgagcgggtatcatctatgaacgcaaattatagccatgataacaaatttttataccagtaattcaagtagttcaatgaacttcttgctcagggcaggaaggctcctcatgttcaaatcctttattagacttcccccttctatgtgttcatcaacaattgtaaaaatctgctgtattactctggaatagcatgcacagattaagtcagaaattcaagagaaccaaatagaattttgcagtagaagcaaacaaaattgtcaccagataatattacatacattttctcacgttgaccaaacactaaagtattgatgatgtttttgaatgaaccatagcactctctgatagcataggaaaaatacggatctgatcccattctcttcttcagatcacgatcttttcctccactgtctgccgccatatccaatgctattggaatctaaaatccagtaaatataaacagtaaatgcctgaatgcaccaataaaacaagcacactttagaaaatggtagagaaaacaccttgctagcaagtaggaaaggtggccactggaatatattcaattcacggtctttacagtatgggacaagtagcaagtccatctccctgttatctataagatcttcctcacggaaacttgtgataattaggttccacatttgagcaaatcttgcggctattttctctttctcttgctcatcaccagaagtctaaaaagaggtatatgagatgaaacagatgatggtgatattacttcaatacttatctgtcaataatcaactcatgatgtcaagcttaagacacgaattccataccttagaaggtttaccagtaaaggcagcacgcaaacctttactcttgtgtgaatcagaaggaatcaagtgctcattgaaggcctcaggcagagattcaaaacgagatctcaacattcctaatgtccgtatctgatgtcatgaaacatgaaaggtgcctaccataagttcatgagttgatgacaattgataggccatagagcacagctaagctatacaccctccgtcccaaaaaagacttgatttctggctatgcaccttgacaaaaaagtcttttttttgggacggtggttgtacaccacaagataatgcttcaaatgagcaaaatataactggaaaaggtagcttaaacgtagagatgtcactgtgaataacatcagtccaagaacattgttttcttatacgctattggatgcagtacgcggtatattagacaagaaaactgttttatcagagaaagcaggtccaacaaatcaaaccagtcataaaatgacttaatgaatgcctgataacaaaacattttaccaacctcaccaagacgacgataagccccatagataccaccgatcaatgtagagaaaagtgcataccaaatttgggtgtccatgaagtagacctggacatatcaattgataaaactcaaaatattggctaatcaacttttgttaacaggaaacaatgaacaacactcacaagaattattggagcccacagcgcaataacaacaccaatgttattgttagctgcaaaatgcaaattgagattgaaataagtgtgccaaaaattccaaaaggtaaaaacatcagttttcaacttaagtaccacgagggaaaaattcatgccactggaaatcccggatcggctctttcattatatctttggttggctgtaccagaggcttgatctgcatggagatcatgagagtatgaatacacaccgcaaggtttcctttgatattttctaacacttaaccctccatcaagtagtttttatactttttaacataggtgctgatactcatcgatatgctggcatcttgaacattcaagaccaaggaaaatccctttttatactttatatttatgaataacaaaacataagtattgagaccacatttgggacgtaggaattttactaggttcctgcaagtattgaactgtttttaaagaaattcctacattcaaaataggatctgagaatacgccaacccataaagttaagatactgcagaaatgtaggcaatatattcacatttcaagttcgacacaagaacagctagtgatgaatgtggaataaagaataaatgagtagatacctctatatagaagcttactgtcaatttcattgctaaaaggaggacccagaacatggtatacctatcacaacacaactctaggtgattagaaaatgtgttatattagaacaatctgcaaagatatgtcaacaacttaacatacttgaagagggaaaatgcgccttcatgcattcctctgccaacaaatagtcgaggctgcagatacatttggcaaaacatataaacaactgtgaccacataaataccatcagaaaccaataggcagaaatttacctgagaccaccacatgatgaatgttatgaccttaacatttgaactctcaagaaaccttctgaggaacgggaaaagaaacagcatagcagcaagcatgtttggtgccaaatatatcacaacagccaaaatatacagtgatggctgattctgaccattgccaagccaacttttaattattcttgcaagacctgtaggactgtcccaggtatatgcataagtcacaggcaaaatcacaacccatgcagatgatgaaattaacttcaagacatatcgcagcttgactgcaaatgacatgcttcttcttgctttccagccaaatacaatgtccagaattgctgtattggttatacttgtcagtaagcatcactataagtattatatatacagggcataagaagtatgcatacagctagaagaacaaggtgttttttattacaaggaaagtagttaagcatatacagttcagttcaatgttatcaaaatttgttgttgttggggaagtatttgttaaggtacatgaacatgactatcaggctatcaattg

SEQ ID NO: 28846 - DNA, 3574 bp, Oryza sativa
  unsure (1)..(3574): unsure at all n locations
nnnnnnnnnnnnnnnnnnnnnnnnnnnnnnnnnnnnnnnnnnnnnnnnnnnnnnnnntgtttctggccaaagcaaaaatacaaacaaaaggtcatagggtgatactcatgggtttcctctagacagagaagccagaaaagttactttaagccctttgccaaaagcatgttaaaaaaacagatactgctaactagactagcacagttctctatccaatattaaagatacctaccaaacaaataggctgtgccttgccaagtctgtgagcagggagaggaaaggagtgtacaagttcgactaaataccttgccctaacttcaaaactgcagccgttataaatatgctcaaaacctgcttaaatactccaacgtcgaatatatcacttggtgtgccaccattccaggcaataataatcatggcctgtattaaaatataagactaagaaatatgttgaaaaagaagcaatggcaagtactccaaaaaaagggataaatgtatatgaacggtcaaccaacctgtaaggataatatcaagaagatccacattctgtcgaaactacgaaatatgtgccagaatgaacggatctcgacaaaattaatctttcccatccaatggacattacctgcggatctgttctcctgcattcgcgaccaaacgagaaatgggtacccagaggattaatactccaagcaagtatttctttttcttggcattacattgaaggacaaggctggaaatgtaatccattccaattatctaagaaacgaaggcaataatgtacaagccacggataagcataagaacttaaaagacaatgcatcaaaactgtgcatgtgttggtgggtgtgtgggaggggggatccaaccaagaaataatgctacatcacctaaaaaacagaacaagcagtagcagcgagcatctgatcagaatattctatttatgaataactgggcttttataaattgtaatagtgcatcacaagccactactaacacttagatatgaaatatgcgcaagatatatctgtattatcaaagaacctactccattaagacgactagggtaagcatcttcaggagttttgaaaaaatcagcatctgctctcataggccatcctagccgaaaacaatccactgacctgcaatacagtaacaattccatgactttctttaaaaaaaaatcttgggagcataggatggtaaaagcgacaactaaaatctgataattgcttaccaaaaatactcatttaaatcatcatagttcctccaatgtgagtgttttgactttatggtcttgctccgttcagcttcctgtaaaatttcataagggcactaactgatcaacctgaaaataaaaggaaaataggaaatagtaacatatttgatacacaagtgaatataccttctctataactttgtaaattggagtcactactttcatcaggaaggcctcttcatcaccaccatacgctggtttaacattttcaccagtcattggactcacgtttccagccaacatgccatagagttcaaaagccatctgttaagatggaaaagcatcattaccatcaagatgatctcaccagaacaaaaacttatacatgcagagtctcatactaatacaaaaacatgccccaacgattatccctacaaactactcttctttctccataacatacatgatactataataacgcaaagtacatttcattggcatggtataaataacaaacctatcctatgccttatatttcccaccgtttatggacagttagacacgaggaattaaatttaagatttcataagctcaaaataaaattgcaagtatttctaattcaacaatatattatgaatcccatcagttttttttctttggtgtgtgtgtgtgtgcgcacgcgcacaaggacatagaactgcaggcacctatatttaggttcgtctgaatcctttgaaacatattcttgattcctcatactacttcttgtgttaacaaaacaaccagtcctccatatcacaatagtgggccacaaacaaggtgaaagggcatcaaagtacagaagagaccaagcggatatgaattctcctaagctactacaggttttgttagaatcaatggaattcctcacaaaaatgatctgagatgttcattattcactatcaaattcctaaaccagttatcaggtacaacccacaaatggagaacagtcaaaccaaagatatgagaaacctcaaatctatatcatgggaaagagcaatatcctctctgttgcaggttttttttttttacttacccattggtcgtacatgggttatccttcaaaagcctggtttactggacctggtggttgcgggcttgcggcgttgcggggcagttggagagggtggtcaaggagttttttacccaaggtcatgggtggcgatcttagtcttaggaatgaatattgacaaccattaattttcctggtgatccattatgttttttctttgggtgggtgtgtgtgtctgagttggttgtgtgcatcttagctacgtagaggctgggagtgttgtcatgacaattgtatcacctcaatgtaatttattgagttcaataaagcttccattatctaaaaaaagatcatggtaaagaacaagattatcttacatgatggtagatgtagcaaagacactctggcatgaacctcaagttagccgcctcaccccaaattagcaaatagagacccatgtagagaagcttacgctgctgaacttcctgctggatagttggcaacctgcagatcaattggccgaatcattttgagagaaggtagaataggaagaaaggttgagaccataatatcagtttcaaatggcataagagcaagaccaaaactataaaccaagtttgttcaaggaagttaaaacaatgaccagcaaatgacaagtattggcatctctgggaaaatcagtgcatgtggtccctataaatcatcccatttacttgacttcactgaagcactgaacctaccataaactgcttttgcggccaaggtacttgcaccacttcttataattcttaaatagcttcttcattacagcatctagagctctgtcgtccaactggaaaacaggattccaagaaaatatatcaataaaacatcaagtcactagtgtgcgagtgatgcgagagggtgggaaaaaactcggtcactcccggaacaaaagtgaaaaataagcacctttgcttgttgctcagtcttaggagactgccttatgtgcacatttgcaagtaacagtattagatgttctctttggttggacacattatctttctgtaaagaaagagactcacagttagactatgcacatttccagggcaaagtacatgttgtgatgtcaacatggagagtttcaccaggaagtggataactacctgaaacccaaacatggcctgaagccaatcaagaaggtctttgccagtcttcttttcatcaggcttcttttcatgttccttgggccacggcaggcctctaatattccttagcgcattaacagctgcttgaatctgtgtagtttatgaggaacacaatgggaa

SEQ ID NO: 28847 - DNA, 1768 bp, Oryza sativa
  unsure (1)..(1768): unsure at all n locations
tgatgcgagagggtgggaaaaaactcggtcactcccggaacaaaagtgaaaaataagcacctttgcttgttgctcagtcttaggagactgccttatgtgcacatttgcaagtaacagtattagatgttctctttggttggacacattatctttctgtaaagaaagagagtcacagttagataatgcacatttccagggcaaagtacatgttgtgatgtcaacaggagagtttcaccaggaagtggatatttacctgaaacccaaacatggcttgaagccaatcaagaaggtctttgccagtcttcttttcatcaggcttcttttcatgttccttgggccacggcaggcctctaatattcattagcgcattaacagctgcttgaatctgtgtagtttatgaggaacacaatgggaaacatttacaaaggcttgatttggtaaaaggatagtattatttttaaaatggtgttgatttgggatagatggaaaccttggatattgcataataggttgataagtactctcaggatcgagtggcagaatattgtaaggaacatagagctttttcttttcctcaactttgttgtgtgtatccagaattgcataacggtcacaggaagagtgcattcgacagagaagaggagaagttgcagttagcaaagaatgcatggaacaataagctgataaaagaagaaggcgagcataacaaaaaggaagtaaaatcaagtaccgcttgatcgacttcaacagattgggaaacattgacggctttcaagacctcgaacaagacagcagcagtttggtatgccttagtgagcagagcactggacaagcagaagaaagacattgctgttagtaaaggagcagagttgtgtccaaaaataaaaaagagatggtgcgaaacggaagagaggaagggtggaagcaaccaaccggtcagccttgtcggcagcattttgaagtgcctggatgtacttcttgtagtattcacggtagaaacgttgcatctctcgagcgtcactctggtgaacccttcccttcaatgttggatcattttcctgaggaatggaatggaaaaaaaaaagaagaaaggaggtagcgcattacagatgaattgttggtagtggtgaacaaatacgggttgtactacataagtagtagaaagaaagggatcgggcaaggaagaaatagataaagagattaccctttcaagcctctgcagaagcgcggttttgaattgacgaacaccacggccattggaggtggggtcgaggcgatgagccttctcgaaagcatagaaacggcctgcaatgcaatgatgaatggagtagtagctagtagttgagtaactagtccagtaaggaaggtaaggaaggaagaagagcattgaattgaatggaacatacataggtaggcgacgcgtgggttggtggcctcgacctcgttggcgacacggaggatgggggcgatctcgacgagcgaggaggggacgacctcactgtcgaagatggactcgcccaagttgccgacggtctgggtgcggagcagcctcctcccggctgcccccgccggcgagggaaagggcgaggccgcgaaggaaaagtcgggcctcctggcgccgccgggcgccgccatcggaatctcaaatcaaatcaaatctcctcctctgcaacacctagatatcgagcaaaaggaaagaagagaaaatccgtcaaaaaggaaaannnnnnnnnnnnnnnnnnnnnnnnnnnnnnnnnnnnnnnnnnnn

SEQ ID NO: 28848 - DNA, 326 bp, Oryza sativa
agactatgcctgcgggcttatgatgtaataattcgtattagacactcgtgtatgtgcacttggtatttcagctatgaattcgtgtgtaccagactacttgatccagggaaatggtactgtttacacgattgattcctgttataaaaacgggggtctacatacggtggcaccgaggatggcagcggtagaggcggaggttgctcgggcgctagcggcgcggaagggcaggcggcggacggctgacgacggcgcgcggaggtgggcacgcctggctgggcgggcggcggactgcggcgcgtgggggtgggtgtgcctgcctgggagag

SEQ ID NO: 28849 - DNA, 737 bp, Oryza sativa
gagtgagctagatgatgagatgtgttatatagagagaaagggggagagggagattaatttgatggttggtattaatcaactgttgttgttgacttgttgtatgaaattatttggaaaattaatcgcaaggaagaagaatcaagttgaaaaaaaaatccaacgcatgcaatagcgagtcaacaaaaaacattgaccaccgtacccatgcaagcgtgcatgcggatgagaagggtacagctctgctcatttaatgcacatgcatgtgagtgtgaggcgccgcagacgcagtttcttgaagccgccagggagccagccaagccaaagtaggagtaggagataaaatacaaatactgtagcaagcacgggaaagccagggagaatgaaatggtcaaagttggcagtgccaaattgccaaacttgtgcaaatggagagtcaacccaggcctaccacgcctgtgcagggacagagcaccttattgatctaggacaaataatattcttctgcttgcttattgatcttcttgtcccacaaatatccagttttctattcttatcttgtgcatctactcgctccatccacaaaattaagctttatcatcttcgtttctcttctatgcttaagtagagaccatgcctccaattgtcagttgcaaatgtcccgtattagagcttggctatgccaaaagtttagccgagcgtcgaagcatagaaaacagtcttaatgaaaggcatgatca

SEQ ID NO: 28850 - DNA, 2495 bp, Oryza sativa
ccggtgaggttggtgtcctggaagacggagagggagacgacgcggccagagtcctggtcgcagtccacgtcgtaccagtcgcagcaggaggtgttgcgcgtccacgacgccaaattgtaggggttcccgagggcgtcgtcgatggccagaagcgccgcctcgtcgtcctcatggcattgcaccttctgctgctgctcatcgtcgtccttggccatggaggcagcagacaggaggaggacggacagcagcagcagcagcaggagcttcacatccatggtcatcatcatcatcatatatattggtcgtttaattttaccagcttgagctagctgcttaatcaattgccgactgatcgagtatgtatgtatgtatgtatgtttgtgcaattggagtgaggtcgcaagagatattgagatgcatatggtgcatgcaatgccgtgtatatatagcctcgcctgggccctgctctctctctcgactgaaaagagatcttctttttcaggtgttaaaaggttattaagttgggagcacctgcactactgagacagagataaagaagctaattaagatagataattttggattaaaatattgggaaaaagcgcaggcaagtgcgcgacaaagatacatggaggcaggccaggccatgcaacgccaatgcagtagcgacattcacttactaattgctcagatatttcacccagtagtagcatttgcattgcggacctaacctcatgtgatctgaatctgactgacatggatatgcatttactagtatttcgccggcctttccatcgatggatgcttacttgcgtggacagatagttgcagacggccaattgcaacaccagtattcacgcatgcttcacggattaacagcccttctagtgagggaggaggcactgaattctcatcactcagcacaggagtcaggaatcgtaatggccaaccaactggattgttattgcctgcagcacattaattgttccaacaggggcaaatgctctccatctttctttcttctattagacacaaaaggccttatgttttgtctacagtgtaaattaaatcctagcgatacctaaaattatgtagcccatcttatcctatcaaaacaaaacaacaatcctatggacaaaaaaacatcatggtttctggtcgaccaccggaagctacggtatcaccttccaggaccactgctctctctgtctccctccaatcgccatgatcaacgataatgcttcatttcagatggtttcagaccgtatcgctgctgaatgctccttcaaatgcaaaggggaggcttcaccaccaaattatatatgctctcctttcatgacgcatagcactgaaacagaggcacgcacatccatggtttccttgtcttgtaactttgttatctactaacgagccagctttgtttaaatataccacctttcctgaagttgcgtccatgtggagatgcagaatcaccttgatttcggtagcactgaaaaacacaatgttaaaatgtttagacgactttatgcgcatggtttttttaaaaacaaaagcagctgctagaaaaaaaataatagcacaagcagttccagctcatttctcaaagggttaggcaatccaagtaaaccatagatgtccaatatccaagttgctaagcacagctaatttgataatgctgcttttgtacgagagaattcacctgcaatgcattatcggataataatccagagtatgcatctaacaaccaatcacgttttcattcaaagaagtaaatagcaaaccaaacagcaaaattgttttgagttgacataccctgtagcatacaactgagtcatctgggtacatgacaaacagcttggtgccaaggcgagctcgacatgaatcacatatgctctcgtcagttagctgcacatgccttgacctctcctctaatctggtcaaccgtgcatcaaggttcgttgcgcgtgataaattatgaactacctatcaataggcatagagcgaaagagaaaatggtaagtcaaacttcacataaaagataagaccaacctgggagcaagtttgagttcaagagaaatattaacagtgcagaggcagaatagttcctcaaacagtcacatttcaatagaagacattggctgaaaaacaggaaatgattatgtttacctgcccttgacgatgatggtgcacccgggctctcagcattcgcaaaattgtatctgatgctagctgaagaggcatatcagcagataatctctggcaaaaataattatagctcaggcttcagaattcttgttctaataaaagtagcacaaaataggatgatcataccaatagcagcgataatataaacataaaagaacacggtgggatgcccctacaccagttttctattatccatgtattctttatttctttcaaagaccaatacacagagattaacaaacaggacatctcatttaccttttgttatatatcaactcctaaagagaagg

SEQ ID NO: 28851 - DNA, 1234 bp, Oryza sativa
  unsure (1)..(1234): unsure at all n locations
tactaataagtcaacatagaaaagctaaaatcaaatcaaaacatagagaatgtaccaagaatactaacaagccaccatgtaataaatactgaagtgaggtaataacatactgaatataggcatcatctcgaccaatctctgcacagtactgctcagcagcttcactatcctccagtttccttcatcataaatgaagaagaaccaacaagaaagttagggaacagaacttgtaggggtgtacaagtccagttaaacaaaacattactgctgaaatttacaagtaacaacaaaccaataaaaaataaatgcagcacaggatcttacagcgctaatatctgaagtacaatgttctcttggcccatcttcctatacaaaatagcctgccagaaggaaagagatttttatgtcaaatatgtcagatataagcgatgaggactatcaagcaagcataaatttcaatgggtaggacacanaatgagctggcatggaacgcgagaaggaagaaataaattgtataatcaccttttccagccatagctcagattctgaaatcacatatagcacttcttctgggtcatacaaatctgacgattgcaaaaaaaattgcaccttttcccccaatagataaatgaactgcatatcagaatcaaattctttattgtttctctcttcattgttggatcccaaacggactgcgtccatggcagatctggagagggacaatgcatatgacgtgtgatagtgaggctcatcacattcctgttcctcaatcaaccattgcaaatatctgcaaaacttagcatattcagatttcataaaagctgaggaatttattcagcaagagtacaaaaggcatagaacacatagagctttcaaagaaacatgcaaatggtaactatatttgattaagaactacctaatataatacgcatatgatacagtagcttcaagtcataatatgttatttcattgagcctcattatgtttccttcgtatatatttagaatacgcttaggtcctgtttgatttataccccaattcaaccatgccaaataattggcaacaccaagaaatttgtcacccatttggtttgcaacctaaagaactgccattgccaaattatttggcatcactcttatgcccatacaaattagaacccactcattcttgccaaaatttttggcaatagacaaatcttgtcattgcccaaaaaaattggtaacactaggaatgg

SEQ ID NO: 28852 - DNA, 1169 bp, Oryza sativa
gttaaaccttgagcatggattttttttgtcataaaatatattctaaatagaaccaaaattgtgtgaaaacattttgaactggtatttgtaacttgtctagtttttggtcaaaatctacaacgtttgactttttaaatcaaaatatgccttatagaaatcaacgaggagatacagcattacaattaacatgtggtaatgaggcataccagatctgaccaacgattagggtcccgcatgatgaatggaaatatttctgctggttgcatagtttccgagagcaagaaatgatttacagcatcctcgaaacgcaagtcgaaaaacaacaagaatccaagttgtgcatgcacaaaggaaatcatgtcatttgagatttccccatcggcctcgaactcttgtaacaaagaaatagcttctgcataactctttcttcgtagtagtgccttgatctgttccaccgctgatactttacggtagcaaaatacctggccaagccaataaatgtgtccataagtacagtgtgtgatacaaaatcgacatgataaaatggcgctgcacatttatgagagaatccattgtcagggtttcacttgagcatacaaaatcattgtcttgtcattggaaattgtaattattgagtattactaacaaacacagaacgcagctcagtagctaagcaatccggtagagcagattggaaattttgagtcaagttgcaccgatggatgagttgacatacctacgttaccttataagccgtagcaatcacaactacgtcgctgccaattccggcatcctcgctcgctacaattagtccacctgtaccaggccttgcaaaaggaatagcctgcaaatgtgcgccgttctttcttctgtagacatctaccttggagtccccggcaacaacaacataggggtacacctccgctatacaatccggcgtggtgttaaagacgaagctgctttcaacgggatgccccgatcggtccacgacgaccccgacattgtcgacgagcagcatgacctcgtcgcccccggacaggggcttcaccctgggtggcctggaggactcagggagcgtgaatatatcgcaccttgggcgttcgtggtggagaagagcgagtagcccgaggcagtgccgacgaagacggagttcccgacccaagcgagcg

SEQ ID NO: 28853 - DNA, 808 bp, Oryza sativa
agactgtgcacaagtgcagtgatgatcctggccctggccagtgtaggggggccagctaaaacggtggcaggaaccgcagcggcagcatctttgcttggttattggattcttggtgagtgctcctcctcctcccttactcttgctctgcctgcgcctccgtgtcttgttgtcttgggaatacaattaaagaggtcttctttctcactggtgatggattattaccagtgggaaatgcattttattagccactagtagtagtagcacctccactcttgaaaactggtgtccttttcctgtcagtgttgtctctctttagtttaaataaaatggacaaatgaaaccgaaaatgcaacctgctgtttcttcggctacagctttatttctgaatgagcactactacggctgtgtggatctaaacttcactacttttctatcacatcaacatgtcatacacataacttttcagtcacatcatatctaatttcaaccaaaacccaaactttggatccaactaaacacagcctacatctatttttttttacaaaactcttacaaataataatatcaaccgtttaacttaaatatataaaaattatagataacctgaatgtatttacagcgtgacatgtaaatggcccaagaataatttatattaaaactaatctactaatataatagatttgctgtaagattgttttcgacatgttagcttctccacagtagcataaaaggcggagcgaaccaacaactagggcctgtttggtacagctccaactcctaaatataactctaggagttaagtctggag

SEQ ID NO: 28854 - DNA, 760 bp, Oryza sativa
agaatagtgacgatgatactctagatgctatgatattttttgagatgtcgtattgtaggtttcatgttaatgggtgttctggataacttctgtcttcgacagatcggcttcgatggctatggcctatagcggctcagttactctctaacatcaatttttgttttggtttgatgcctgttctcgacaatgatgtgtgtggaattcgatcgacgcaacgatcaaagttgattttagacattctgatttttcaatatgagaaaaacacaaagactacatacaacttataaagcattgagaagaaaataatagttatgcgtattattgtcaattatagatagtaagtcactatctttaaggtattataagttgttttattggttttaatcaagcagtgatttaaaaaaacctaagtctactgtaaactgtaactaaatggtggtagaacatatatggcctcatcagatggccagatgctttggctgatcagccatttaagcaaaataagctaaccaatatacattgaaatttagctgaattagaggcagttttggctgatcagccaaaacatttggccatccgatgaggaccatattatacacctattataacacaaatcaaacacaatatcgttttgtctaagaaaaaccatattaatgtatactctcatagtagggtatgagtattggaaatatcaaaatcacttacctattcattcattttaaaatataaaaaaattttagttagatatgatgcatattag

SEQ ID NO: 28855 - DNA, 3688 bp, Oryza sativa
  unsure (1)..(3688): unsure at all n locations
ccaagctttagcacacaaataggacgatgattgattcatacttaccagtacttatctctacggttgtaaaaacagagtcctccttacatccccttgctcctccccccaacacacacctgagcgctgccccaccgtgaaaaaccaaaaaaaaaaagccattcatacctcagtttagttctaactcaaagaattataatttctttccatcaaggctcagatatgcagaacacaagatgcaccagtgtcaattttcaataacatgcatcatgtggtccctttccgcagtacatcgtagaataggatctgaactagcaattcaggagacagggaaacatattaccctgtgaattcgcctctcaatccatcatctgctccttgtacaattcacctgctcctcagggaaaaaaaagaaacggctaagcttaccatatcatacactattatcttaccgcttacagtagcaatcaaacaaaatctccccgagaacatcgcttgaagctaggtttaagccctatgcgaattacaatagacaacactcttacccttgacccatgacgggagatgaaatgagaaccaggcacaaaagggtgaatgtgctaaaatgatttaagatgtatcaaatctacacctctgattttaagtcagtcagctcaagcctgaccctagatgctcaactacagaaggcccaaatgacagatgatgccttagtctagttaatcccttagagtacattggagaaccttattaaacctgagagagtacattcttgtgaaaccaaattcaacaaaaaaaaggcgacaaaacagatttagcggctcttcttgctttcttttgcagcagaggattttgacgggcttgcaaccaggtagataaacacacccgccaaggaaacaacggagaccagcgacccatattttcccacaagtctctgcagatgacgttnggtaacacattagatcacaatgtctagccatatggttttcttttcttatcgcctatttcctacttagataaaacacataagtttacataaaacagagggcaatggcagtaccttagcctggaaaggtcaagtgcaaaagttgcatatccataagttgagtaccagcaccaaaaaagtaaggcgttgagacataagaatcaggaaaggttttactcttaatgaaagcaaatggtatgagataactaaccaattcaaacttctgttggggaggtctctcagcaagaatatcaagtggaaacatgggcgttgagtaagcctccttgagaaaaataattggcagtttaaactcaagaagagaatagtgcaggaatagtatggtgaaaatgataattagaacaccaagtactagggtcgtaatgagctatttaagctgagcaaagttagcccctttcactatgatccatggaataatgagatcgatcacactgcagtccttagaaaaggctcatccggtgctcaatactaaaggtatactcactcgattgtgatggcatgtgaaacaaagcatcacgaaacgaaaattcaagtttaacttgtgaaacaaagcatatgacaagcatcaaattgcatgagtacctgaagtgtaagtatgaaaattttgatgtacctgaagtgcggcctttgtgggaacacggtatgtgataatggcaggagagccctgaaacttgccctgcactttggtctccaagatgaagttgtgggaagcagtagcaccactgaaagcacaagaggtaaaaaggattgtcaaagggcaaatattggtgtgagaaagcataagtaactagtaagtgttgttactaacggatcaagtttttccacaatctttgatgtgggtccagagataagttgaaaagcctcctgtggccaagagtcgtcgttcaagctaacatcataggcggtcctgtaaaaaatgagagagagagagagagagagtagtaancaacatgatagaagaatagaagatgaatggttgatggcactggcagtgaagaatatagggcctgtttagatcccaccctaaaattttacaccctatcacatcgaacgtttgaacacctgtatgaagtattaaatataggctaaaaaaataaccaattgcacagattgcgactactttgcgagacgaaatcttttaagcctaattgctctaagatttgacaatgtggtgctacagtaaacatatggtaatgatggattaattaggcttaataaattcgtctcgcggtttactgtaattagtttttttattagtgccgaacacccaatgcgacaccctatataatacccggaaacgccaaaactttacaaccctggatgtaaacacccccataataaggattccggttccccttccctaaaatagcagtgtggttagatagatggagaaatggattagcgattgatgtgtgtgtatgtgactatcaatcatgtcatgtcatgtaggagtagtatatatgcacaatagtagcgtgataatttgtgttatcaacaagtgagtcagcttgacattattacacagagaaagggaaacatgggctcgcggctatctatcaagtctagctaacagtaggaattcccgttgtttttgacctatgcgaattaatcaataaggaaaggcggatagagcaataataggttaacaaagtgaagagagggagagagagatgtggatctaaatctgggggaagagggagatgagatggggaggggactgacgcggaaccctggttgtagaggttgagggtgacggcgaggcgctccacgcctggacccgggcgggacagcgcaaccttcttctgtgctaccacgaacggcgcatcctgcccggcggcggcggcgaagggcacgaggaggaggaggaggaggaagaggagagatcgccactgctgcgccatcaccgctcacggagattgctttgcttcttccacctcacctcgaccgaggctattgttacattacatgtgtgttcaagcccatcccatctattacatgggcccccgtgaatactatgcccatcagcccattttactacctcctgcctcctatgcggccccctcccctctctaccaaaaaaaaaataataccacctcctattcttattttttagcattgtccatatttatatatgtgttaatagatctagacatatatgaatgtgaagtcttataacctaaaactcaagaaaaaatatttactcaggtcctagttttaaaaaatactcaaaatacatataaggttaacaattgatgtattcatctaacggtttaaaaatatgaattgtttatgtagcttacttacccaacatgaaagtttatatataaatttcaagttttcacttttttaaaaaaaatatttttgagttttttatgagagagaaattacttacgcaaaagataattgacattagaaatgaggtatgttctcgaaaaaagttacattaaaaacagcaaaaaaaaaattcttgcagtatataatggataaataattttttttaaaaaaatataaaaatgtaaaatcttaaaactagtgcataaactagcattttttttcttttgaaacttatggtaggataaatcaaatattaaccgtatatggtgtattttaggtatttttgaaaatagtatagtccgatggtatattgtataataattgataacttaccgatatattatagaaagagacact

SEQ ID NO: 28856 - DNA, 1280 bp, Oryza sativa
aggagactttgacaagggcaacgtatgtcttcattatttactttctttataatctactcctatgttgcacttgttcctctgtttcatctgacaaactctattggaaaaagtcacatagtgtaacattactcacaacactgaatgagctcatgtgtttgtttctatctatcaccattgagccaactatttctccaaaaaaaaaaaagtttgatttgttttatcaatgttagcgctttatgctgttttggatagaaagctgacctatatatgtgttttggatcattatacaactttgtgttatgcacttcagtgcttgccctatggtgttttagatcattatactgctttgcatcatgtacattatgagtatgaattggtagtttgtgatcagcataatgtgtatgcagtgattattgacttcatggctagattacaaggagattagcaccaaatcctttttctttaaattgatggcctaaattaaatcatgcagctgcctggtttcatgaattatgaatttttgacctagcctacatcaaatcattcagctttcaacttctgcatgtggataaagtaggtttcaaaaaatgaatatttcagggtactggagggaaaagcatatatggccggaccttcaaagacgagaacttcaaatgtacgtctgacaaatgacctaatctgatcgttctttctgcttcttatcttgtggttgtgctgattatatgtcttgtaatgtttgtagtggttcatactggacctggagtggtcagcatggccaatgctgggccaaacaccaatggcagccagttcttcatctgcactgtcaaggtaacactgtactgatatgttcactgtgtactagtgtcgaaactcactcaaaattacattgcgctgactgctacctgcgaatgcagacaccttggttggatgggaggcacgtcgtgtttgggcaggttattgaaggcatggacatcgttaagatgatcgaatcgcaggagactgacagaggggaccgcccgaagaagaaggtggtcatcagtgagtgtggggagcttccagtggtctaataggtgccagagggctaatcttcttcccccggagactttgctgtttttggtttcatagtaagctgtgaacttatcgcatgttctccgcgcagtcagagatcatgctgagttgaggccaagatttctaagttgagaagaatcctctattgttcggctggaataaaacgttcttacctgtcgagggtcaggaaataatgttgtggttcatgaaag

SEQ ID NO: 28857 - DNA, 1954 bp, Oryza sativa
gaaaaaaattaaaaagacaagtcacgcataaaatattaatcatgttttatcatctaacaacaatgaaaatacaaattataaaaaaaaatcatataagacggacagtcaaagttggacacggaaactcagggtttgccttttttttttttgggacggagggagtatttactaaggccctgtttacatctcaccctaaaattcatcctatcacatcaaacgtttgaacacaaacatgaagtattaaatatatgttaaaaaatagctaattgcacagattgcgactaattgctctatgatttgacaatgtggtgctatagtaaacatttgctaatgatggattaaataagcttaataattcgtctcgtggtttattgatggattctgtaattagtttttttattagtgtccaaacaccccatgcgacatcctatataattcctgatgtgacacgtaaaactttacccctcagttgctctttgtacatcctctggttttggccttatactgggcactgcactaggtagaaagaactagctgatgctacctaagtactacattgcaggcttgcagctgatgaggaaataaccgatgaatttggtggtgtttgaatctcctaaagattaaagattaagtgtttcacgtaaaatgagaggataataacgtgtgattaattaagttttaattattataaacttaaaaatggattaatctgatattttagaacaattttcatataaaaagttttcgcacgaatcacaccgtttagcagtttgaaaagcatgccactttaatccaaaatttaatccaccgttttcaggacattcgaacggggctgttgctagtgttgctgtgacttgacttgcaacaacacagcttaatctgggttaataatactacaatttttaatcaggaaactgggctataataattactagtaaaaaaaataggggagtttatatccaatctttttcttatatgcaattcaagtgatgggactataggcagcaagtactagtgtagtatagtaaacattatggtgggtagatatatatatctccaccgcacattcctcatcgagtggaccttgtggtcagctgcatatccatacttgtatgtagagaagaatgtaatactgctccagtaggcagcatcctctcctctcctatatcatcatcatatccaatccttggttggttggttcgttcacaaggaggaaagcctcgagcatcatcatcagtaggaagaagaagaagaagaagaagaagaagagcaacaggaagaagcaagcaagaagaggaagaagaagaaagcaaggagaagaagatgcaggattggggtccggtgctgatatcttgggtgctgttcatcctgctgtcgcggggcttctgttccagataccaggcaagtgcaggttgatcgagttcggcaagttccagaccagcgtcgtctccatcctcgtccacaccatcctcttcttcgccctggacgccatcttcctcgtcgccatcggcgtccagatcaaccttggctcctctccctgattctctctctttgtttcttctaggtaatctcaattgcatatgtatagcagtatatatgcacctccatccatcatctctactcaccttagctcgttaatttgtactactatttgtgtgttccttccaattcttggcataatattgtgactcaaaggaattgatttcagagttactcattacttagtttcttcctccacatatatatgtagcaaaatcaaaagtgcaccattcatagcatttcaagtaaattacaactagcaaatttcccacgcaaaattaggcgaagccaatttttttctttttctttttagtaagagctggatttggcatacacatatattttgtttccatagatatttgtattttgtatacaatagatctttgaaagtagaattacatttgatatacaacca

SEQ ID NO: 28858 - DNA, 9577 bp, Oryza sativa
  unsure (1)..(9577): unsure at all n locations
acccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatgctatttacggtggatgttttggtgctgagtatatcaagaaattaggacagtacggaccatctactttacttgtccagacatagaaatcgcgattactagaatggaatcattatgtagagactctgaacatgtgaattggaatggtggctacgtgttgctatttgtttatgttatttcttgtacactattatatctatccatttttgcagttaaaagcacaagggtaccctaacatccttgtcactgctggcttaaatggtaggtggtctttccattttgagtttctgttgactggttaattgatgtatctgcacagttaactagtttgtacgaaccagatcctcgtgtgatgtactcggaaccggcgaaatatgtcgcaaagctaagggaactgaaaacggatgacaatcttctgttattcaagtgcgaacttggtgctgggcacttctcaaaatcgggaaggtaagctttagatgctgtcattttcgcactttgtgttcaccaaaggaataagatccaacaaaatgagtgactgttggatgcttgcaggtttgagaaactacgagaagatgcgtttacttatgcgtttatcctcaaggcactgggaatggctccaaaggcagcgttgtaaaagaaagcccttctgttccgggttaagatggtggcggttctcaagcattgattggctgattgtagtaaaacttaacttgagtcgatcggttgtgttgtgttgtgttgacatattcgactaaggccctgtttagatttcaacttttttctttaaacttccaactttccgtcacatcgaacttttctacacacacaaactttcaacttttctgtcacatcgtttcaatttcttcaaacttacaattttggcgtggaactaaacacagcctaattgatgcaagtcagtcagacattagctatgactattgactatggggttggttgccgcattttcatcctactactggttttcaaggccattagctaggacctgccgaagacatacatgtatatcagtacatgtatgctactatagtttgcaaaaatggttggtttggtgatttttttttaaaaaaaaacttaggaattggagaggtttttttgtttgatctttaagtgtattgaccaaaagcagcaagctggccggctgggtgggccaaaagatttggagtctcgcatcgctaggcatgatatttgttgaatctgtaatgtaatcgactttttttctcagatttgttcaatgtatcgtttgctgcggcaccttggacattccagcgtatttttggcacctaaaagggtgtaattctaactgaataaggtcagctacaactagttttcagagattttgaggactttgccacggaccagctgaataaacacatcgtgtagttttgattctttgagaaagttaatataagccaaaactatactttctttgattctttgagaaagttaatataagccaaaactatactttctacgcgaagctgaatttatgtactagtacatcattgtagaactcatataagatgaaacgattccagtttgtagatgattcttgcgttccctgggtcccttggagtatactcaaatatatgtatggcaattcttgtttagttatcgcaccatgtcataatttgctcctttcaaactcggtatgcattcggatagtaatagtaatgtgatcagctgagcatttgctgacattcgtgacatgcgatgcaactggtggttactcagaaactggagtacatggaaattgcgtgcaagctttgttgtggtggttagtttgattcagtgcaagatggaaatgctcagccgagttgcttgcctacattggaaggatggatcagttggctgccatgaaacatttcaatttccatgtactccagttgtgacaccatgtcttctacatttgcgagccaccagccagacagaaacaccaatcgcattgcaagttttaacaccaaatctccagtgctaagtgctaacctaccaggaataatcatggtctatctatgcttgctcactgctatctttgactcgccggtgttcttttctttctaccttcctcgctgagccacctgcaattatgaacgaaaatgaactgtaacctcacatacatatcacattgacaagaaaccaagaatagcactggtctgtagattttaaaggactaagtatcaactgaaaaatggatgggtatcatcggagggaggatgctaaatctgacttagactgattaggggcaaagcgatcgagcgcagcttggggtctgtaatacaaaaacgcatgctagggtgatgctcttctgttcctaagcaacaacaagacgaacaaaatatatgggagaaggaacaaggcatacccagcctgcgtctgcttcctttttccattggcacccattggcgtcttggatctgactccctcagactcagagtcactcgcaatgctgggaaaatacgcatcagaatcacttaagagagccagtctatcaaaaacacttggatcaattgaggtttccttaagtcgttctttcaaagtttccagcaaaacaatccctggaaattaaataaaacaatcgacccaacatggatcagcaagcaatgcgagatagataaagaggataaacaagaataagaaataccaagagcacgcagcgtgggaagatcatagtcgtgaccaagcacagcgaggctggcattttccgtgcataccatggccaaatccttcaaggtgatgagcaaatcctgcgattgagcagcccctcaatcggagatgagaaaccggaaaaagaatgaaaggcagtggcaaaagagaggaacatacaagctcggggtcggagagggtccggagccgtcgtgagtcttgttgctgcccgccacgagtaggagatgatggctcttcagcgttggtagacgcaggttttttagcctgagtattcaaagttaattaaattcatatataaagaggttcacagaaacacagatcaaaagcagtggagtaccgataaataaatagttcaatcgtagagataatataaagtaaattgaaaacagaatagaaagaaaataaatccctgcagacatgcaatattgatatctgaattatgcaggttaggttagggagaagaggaagcagcatcggcaatctcatcttgtttctttttggagagaaaatggatgagatagcctgacagacataatatgtttgctgtatttggttggtatgatgtgctagtatttgatttggtgtgagagaatcattcatgtagagtatagaattgagaccctacattcccaatcaataatgagaaacagtactagtatatgggaggggttggagtggagaaatggaggatggggaaacttttcacctgagctgaggttgaggctgagcctgagctgctgtggtcacggtctgctggtgtgccgacgtccctcatgccggttgcccctcgtcgtccttcagtggcggagccaggatctcttcatgcctagggctcaaattgaaggctaaaactatccatgacaattcatacactgaagtacagtgcgagtgctgaaaaaaaaaatgcaagactgaaatacgatttctaatcatacaacgaagtacagtaaaagtacaatacctaacgcaacatatcctcgtaattttcactattcattaacagtactacgtagagaacctgaagttgaatccagaaaataatattacatatgtaagtgattcatccattaatcattcatcttgttctgcagctcagttttaataatgttcatagctgagaaggctctttctaccattgccgtagcaacgggcaaaattaaggctaattcaattaagcgatataacaatggaaaaaccgtgtgtctattacttttaaccatcttcacaggctcacagaaaggttgatcttggtcagagcagcttgagaaatccaaatcagattacttacatcacagataaatgtgtcaagttgatctctgaagactatacaatcatattcaaaatagtctgccgcatatatcttagcaagttcaatgagcttatcttcatcataattggtaaaagaattccttggatcaagacaagtaatgcatctcaatagccgagtagacctttcagcaaagcgattgtttaaatcaacaataatttcatcaagtaccacattaaatatttcattgctgaaatgatgcaagtaagttacaaattgtttgtgatgtttctgggttggagtggactcactagactggacttggtagaattattttaaagttctatcctcttcatctaaaaaatcaaagcaatttctaattgagactaattgctatcaaaagcagaataaggatgtagatcgaacatcaaagattagagagaagattgacctggatttgatttggggaatcaagctttggatgagaaaggggaactgcgacgccaatgcgcgcgccgctgccgagacacgccgccgatgcgcagcgcagtcgttacagaggaagcgcgctgcctccttccgtcgattcgcgccgcttccttccgccccgatgcgtcgctcgctgccgctgtggtgggtggttttggtttttcttttcttggacagagagctagcagcaactggaaaagtaaaggatggggagagatggagacagatgggcgggcgagcacttggccaccggcggcggcggcggcggtggcggcggcgttgttcggagaggagtcgtcggccccccgggaagaaggaagaaagagacaagggaaggcaacgtttcggcccaataccttcatgggccggctgctccgatatactgctctccatgtgtatacgtatggaaaataagttcactttgaatacctcgatttggtccctgaaccgtaaaaccggatacaacacatcacccaacttaagtgcaaacaaagttccccggcaatattatccctggttttgacacctacatgacttctttgattaggtctttgtcccacgtcacattgacgtgacacttacatgatagctcgataaaaaaagagcaaaattgaaaactagaaaattgaaataaaatatattgaggcccatatatcggttaaacaaaaagataaaaatgccaccctctctacctctatctcctccctccgctggcaagctgaagttagtagggaggccgacgagcggggtgggaagggaggatgcgggaagggtgtccataactccatgtcaatgaggagggtgacgaaggggagtaggccagagccaaagtcgacgatgacaccgatgccagtgtctgcgcgggttgtgaaactgagccgctccagcccgttgcagagaaggggtgctggtgtggtgctcccagaacgcgacctccggatgggcgtggatgtggtgccacacgcgcaccatccagtcccgtgcgccacaaaagcgcctcctcataacttgtagaggcagaggaaacaataaggaggaagaagagaggagccactctttctccaattcggtcaccactgctacgattcggtctccgccgtacctcatttctcctatgcgagctccgcctggcctcctcttcctcagctgctccctcatcaacgtgtccactagccctgaggagattgtttgcgccaatagcccaaagcccgtcatgtggaacaacgtcactatgaccggcaacgacggcttgccacttcaacttcgatggcttggcggatggaggaggagcaacactgtcaagccgtcttgttttgaaggaaaagagacaaggatttggggagagatgttggagagtcgacattagcgaagatgctcactcccttgaatctggaatcgtagtttgaccttggcgacattgcgacaaggtggcgcagcgcaagcttgacgacgaggtggcccaactggcccttttccgttgcctctgtcgtatcctcctacttcaccgaagacagctatgaccccctctcctcttctaccacttaggtccaccggagcccctcttcgctaattgcccacagcaatcaccaccagccgcatccggggaggaagagaggagaaggggaaggaaagtgccaccgcctgggggagatagaggagagagagaatgaggtggaggaagtgggccgcactgaaacgtgggtcccactattttttaatcttattgtttgactgacatataggcccacatattttgtttttatttttaaattgttaaattttgcttcatgtgtcacatcagatgaagactgagtcaaattagccacgtagacaccatgttagcttaaacctcagtttaaactgtcttaggacctatattgcaccagttgtgatagttgagggactcgttgtttttgtattgcagttcaaggtcgaaaatgctgtcaagtaaagggacctaaagtgaacttattcctatatgtatgtacgcatgaatttgctttgctgaatttctgttgaatcaatcacctctgagcagagctttgagaagaggaaagtaaaagatcgggaagataaagatgagtcattaacgtctaattaattattaattattttaaattttaaaaaaagttaatttgattttttaaattaacctttatatatatatattttaaaataaaaatgtaccgtctcgttgtttgaaaaacatgcatacaaaaaacaagacaaatccttttttgcgttgtcgacagtttaaaaagcgtgcattcgtaaaacgcattcgtaaaacgacacacatcttcctttcttgttttttctcctcttgtcgacattacactctatatataaggggaaaaactacattaataacaagtttcggtccgtaaaagaaacagcagacctgacaattcattgcatcacaaaattagtactagcatgtcgtgctgtgccaaaggagtataatcctacagtggaaggaacaagtgataaacagatagaccaatgagtcagtaaccaccattttcctttttgttttcttctagcaacgtgtttacaattgattgaaagtcaatcccaccaatgagagtatgagacgagacgaaagaaaacagtagtgtactcgctctcctgtctaaaaaaaagtactagtaatactcctctcctggcacctatttttctctttgcaattgagcgccagtgaagaatgaatgaaaataacagttggtatgtatgcctatctctattttatggcagttgcacatcaccaccatcatcatcttagttagttggtgacctcctcctcctcctccttcgcctggcagcgggccaacacgcagtcctccatgaattcagtgagctgagaggtatacagctctggattgctccggtagtggtcgacatgaggcgacgacacaaagtcgcatgctctcacctcatgcccggctcgccgttgactctccacgaacgactccaccgacttggccgggattaccctgtcagcagagctgtatatgtacagctgtgggcattttggctgcttcgacgacaatagctccatcacacccgacaacttcctgttgttaaaaccaaaagtaaagttgcttatcaatcagttatttgttattgtcaacggcctgcatctatcttctatacttaactgagattcaatcaaagtcatacactttatggaccaatttttctaagcatcaatcaaacaatgcacaattgtggtgtgaccagacagagacagaccacaacagttggattggatggaataaaaggcacagagataagacccaacttttctcaaaatgctaatgactacttgtgaacatggctgagatgtttacctattgatggctgggtagtttaaaacaacatcgaacaacttctccagcgctgaaagtagaatggcctcgctaactgctggcttgggatgatccttgttagactccacaactaggacatcgggccttgcatcatttggtttcactccttttgccgctacgctgtgttttttcatgatagcagctgagaagcctgaagcccaaacctgtgttccaacaaaacatggcaaagtaactgcaaatgtgaaagaatgaaataataatgaagcacgtccatttgacacaacaatgcaacacaggtgcgcacaaagagacaattagccaacagttcaagaagcataaaatcatctcgaatgctcacgatgagttctttgaaccatgcaattaaatagcaaaccctacttttgttccaataaagttacgtgttctaatatacctgagaatcagggacagcaacaggcgctgagtccactacgcagcccttaattttgtccattgcagaaggatcctgcctctgtaaattctccagtatcaccccatagctgaagcaacagatataaaaaaaattaagcccgaaatctcagaatgaatgctaattgttaacgagaggaagagcataattaataccaaagccagccagtgttactgaaggtgtggaaaacaatcttcttcccatcctcctcgctaacccaatcagcgagatgttctgagagcatctctacattcttctcagccttccctccaacattgtagctaacaatgtcagacatggggagggtgaaggtcactgcatggtaacccctggaggtataccaatcggcatatctcttgaggtgcttctgcctcgagcccaaccacccgagcagaaccaccactgtctgagacttgccatgtgagtcaccgcagaccttagggtccggcagatgccagaggtacagaacatccggcgatgacgaggatggcatcgcagtcgtcactgcctcctcttccgagtagtatttggcaaactttgcatagtggtaaaccgtgtggatgacaggcaaagatgcaggaggcgccttagccgggtgcgaagtctgcagattgcgtggcaggaagtgcaggcgagacatggcagaagcagaaggtgctgctgatacatcgggcctgctggctggaatcgagacgacagcttcggcatccacggttgtgtcaggcaacttgtggtgagacagcctgtcaggcagctcaagggaggagacggcggcaaaggcggaactgccatggcagagagggggcggtggagcgaagccatcatggagaggagagaagttgttgtgaataatcagattgttgtttagtctccggcctcgtgttgccctaccctgtttcatagaggagaggaaaggaacaaccagagttagctgtcagtccgatccggtcataacacgcggtttgcaaaaattgaattgaataggattcggttggaaatactaataaaagcatatgcgtggcgtaggcaattgaccaagtatgataggcacattatttgtgtcccaattg

SEQ ID NO: 28859 - DNA, 13082 bp, Oryza sativa
ctctatgagtcgtctagtcaccaccgcttttttttattattttatttaaaggccaaaaacaaaagggccctcctcttcctcctgtttattccctggaatatccaccaagccccaaatcccgaatgctccatgactgctccctctatgcctctacacgttcaaactctatacggtcttcaaacatagtaatctttagttttatagcaacaatattatcatcgtataaaagtaaattcaaataataatattttgtatattttagaaaacacatcctacccctataaatatatctaaagactcatcgatatatcttaaggtagataaagtcatcatcaaatatctgattgtcgacgaatatatcgttaccattaaaagaataataattagttatctctatctctatctctactacttataaaaaataaaaaataaaagatgtttccaccgtccgtataaaataaaaagggcgacaaaaatttttgtcttaaaataaaaggaaaaaaaaagaatgtccgactcccctaataaaagaaagcgctggactcttaaaaaaaggacttctcgtacgtggaaaaaagatgtccaactcccctaataaaataacgcccgactcccaaaaaaaaaagacttctcgtccgttaaaaaaaagtccgtccaaaaaaaaggtccaccctaaattctataaatatccatatattttctcctctaattaattagaaaatctgttccttccacatcctttgctacatgatttcccttttcaatttgtctttaatttgccggccgtttaactattatcaatgatggccgaccgacgatattttttcttttttatcctattatttttttcttttttatcctattgcagattcgctttgattttggaaaaaaaatgaaaataggagatcaagtggatcaaaagacctcaataaatttttagaggttgggtatatttaatagggatgatcggctatgccatcatacatatacaagactgtatttggaagctaggagaggcatgtcaggtgaagggtcctcaactccgaatagttattatactactgaaaaaaacctttacccgtgcgttctttacccgttgcaatgcacgggcaagtttccatcatctataaaaaaaaaggaaaaaaagatccaaaagtgagaaaaatgccatttataagataatcggttcggaaaaatcacctgactcaacacgagcagaaaaaacaccggtccgaaaaaaatgtctgactcaacgtaagataaaaatagttttatataaaaacaaataaaaaaagtctgattccacatgagaaaaagcggatcgaaaaaaccgttcgactccacgtgagaaaaaaaagttgtttataaaaaaccgctctaaaaagaattatcgacccaacgcgaaaaaaagcttgcgcttataaataaaatctgattcggcactgtgcaatgcaaaaaaaaatgtcagattcaaggaaaagaaaacatccgattccatgaaaaataatcatatcgtatatattgttttatgtgcgtcttgatagctaatatatgttttgtctagagttgaccatacgagatattgtaggatttgattaatcctattattagttgcaagaatgagattaaaatagtatttcagattatatgtgtaaaaccactattaacaaccaaatttggcaatatcagcatcggaaatgaagattagatcgaggcgaaatcgaagtcggagatcgattcgggaacagagtaagagtcggctggagtccaaatcgactacgatcagaatcagctgagtccgagtcagactgggtaagccgatacagccgattctgacaatacgatttggtgtgcgacatcgggttgagttgatatgcttcaagatgattgccacgcatggatagagtcctaaggcaattgtatctattaattaggatattttatgtagtttccttagagatatgtttgggcaaaagtctgtcgcaaagacttatggtatcttatagtttgttagagataagagtcgtgtccggtatggacatagtttgtaattctcgggtataaatagaccccgaaccccatgtaatcaaacaacacacacgttcaatacaatctcggcgcatcgccacccttttgctttaggtttatttcgacgggttcttactttcgggttgagctgcatcggtttcgatcttcaacaagaggtaaaacttgttatgacggcttgcgttctcgggattagtgcttccatctttatgatactctaatattatttatgtaattcgtcgagttatcatatatctcatataatctctggcaatattgctatctaacctacaatcgactaacatctatcaatagagggcagccgattaggttaaatatcaatgttgacttagattatatacaatatctaccactctatgaaacttccaatggcttgattatctagatattgttcttcttttcatacttatagctacatcagttgtttgatcttatgagtcgtgattagaatctcaatctctagcctgcttcttggttgccgatgtaggatcgagatgtcgactagaggggggtgaataggcgatttaaaactaaatgacacctaatcaaaactaacctaagttgctaggcttggtgagggtgaactctaactaagcaactaagttatgttttgcaaatctagggtgatagtggctcaattatatctctaggaaagtaaatcacactcctatgtcaatgtttagcaatcctagggtgatatgatctcaagtatgtctctagaaatgtaaattgcacaaatgtaaatgcgacaatcaaatgagacaaggagacaagagatttttcaccgaggttcggaaactcgccggtttcctactccccgttgaggcgagccaaactccaccgctcaaccatgaagccaccgcacgcccccttcgtcaagggatgggcaaggcgggagtcggcccatggagaggactacccaagcctcgatcaatagggtagttcttccttcactccgaaggtggtgaactccaaaccactcacaaaccgacgccgggcctcctctacaatcttctcggagaggtcaccgggcaactcctccacaagccgtctaggaggcggcaacctccaagagtaacaagcaatgacccggcgtggagatgatcaatcaagtgccacactagctctacaaatggaagcaacgtacttgactcttggctaattaaccccctaacacactagatggatgaacacaaagctcaagtgggtgtgagagaggtgcaaggggtgtatgcaattgaattgggtgccaagagagcccccttgctgctggagggggagtatttatactcccaccaaccaaaactagccgttggggatgaaatcccctaactttgtgctctgccggtctaaccgaaggtatgtggccggtcagaccgtggtactctgcaacgactagaaaactagccgttgtaacactgtcagagggtcccatcggactggccgatcagaccggcgttgagtgggcggtcagaccggccttggctcggtcagaccgccatcagctcggtctgaccgaatacggctatgtatcggccatcccgagcagcaccatcccggcctctagggggccggtctgaccgctcatgtgccaccggtcagaccggccttatgcgccggtcagatcgccgtcttgcgaacggtcagaccagccagggcatgccggtcaaaccgccactatgtggccggtctgactgcccctagtcaggccgaaaccagtgaaatcccaagtgattgtgtgtgtgatgaaaagcgagcacaagtctaaatgcataatgacctaatgtggcaattaaaatcatctctttgctaggtcattacccctcttaatagtacggcgaaactaaaaagtaaactagcaaatttgatcaccctacacctcgatcaattctaaattaaagcactagttttactgtcttctttctctttgctttgcgccgtcaattttaatccatcaatagtcatccatgcgcacacatgacgtggacctaacttaaaatattatctccatagcaacggttagtccacaattagcgtttgtcattaattactaaaattaacaacggggacctagatgcttcagccgattagggtattatcggagtttcagccgatcttacctgatttagctatatttgttttatgtgctttattgacatgttaaatctgccctttacgttgagatcttgttgcatttaagtatattatacttttgtttggtatattctacttgctttaatatcttagtatagagtggtatcggagtactagccgatacatgctagatctatctgatcggctatgctatgaacatatatagtcccattattaatatatatttcgatctaagtgatttatactgtctcggcatggcgaccgatctatcccaatcacttgatttaagtatatatcgatataaggagtatatattgttaatatctacagccgatcgagtagatttagttctttcttatttattcatgactgccgatcgatacatatatgacatcggctcaaagataaatgatatgtcatcggcccttagccgatcagctatcatttataagtttaaccgcggtttctttgtctttatttctttttgattgcaggatcaaatcaactggcacgctagcatacccgaaggctagtttttgacctgcactggagttaagcagatctcccaggcctcgtgtttttcgtcaacaaccacaaataatcgaattcttttgggtaaaagaggcataaataatgttgccgcatcacgcatcatcgaggttgggctattacatggaagatgttccaatttttcttatgatatgtcttagttaagaacgatcgatacaaacattatcattgacatggttatacatgtgaaatgtgtattggcatttatttttttcacccgttgcaacgcaggggcaattttgctagtaaatacaaacacacaagtccaagcgagcagaggaagctatacgaagcatttgcatgcggactcctgttaatagcagctaaggaccgaatggaggaggaatggaatgataacatccttttatcttgtgccgtgcgtgcatcctaagctcacagtgcctactactcctttgcatttgcaagcctttcaacctcacccagcagtctagctgcatgccacgcgacagtcattccatgctgctaataagcatttgtactccacttgagacagtgagagcatatacattggtcagtgtcaacaatgcatcggattcggatgaccatgaatctgaagcaggtcagctttttctcttacaaaaacaggcctgtttgccataagccccaggaccctcccaggggttcagataaaaccgtttaatttatcaataccataaataaatacacaacaatcattttcttcatcaatggtatagtttatatctgtaattgcagtactaatttgcattgcagaccctaacaatgatttatcagctcttgtttatgttacattacaacaagtcaaataaataataaatctagtgctaacagatcacacgacttctcggttttcaatttcaccagtgcgatgaaaagactatgatgatatatctcatcaatggtcaggccagaacctaagctcctcaaacacatcaattgtgatatcgcccccaaagaaaagaattgcccacaatcttgcatccttcactcttcatcacctagtgctacattcctttcaacttcagctgcacatcactcagcccagtcctcatcgctatcatcgtccacgttgttatcctgtcatatgctgttaggattagctgggaggacggcacaacctcataacaacaagaagaagaataagaacaatggccataatgtaccaatctactacactctagctatcagaaaaacaatcacctgggaggaacttgagagcacttcaattttgtcatcttctacctgtgacagaaaaatgagagggcaaaggcaatcagcaaagtaaacaatgggaagggacattcaaattaaaatccctgatcattgttgctaagtaaagtacctgtgtttttctccttttctgacttctgccagctacatccatgtaaatacaatagtcagcttcatatgaagaatactaacatgtactgatgtactcagttaaagaaaagctgatagatcgttgcatgttgtgctaagagccactaaaatgcatttgtttttcccccatgcatcacagcttttacccagcaatatcaagtcttgtaaaattcaaatagcatatttagtatagagccgccgcaatagattttaattccatcatttattccgattcgacaggcttgagatggtcctaaagcttcatgaaatggattaacattttaaatgccccttacatagacaaaagctgaaagcttctcaagtaagcctcccaaaacctttggattattttagaacaagtcttctccattgaggaaggccttcagaggcttaaaacaaatgtaatcgcaccaaggtctattagatgcttcttaacaacagacttgctactgcacttaccactcttcttccctgttggatgtttttcctctggacttgctcgctgcttcttagcagcaggtcctgtagaacaatgccaatcacagatccaatcaaaaggaattttctttgtgtaataaaggaaaacacaagaagcctagaattgcgtaaatatgaagaaccttttgctgctggagatcctttcgggcttcttgtacatctctgaaatagaaatccttttgtcagatgctgaactaatttatttgtaccaggcatgaaaacagataatgttcaaaacacatatacggaaaaagaggtatgttgtgaagttggttcaattaatgcatcaagcaaacattatatcaaagttaagggtataactgtccgctatcataaggagagaaactattataataacaggtatgcatttccaccttttttttcttctgcttttttaaacatgctagacagagtggcctgaacgagtggctccttcttagctgagataggctgcgcagaccaatctgcaggtttaatgtcttcactttgggattcattcttaactgctggactcttcatctgcttcaaacgaagaaagcaaataaacacaataaaattatttacaaaagataaaagcttgattgacattgattcatatatctgaatcttataaaattaaattcggtatcactaccttctcatccatgtcctcagggacatcaatctcatcgtcattatcagatgaatcgtctccagatgatatctcagtatacctgcataaagagcgagggatctatcaagtatacctttttattctttgccttttttcgggtgggtgggagatgaacatatttgtttttagaaacattagccgttaagccaaataaatgcaggaagtaggcaatctttcagctgctaagcaacaactagagcccgtgtgcttttctgtttatccgagagagcaacagaaaagggtgaaactgacttacttcaaggctttcccagcagttctagcagactgcctaactgaaggtgcttgactagtgctttgtgtgttatcctcgtccttaaggtctgaatcctcggaagaatcaatgtcagattcaatcttaggggaaagggatcctgtggtggtttcctttggcggtttattgatggaaacagcttcatcacaggaagcacctgctccacctttaaaatcagaatctgcaaccgcctcatcctaccagtctgaaatgaagaagcacatgagatgagaggcacagtagcgtcgtagaagaagcgaaaattaagaaaaaggaagtaacatatatggatggaaagcacacgcacattctggaactcttttggaaaatccagtttcagttcttgtgggttttcttcttcttttgttccaatccaccaggcttcagaaaaaacaatctgccaaataaaacagcagcataagtaagtagttagcaataacagcccagagaaaagggacgagcatagcagcaattgtgcggatgcaagttccagttccaagatagatagagggcagggcaggcagagtaaagatgtgaagtttgaagtaaccaggctctcgaagacgtcatctgcagtgtcagatacttgttcttggggtacacatgcgtccccaacagcttcatcctcccctgaaacattcattacccacaataaaacatgcatatcatatcatctcacctacctgacctgacggaatagatagatagatataggatacctgtgggaagtcgaggtagagcagaggatttttggtgccaagatcagcgagctcgccgacgcggccgcccgaggcagcagccgcgggcgcgaggaggccggggaaggagaagaggaagcggctcttgcgctgcccgccgcggcgcacgatgtcgcggccctgcagccgcgacacggcagtggagggcgcgagagccgagcgcggcgccgccggctccccgcgctggagtaagccattagagaaggcgagggagcggaggcggcgccgctcgtcggcctccgcatcgccggccggcttcttcttcaccatccctccctgctcctcctttgcccctcgccttgcctgcgctactttacgcctcccttctggtaaagcgggtttatccacctctgtcactcttctccatttaaaatgttcattggttttattctacattaaatgaattatttacttcttcgtagaatagttgttaatgccaaaatttggtacacccgaagtcatcatcggtttagagtcaatatcggcttcagaatcttggaatcggccgatgggagtcgtcaaatcgtcagcagttgtgttcttggtggagtcggatcaattaaagaaaatttatccagaagagtccgagttcaaggaggatgcggtatggcaagttatttattaattatgaatagtttgttagtttccttttttatctttaggaaagtttctttcttgtcctacaaggactagtatttacccatgggtataaatatgtacacccggggttattataatctatcaatctctcgatcaatacaactattctcggcgcattgccaccctctttaccgaggtttttacttgtcatccggcggaacttggcacctgatgtggggctgcatcggctttcgatctctggtgaaggggtaagtcctacgtttcgccgaccctagtgaatctgttgtctacattggtgttgttcaaggctgcatcgctttgatctcttggatcgctctggtttggttgatatatttacctacctgatatctcaattctatctctaattgcattgtgtttacagacgtatcggtttaattgggactgtctcgattaggtctgatcttctgtcttagccgaaatatctctacaatcacaatgttgttataaatagatttgttatatccatcacattagacagatctatcggctcatcgagtattagattatcatatacaatctcgtgttgcatcggttaggttcgacctactagattattgttgataatataagtcttgttaagccgataggttcatgctagtgtcttatcggggtgctagccgataagttatctggacgttgcatcggcttataagaattgcatatatctataagttggatttagccgatgacaacaaaaggtttcactgatttatctaatcttgtggattttatgacatgggacctcctgccgatgaatgctttaaccgtcggatcagtatttatcctgtcatattattattagccgattggtttctactggattatattgttatatattttatcacatcatcatcagccgattgcctttatatcattatttacatcgagtgtcagactctacattggacatatagccgataactcaaaaccctatcgctatcggctggcatcagctatcggctggaactactacattggcttgtcagccgatcggctatttgatctactgtttatatatcttgtcagtagcaggatcaaactgactggcacgcccgcatctcatcaacctttggacctgcactagagctaagcagatctcccaggccagtgtatgtttttcacatcaacaatagtcttaggtggtgtttggatccagggacttaactttagtccatgtatttagacactaatttagagtattaaatatagactacttacaaaactaattacataaatgaaagctaattcacgagacaaattttttaagcctgactaatccataattagataatatttattgtagcatcacatagactaatcatggattaattaggctcaatagattcgtctcgtgaattagtctaagattatagatgggttttttattaatagtctacgtttaatatttataattagtgtccaaacatctgatatgataggggctaaaaagttttagtcctatataaacatggtctactattacacttttggaatgagggagtactatagtacagatgtgatatagtatcttatcttagaattatgagacaaactacaaatctagacaaacagattatgaatctgtagtctgtacagttatctattcggtccaaattcatagttataaaaatgtcacatctgtactatgtgcacttgtatttggacggaagacgtaatacggagtaatatagatttgcttttactagtaataaatactatgttcgctaacagtttgaacgttttaaatgaagtttaaaaatttccactttaatagtaatgattctactggctttcgattcagaaaatcattaagaattcacttacaattggctcaggacactatgcaatcagtattcagaaaacatagagactgtaatttagatagcccgcttttcatgaaaattaagctctatgtacttttttcatgaaattaattggctttggatagctgctgctgctagtagttattattcgtcattcttgttatttgtaagaattttctttggttgcagtgaaaattggtggtacaaactgaagtcattggaaaagagacgttagggtgggagggaagcatgtcaataattctgactcccctgatcctgataagatgcagatgatcatgatagaagtaaaaaccaacatcaggaatcctaattagcacgcacgcgctagcgagagaagttgcgcgcgttttccgaccacgtcacgacaactagggttagagttagggtttcagggtgggtcagggaaaggtggcgttggagagggggaagtgggggatcaggtttagagggcggtggagaaaagagctaacctgttaccggagggaggaggagaggactcgtcatagaaaggaggagcgggctcgccggagccagcgccggaggggagccgcccatcgttgccgctctgctccctcagcgacgggaagagataagggagagagagagagaaacccaaggaaagacaagagagagcactagaggtgacttgagataaaaacattacatataggtcatgtttggagaactagccaagagttattttgagagctattttttagcacaaggaaatagctctccaataaaatagctctaagttatttagatacaagggttattttgagagctatttggcttttaattttaatgtaccttcccaaggagagagagaaaatatactttttcagtgggccccactcgaaatagccccaattagcatcccttaggtgggatagttttttgggtgggttcttttcaaatagccctcaaatagctcacctttttgaatctttttgactatttgagctatttaagggagggctaaaaaatatccctgatcgaaacagggccatatagagtagcttttttatactccctccgtcccaaaataagtgtagttttagcaatgttcatgtctaacgtttgaccgttcgtcttatttgaaaaaaaaattatgattagtatttttattgttattacatgataaaacatgagtagtactttatgtgactatttttttaactttttcataagtttttcaaataagatgaacaattaaaacgctaaacacggatatttatggctccacttattttgggacggaggtagtattgcgtaggcagatgattactgtacgtagttagcaaaagagtggcattgtagtacgtgttgctcaaaaagtgacagtcgattagtaagttaaaacaaacaaaaatatactcattcccctccactcctgtaggagtacacacaggaccgatcaattggagtagcagtagtagaagaagagccaatgaactagtactagtagtagatgttgggaaaggcaggcagcctccctcaattaatctgaagactgacggcggcagccggagatggtggtggtggtgctgctgctgctgctcaacaaggaaaaggaggaggaggagacatggtcgttggtgtcgtcgtcttcttcctcggcgatggggtggaggcagaggtcggccgcgcggcggagtagctgtcgctgcctacggacgacgtcaagcgtctccggcggcggcacctcttgggcgaacaaggcggtgcctctcgcggtggcggccatgtaatcgatcgatcgatcaggactgactgtagcttaattaatttgtcaatctaattaatcttgaatgaattgaatgtggttgggggtgagtagaagacgacgaggacggacagcaacaacgaggcaacggggccaggaaggatccaggaaagcactactagtactgtagtagtgtacgtgtgggcagggctctgccgcgtaggagtaatactcctaggtaggagtagttgcctcgtccttgtcattttgttttgtgtccacgcaacgcacgcacgcaaatcgcaatcgcaatcgcaggtgcagctgcagctgccgcgcaacacaaacaaaacgtgttccttttcttttgcaaaaccaacaaacgtgtattgcgtgcgtacgcccctgcctgctaccacaccacaactttattttctccttcctgtaccagtaggactacatccatctggggatcctctagagtcgacctgcaggc

SEQ ID NO: 28860 - DNA, 4405 bp, Oryza sativa
ccagtaggactacattcatcttccactttaattccactcactatatcacaaattattttcaaatcatactatgtatgtccatttttatttaccactttttaacactttatatatactattaagaatatctccaacgacttcttcatccaacttgaaagggtctattcttaaaagtaaaaaaaattcaaaaaaattaaaaaaatatatcctccttaataggccaaatttggccaccccattttggttagccaaggatggaccgagcctcacagccaatacactcccccccatctaatacactccccccatctcccccatcggtctctctcccaaccccatctcagcaccggtgcactgctactggagggcgacgagacatggcgaggtggaacacggccaacaacaataacaacgacgcagaggaagcctgcagcaagccccgggttggcgcgagggcgaaggttgaaaaacatcgttcgtagggcctcaaactccctcctccctccctctacttcgagcaccgccgacgtccatacaggcgtgcggcctccagatcccatcatcatccaccacaggatagtggacgcatatgaggctacgacgacgaggacggagtgcttgcgccaggattccttccatccgccacaaggggggagagagaggggggtgaagaagaaggttggggaggttagagaggctgttcgagtgaaagaaaaacttgactatctaaatttttctcaaattgactaaatggatatttggagagaatattggagatgttctagggtagtgattcccagtttacccttagagcaactccgatccacgagagttgccatatgcatctccaagccaaaacttggttatattgggcaaaagtgctactccaagagattggtcaactggatggctctactagccaaatttggccacccatagccgctgccccaagtgtgggtcccacaccctttggctctctctcccatcgccctctgctcgctttgcttgcttggtctcccacctaccacatcaatccattgaaaacagtggcaacaacaatggtggcagtgccagcagcctcccatcaccgagatcctcctctatgcgatgcggtggtgatggcctccccatccacccagcacggaggcaccgaagaggcagcggcggcggcacctcccggcaacgacagatcggtcgacgtcccgctggactgtctctgccccatagccgtcgcaattgtgcgggagctcaagatcgtgtgttggaggtcatctcccatcatcccccctcccctcgcacctcaccttcctatacggtcgggtgtggtggcagcaggacaatcggctaacagtgacaagggtagggagaggatgacgatggaggggtagtgggcagccaatggtggggagatgaaagatatggagggatgaagaagtatatagagattgacatgtgaaccactggttgtttagcacgtgtaaattcctccctttttggcctagcggatggctgattgtaagagtacttatactgccaacattcaaaccccctaaatctttttaatctctaataggacttaaatgataaaactatatactcagctccgaaagatatctaaaacttttagaaaaacggttgtgctaaaagactggcgacaattttttgtttagaaaactttcgattttctaaccattagatgcacttcaggattcgcgcaacatatacggccatacgggcagaataaaaaaaatctcgtgtgggctagacaagcatcgaaccagctaggatctattcatcaaactcagcacacgttaccgctgctaggggtacttttttattattaatagtactttttagttacatactcacttacatcctatgtgcatactccctccgtctcataatataagttattttgactttttcttacactgtttgaccattcgtcttattaaaaaaatttggaattattatttattttatttgtgatttactttattatccaaagtactccattttaagcacaacttttcgttttttatatttgcacaaatttttttaataagagtggttaaatagtgcaagcaaaaaagtcaaaaatcccttatattataggacggagggagtagcacttacactctaattacagagtagttacataacacttacaccctacttacagagtagttacatagcacatacacatgtacactagttacatgatagttacagggtaattacatggtataaaattaggatttgtaatttttttcgggggcatatgcatattacttttgaattgaaagttatttttttcattctacatgtttggcaatttcttgacgttcaatcagtttgggcactaagactcgtggtttgtactagtgcggactgttttcctgttatcgttgataacaattcactaagaactcatggtttgtactagtgcaggctgttttcctgtaatcgatgatgacaattcctgtggttgaaaaatttgaaagttctggactaaaaaactgtcaacagcacactagctagtcccttagaaaaataggccacgttataaacttcaaaatgaaatggccacattaaaaaagaaaacttccaaacaaaattggtcttcttttcccataccctgtcggtcttgtttcccagtacgtagcttgcgcgaactcgctcagtgatgaagattaggagcgagattttaagagatggggatgggattatttttccttaaaaactggaaaacttgaattaggagtagtatatataggcaatcttttttgctacaatttcctttcttttatttgtttagttacgcgcaaattaaggttgtcgtgtttgaaaattaaaaaaaaatcaattggtagataaaaattcttctaccatgaatctttgttgcaaaatagaataactttaagctataaatacattcattcatattgatagcatatgtagcaggtacgttgatagccgaaaataaataaatgtgaagtttagagggcaggcatattagatatatgccctaacaaaatatataaatcctaaaaataaataagaagacgcacagctgctaatataaagaaaattaaggtggagtgggggcgaggatggggttggcgggcatgtcgtcgccggcgaggaagtgggcgaagagctgtctggcctgcacaggcgtgatcatgggaaccatgtggccggcgccgcggatggtgaccaaggtgaggccgtcgtagagcacggtgtagccgcccacctgatcgctcgtgaaccactgcttccacggcctcaccgtcttgagcttgagcttccgcagcgcgtacctcgtcgacgtcaccggcacgcggtcgtccgtgtcaccgctgaagacccagacgcggaggccggcgcggacgagggcggcgatgtccggcagcgtggagggcggcgcgtccgtccagttggtgagcgcgtcgctgcagggcgcccagctgtaggggatgccgcccgacacgttggcgtggagcgccgcctggacgtcgccgcggttcaggtagtcgatcacgcggtagtccacgcacgggttgtacgtgttgtaaggcaagccgcggcggaggcggagcaccttatcggcgaagcggctgcgggtgccattagtaatggtggttgtgccgttgagcgcggcggtgcaggacggagtgtagaggctgtagatgtcgatgtcgcccatggcggtgaagaagccgttccatgcggtgttgcacttgtccgtctcgttgccgtcgtcggggaaggtgcagttgcccttgatggcggcgtagatttcgtcggagatgacggcgtggtcccaagcgtactccacgagaccgcggtcgtcggagctggagtcgatggcggcgttgccgatcatgatgcccttgaggttgatgatgcgatcatcatcatcatgttccttcttcttcttgttaaaatggaggatcttggtggcgagctgggggacgtagtggccggcgtagctctcgccggcgatgtataggtcgtgccccttgaattgcgggaacctctccagccaattcaccaagaaggcgtgcgcgtcatgggctacgtacatatagctagtattaacttaaatcaatcattattctactccctccgtttcaaaatgtttgacaccgttgactttttagcatatgtttaaccgttcgtcttattcaaaagaaaaagtaaaatatttaaaactatatgtgtacatgaaagtatacttaacaatgaagcaaatgatatgaaaagaataaataattacttaaattttttgaataaaacgaatagtcaaacacgtactaaaaagttaacagtgtcaaacattttgaaatggagggattactatatttctagcactacgcaggccacaagcagataccgg

SEQ ID NO: 28861 - DNA, 1244 bp, Oryza sativa
ctgccgccctgccatgcctactgatcactgatcgatcgatcgatcgatcttaatttggtttgctttctatcttgctagtgctagctatatagatcgatccatatgcaagctgagtactgcaatatatataagctgatgaagctgaggtgagctggtaactcgatctatcgcgcgcgggacatcggggttctgttgaacatttttaggaacagattaacaaataaccaattaagctgtacgttatccatctatctatctatctaaaactaaccagctgcaactcctcgccgatatatgcgtacgtgctcgccctacgtctcaaacgtacgtacgattcatcactagtttcatcgctcgcccaatcttggctggctgctccggcctcgtcctgcaactgatgatatatcaaatcaggatttgatttcatcatatttatgaggagaatgcaattaacatcagctcacgtgattaattgtctctcctaatttgctgcctcatcaatccatttacctagctgcctacaagcggtcgagatccacgattatttaatttacttctcattcattggatagggatatagactatcatttcatttactcctctcgtaatttgttgcccgatcaatcgattaacctagctgttcctgtctctatacaagcgaaatcgacggacgatttgttatttactcgattggatatggattccatcgtttcatttttttaggagtagtttgttgctccaatgcatttaaacatacagatacagatgcacactttaaaacctaaacaaaaaagagaagaactgactgtctccctccagctaacagtacgctcaactgccgtcaaacacgcccaaaattagtccctggttacctgtgttggccatgcctttttttttaaacacacattttttttagagaagggtattttttacccggcctctacatccaaccgaatatatacggcaattgaaatagggaattagccccacaaataacccaatctaaaattcgctccataggagatttgaactcaggaccttggggtactactcaggtcactgtaaccactaggctacatgcacactcacctgaaagaataattagccataaatatgagtacccgtgttaaggactaagaataattaaccgtaaatatgaatacccgtgtcaaggatttgggtgggttggttccaccacaaggaagttaactagttgagctacgtttacttcgcggcaatgcaat

SEQ ID NO: 28862 - DNA, 2084 bp, Oryza sativa
aagggatatcaaattagagtagcacttgctgtgacatcacacaactgcatgcctcaattagaatgcatgggatatactccgtatataggtcctctgtctgtaaactctctgctctctttctcaaaactctatactaaattatataccagcacatcatctacataacagagtaaagaatacatgtatgtatattgatacaattatatatgagtttctatgccagaaccaccgcttgcttccatggcactgaaaagtattgagctctacattttgccacaggtaagatgaagaatgcagcgctggcgtcaagggtgcaactgccgtcaaaataaaaactctgaaaacaagccaagccacaacttccattttccaccggcttcttcttggcaaattcaagttggatcatcgcagacaaacctactacagccacaggcagctcaatccaaagcagctttggtcctcctaggtgctgtgggtttcggaaggccatcaagcaatggtcgcgtgaacgactcatggttgaaagtccatgccgagcttgaccacatagagatcccattctctgcatctgcaaagtttggtgtgctaggcgacttccgcactgatctaaatccgctcagaaatgaaccattgctcttcaggctggactctgggttgcttgtgtccatgttttgtcggatactagaaattggccttggcaacaaactcttggtcatcttaattgggtctgtaaaaacatcgtcctgggtatctgtggtgttagacacttgatcagcttcaactttttgccgccgacgaatggaaccatcttgctttgctttggctgtcccattgatcttggccccactggcaccgtttgttgctgaaaagccattcgacgtgtcttcagagttcctacttctgtcggtattatgtgtgtctggtaatctagatgaagtgaccaatgtttcactgttgatacgctccaaactgcccttactgtacaaggacatctcagtgccagcatctgtcatagccccattttgaggagttagaccataataggactgcaaggtgctcatggcgagtgacatttgctgcttagaagaattgtagttggatgagtctagcgaatccgtaacatctctgttttgctgattgtttggagcccacgctctgcacatagacagaaagctaagaatgagcctatcaacagttacttacaacagtggggaaaaaaagaagtgttgacagacgacaaattattaaggtaaacatttatacggtaagggtttcatctttagaatatcagcattgagattgaggtgaagtcccgttttgatttcttgcatcacaggatggattaaagagaggaaaaataaaggaaatgcgtacctcttcattttctgaccagaaccattgagccttacagaggatggcatgggtcttcctggtagaggtatgagcaacattttgtgtgcgaacatctggctgtcagtcatcaaactgtttgccctcttgatgtcagatatctgaaaaatgagaggacattgtttaactcactgataaaattgacaaatttggtgaacatgtacaactcaaatcaagcaagaaaagctaagtttggctaatatgaggcactgaaatatgcaaataaatgatatggtttagtaagtacatcaacccttgtgttgctttcgtaatccgaggctgatgttacttttatgcatgatgacttatgagtgaataagatttgcagagttgttgtgaaccacagttagtgatgctaaatggtagtggtacgtgaccctgtgatttataaattggccaagtcctaaaatacttctatttcttgtgagtctgtggaaagcacaacatttttgtaagacattacttcattaaatcatctatgtgtaaatagtttaggacggtgatatgatataagaaagagcatcagacagccggtaaaaccgaatagaaaagataaaaaaataattgaagctttgattttgtcacaggcaagttttctttcctatctactccatcaaagaagtagtggcaagatggcaagttttttagccggcggcagtaggtaaataattgct

SEQ ID NO: 28863 - DNA, 2012 bp, Oryza sativa
cgatttagcagctgcctgaaggctggaggtaggagaaggaggcggccggcttgcttggctttagcttggaatgagagagagagatggcttgctttggcttggctggccctcccctccctccccaagatcacaacacaattgcaagcaaagccagccagcctctccctccctttacctttgacaccacgaccacttgaaaaccaaaaaaaaaaaaagaatcgtgttttgcgtttttcttttttttaaaaaaaaaacataagagtagtacgcggttgatggggttggagccacgtggttgctgtgctcccatacagtaagtacttcatacatacagcgtccgtctgcttgtcttccctttctttctttcttcaaacaccatcgctcggctggaatggatgtacagcaggcaggcaggcagacaggtggccagccatcctgaacgagtcaactcacctactttagcaccaacctgaactatccttttacaatggcaaacacattaacatgtgtgacattttatatctcccatacttaatcttaaccgattattatgatgtacagttataactccctattatttcagtataacttatctaattagaatgtaattattactgattattcttgtttatttgtttaaaaaatattcttttacctgtttttatctacaatttcctgcagcaatacacgtggttagtactcctacatattaatccttctatatattttggtagataaaaactactctgtagctccagttccattaaattccctcaaagctatcttaaaaccaacccctattttgatatctaatattgaatttaccgtgtttttatattttcatttttgtccctttttttaaaaaaatgaagcaaatgtttaccccttttatttaacagaagatagtggatccagaattgttgtgctaaataagtgtatagacttttaaaatttgttgattgacctttgtacacctggtgattttaccatagccaaatctatgcctaaccacacacactactcgtcctttatttgaccaagtttaattactcctacatacagagaacaacactacgacgtgtgatgtgagtgagtcctgcatgctctttctttcgttgacactttctcctgactaataccggtcaatcaaacttggcttactactataccttggagtacgtatcatatggatggctacctaccaagcatcaccagatcaatcccctctatctccccccccccccccccccaaaaaaaaattaaaaggaaaagatgaagacctagcaaaagcttcggcattaatattaatccttaatcatgacttgtgagcatctgcagctccttccttcttgcagctctagcaagcaggcctgaaatgatgtactactcatatgtactcgtatagcaagagtaagcatgtaggcataaaacaaatgctgctccttggagtgcctattttcttcaaaaagtattgacaagcactagtacttaccttgctgtttgacaaagaatcttcacgcttttgaagctatataagagctggtgctttacatcacatggcacacacatgacaccactgcttttgcactgtcttttctgcattttccttctctccttcctttttcatggagagcaaattatgtcgagtgcatccctccaaaatgtttggtgggtatcattgcatataaccataagatttggaacagtatttctgttggctatacatattttgggttgccctgcaactttctctgctacagccgaaaacgacatgtttctttttccttagttaggtgcagacgcggttactaccgcaccatcatatatatgatgatgatctccttagttgtgctacagatcattggcaacgttggatccctgactaatgatcgatcagcaagaaaataaaacgcagtgcaccagttgttatattcagagcttgtgaccgtccaaagagctgaccagaaagctagtccagagcacgtgcaatcattcaaccttgtatatattct

SEQ ID NO: 28864 - DNA, 39546 bp, Oryza sativa
gtcatacattaaaatacggaggcagtagtatactcagatcagatgccaacggttgccttacacaaggggatagaattatatgtactctgctgccacttgtgcgttggttgcttgagagtaccatatgcatgatgcatcagagtatcagacatggctggtagcccaacaagtcatctttcaatctcccggccgttttctttttcttccttttgctatgttttgtttttatctcttatccattgcaaattgcagatagtgtttgattgggggaaagcaggaagataatgcgaccgcagacagcaacacattttggttttgcacatcttcttcagtaatgggtacaatgctttgacaaatacagcactaagcactacgggagatttcagatacaaaaatattagtattaaccacattgccgtgctgcagcacaagtacaagaaggttgacaaacagcgtccacaaccgagcaagagtgatacaggtaacacggcaagtgaagtgaagtgaagtctcccatctgtttagtactctgaatctcacaaaatttgtgatgcttccaacttcagtttcagaccatgcaaactccatgctcacattcacaagcaaaacaccctctaagctgtaatgtcatatatcttcttttcatagagttaatacagacagaaatatgctgaagaaacactagtgaattttcattgaattccaaagttgaaaacacttttggtataacatttgcaaaacaagtatctgtatttttctgacaaaaaaaggctgaaatttcctattgtaacatctccaaacacagcagcaggatagtttcctggcgggaaaagagggggaagaaaaaaaagagataacaagagagagcagtagaggtcacttcctctgtgtccttgtgatccaatccaaaacgtggcaacaatcatcatccccacggaacaccctgttctcagaacggtaggtcttgagatcacggctctcgtgcctgcaactctccctcttcatttccagtgaatcaggaaccagccttgcagcacggtcatggtaagcatcacagataaactgcgcaatggcgtcgaaaggctgcgaggcatcaacccactggtaaatcttctcgttgcggaaccatgtcatctgcctctttgagaagttcctggaggcagtctgaaacttggtcaggaactccaagaactcttgtggggagctgctgcctccgttgtgcctacactgaagcaagtactccatggcttgcctgtagccgattgcgcaggtagccgagttcatgccaggactcaagccgatgtcgaggagccaggaggcttcagagagtaggccacctgtgtcggccagcatctcttcgcacctcagatcgattgatctgtagagctcaacgcgtgggcacgcgaggaagatgcagaggaagtcgtagtccagctccagctccgtgggttgatcggcttggttggtgagactgagacgacggtggtgattgagattgtaagcattgtagggcaaggagaaggcagagggaggtgagcctgaagacctgatgatctcaaggcttctccttaaccttgaccagttgttgactgacaggtcccgagctttggggtcgccggcgttggcaaccaggtcgacggcttcttcccagcggccggtgtcccggaagcgggagagctcggaccagacggcggaggtgacgtccatggaagactgcgggacactgggcttgccatagatgtaccagcggaggtagaggccagtccctccggcgacaatggggacgcgggctcgggcgaggaggtggtcggttgctgcgcgggcgtcgtggaagaagtccccggcggagtagtcgtcggaggcgtggaggatgtcgatgaggtggtgcggcacggcggccctgtcggaagaggagggcttggcggagccgacgtcgaggccccggtagacctggacggagtcggcgctgatgatctccccggagagcctcttggcgaggtccaaggcgagcctggtcttgccggcgccggtggggcctgagatgacgatgaccttgttcttggtggcggcggcggcagccggggaccaacttctcttccacacggcggggcgcctgcatccatactgcataccgcactgggagatctgatggcgcgcggaggaggaaggaggaggagctttctggttctgggcggccggccggcgggcggcggcttcgtgtggaagggaagggaagaggatagaggaggagatggatgggatttctgaaagagagcctgtgcagatgtagaggcccaaaacaaacaaacaagtattgggctttcaggcccaaattggacattctattttggaataagttcaccgaaggtccctcaacttaacagcgagcttttttaagatcatttaaccacaaaaccagaaatctctgctcctaaactatacaaaactgtgtaaaaaaggtcccttgatctctggttttgctgacgtgtcagcaaaaaataaaaaaaaattatgggacccacatataagtgagaagaaaaaatgtgggacccacacttctttttgcttttcttttctcttttctttctcctattcgagtatcttctctactctttctccgaggctgccggcggcatagggagcctaagagagagggggcagcggccgctggcgagcgcggcagtgggcggctggaaagggggggagaggcggccggtgagcctgggagggaggagagggggcggttggagtcgatgccatggtggagcggctcgtggggctcctcccatcggagctacggggagaggcggaggatggaggggttgggggcgcactccgggaggaacgatgccgtcccagtgggatcccaccacgcccgcgcgcccggccatgttcgactgcccgcccaggatgaacaccaccttgttcgacggagggagctcaccgccggacacagccgccgtcggaagcagcagcatcatcatccgccgcattgttgcttgctaccgttgggcgttgggactaataatcaagcaaatttgaaatctactcttcctccctactcgtagtcaatttatactgcaactagcggcatgtctgtttgagtttgtttgacccaaccaaaccaaccaaccaacgaaagaaatactccactaaaacgaaacaacatccacccatgtcgatcgtgcgctgctacccccttcgtctccgcctaccgtaggttcctcctcaccggcgtccacatcgccctcgacgccgccctctgctcctcccgcacccggagccgccgcttgaaaccgcctgccgccgccgatgctcctcccgagcccggagcctccgcttcgcagccgcactcgcccgccgcgccccctgcgtcccaagctcctctccacctcccgagcccagagtcgctgctcgcccgccgccgcgctcgcccgccgtttgccaccgccgccgctccacagcctcgctcaccgtcgaagcagcacgagaggcacctagcgcggcgacctcgcctccctccgagcggcagcggcgaccttgtcttcctccgcgctcgcccgtcgccgcctgcctgctccgtccgccgctgcccggcccgccatcctctcaggctcgggggaagaatagagagcaaagagaagagaagaaaaaaaagaaaaagaaaataggagaagagaggacgctgacgtgtggtcccaccacatgccacgtcagccaaaccggggaaaaattagatcaatactgactagggactttttttttcacggttttatattgtttaggggtgaagatttctgattttatggataagggactttaaaaaatatcgctattaagttgagggacctccgatgaacttattccttctattttgcttcttttccacctgcaatttcttcccttattttctcaacgcttttatttatgttgaattccataattttcaatattaataagagcaagacaaaaacatgtgtaacgctccgcttttcgtgagtcgttaaaaactaactcggtaaaatcctaattgcgaaaattttcgttctttgtgtgagagtctaagttgtgccaaggatctcaatttaatcccgttgttccctctcatcgaaatcaaaatcctccccctcatccaaattcctcttccgattcgagtctctgaaatcaaaattctgaaattcaaatccttcctttgaatcctcgccaaatacttctacgaatccagaattattcaaatcccgcctcgaatcctttccttgactccaccctatgttcccgagaacaaatacccaagtattccttttgaatcttttccatgactcctccttgagttttccttgatacatccctaaaccctcgagttcgaatatcaaattgaattcgaatccaaaccctaaatctctccaattctatccaaatcagttttctctgtaaaagtctactttacctccctgtatttttggatggaccgattttcctcccccggcccatctcccctccccagcccatctctctcctttgccatctccctcacgtgcgctgcacgagccgtcgccgagagaaggatctctctctctctcgttttctcgctccctctctgtttctctctcgcgccgacaccgcttcccgccgtcgccgcccaaaacctccaccgccttcgcccattcccgcgtgcgcctcgcgaggtggccgaccggccggtcgccgccgacgccatgcgctgccgccttgcccccgctccatgccaaaccgaccgccgccgtcatcgtcgacgtcatccatggccccccgccactccacgccgcacccgtccaagagtgggagaagcagctgccctccctctcctcctcctcctcactctccctctcctcattatggcaagggaccaagcccctttttccccttctttttccctttcccgaccactgccggtgtcactgcctctgcgccgcttgaccgaccacgccaactcgctctccttgaccgcgccagcccgcactcccgcggttcgatttccgccgctcgatccaccgccttcgctgcccaacgcatccacgccgtcgccgctttcgcactgcccacgaaaccgccgctgccgcccgtgaacaccagccgagctcccttgaccgccaatgtcggtttccctcctccaaaccgacctctcctcctcgcctataaagcccgcgccctcccctctcgtttcgtctccgcctcgctcgaaacacccacgcctttgttgccggccgccagctgctcgcccccgccccgctgtcgcgaccacctcgccacgactccctccgcgtcgccaacgttgctcctctctcgccggtgagctcctcgcccaaattcttgccatttgcatcatcttggataagccccgagccgttcggttgctcgctcgtccccctaaacgtgtcgccccgccgttgctctgcttcgccgccgccgcgcccgactgtgcaccgccatgggccccctcgccaatccctcgcgccaccaccgtccttgagctccctaggacctccccaaaccattccctagcgccgtcgccgcccggcacggcctcgccgccattgccgcccgctcccgaagaccgtctctcgtcgccagcgaatctcggtgccgctccgtccaatccgacgccggaaacggattccttgaaccccggagatgctcccacccctttgaatcgaaccctcgtcgtctcgtcgtgttttccccttttgctctccggtgattgccgccgccgcaatccaccgtcgttggctcctctcgcgtcgattcctctcgccgccacgctcccggggatccccatgacctccccctggctgcccaaaggccgtcggccttctcctttgtctccgcgccgtgtcgccgcttccgccgccgcctaacgccgccgcgcgtgcgtcgccggtgaccatcgggtcccgcgtccccgcgtgcgcatcgcggtcgcgtaccgtttcggctaggcccgagtccgcgcccccttgtcccttccctcgcgcgaccacatccccgatccgacgagcttggtcgccgccgccagccaccgtcgtacctcccctctcaaatccgtgccgttaaacggattccccctaacctcctctagctgccggcggtagccgctcgctccggttcgccgccgctcgctggaacgcctcgtgcgtcgtcggccgtccgatcccgggcgcctccttctcctcctcctcccctttcgcccctgcccgcgtggccgaccacgtggcagccacctcagccccgggcccgcttgactgggtcaagtcacgcccagtcagcctcctccctccgtcttccctcccgtgcgcgcggtccacagcaagccgtgcggctgcacgtgggctcgccgccatccgtccacccggcgcgccgcgcccgaaccgcgcgcacccgaaaccctagcgcctgcccccgcgtgcgccctccccaccgtgaacccaaccaccgccatgtgggtcccgcgcggtggaccgcgcccaccccgtcgggcctccctctctccccgcgcgccctaatgggccgcctccccgtggccgcgctcggcccaatgggtggccaagccttgtgaatccctcgggccgcgcctaagtcgcccgaggaagtctaaatccgatccctccttccttttcttttccaagggaattaataattccttttccttgtccagaaaatccatttagacctccaaaattcatatccctcgatccgtagctccgatcgcctccgttccacttccagtaattccgtaaaattgagacctatttaatggcactactaataggtctaaataggatctttcttttggtcttttgtttaggtttttgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcgtgccaaatcgacggacctacccagtagtcgcactaatttccgtaggtcgtactaccctgattccttgtcgctccacccttgtggtacctcggtattcgtgctctctgagcgcgtataccaaatatcccacatacaccgttgtttgttgaaaacttgggaaatgggtttgtgaagccttcaaaacccgacatgtggtgtcggtgtgtttgaaaataaaatgaattatgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggagttgatttgtgaatgcctaaaatgtcctatacttacgtgaggatttgatccttctatgtggcatgaggtaaccctgggtcggcttgggaaaggctttgtcgcgaacctctgacaccggccagtgtctggagtaagttcgtgtcttgtgggtaaagtgtacccctctgtagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggtagctggactctgggagtccgagaaaatgaaaaaggctctgggagccgattaatcaagtggaatggctctgggagccgagaagtaatgatctgacccgggaggtcggtacattgccaaatgagctattgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatatatatatagttcctccgccctgaagagaagataaagtgaagtgaagattagggtttcgtcctggttcccagccgtcgcctgtggtgttgggtattagaccgttggttccgctgctgctgttgttggtgttcgcctcgtctgtgtcgtcggttgtattctcgggctgtctgagctgcaacctaagttaaggtaaataagtcatctatttattttaaagattgctatgatttatatctgtcaccgtgggtaccagcactatgtcctgggactggtaccgagatcgcggtttcgtaggaagcggttcgcgccgttttccctacgacatgctcctgtcaggtgccgttgtacggcggtatcagattggggtgtgataacatgtttatgttttgttctagtataacactgagcttgtcgagaaatgcaaatatctgagagaggaaagggagttcagaaatgctgcaaacagtctaacagcctcatcatcgttgcgctcatgcttataagccaaaatgtgttttttttaaaaaaaataattttaaacttgatcttgtgaatttttatcgcagttttatttatacaacatttgctttctaatcgccaaagtcatttacataaaaattttagccatcagtatttttttcgttgctaataagtggtaggaataggcataagcataagcaaaaacaatatgaccaagaaagaggaaaaaaggtgtttagaaatgctagaaaaatttgataatatttgaaagagaaaaaaagagatgaaggaatgtcaaaataattgaggaagaggaaaaaaggagtttagatttgctgccaaaagttgaaaaatatttgaaagagagttcacaaaaccagaaatggtgcacaaaaaggtgtttgggaatgctagaaaaaattgagaatatttgaaagagaaaaaaagagatgaaggaatgtgaaaataattgaagaggaggaaaaaaggagttcagaaatgcgatgaaggaatgtgaaaataattaaagaagaggaaaaaaggagttctgaaatgctgccaaaagttgaaaatatttgaaagagagttcataaaaacagaaatggtgcaaaaaaattaagtgaaaattaagatacaatagaaatggtgcaaaaaaaataattaagaaatggtgcaaaaaaagtgaattaagtgaaaattaagaaacggtgcaaaaaaaagtgcaaaaaaaattaagtgaaaattaagataaaatagaaattgtgcaaaaaaaaagaaatggtgcaaaaaaaattaagtggaaattaagataaaatagaaatggtgcaaaaaaaaaagtgaaaattaagtgtagatgcggggtatcgatccccgtacctctcacatgctaagcgagcgctctaccatctgagccacatccccatttgatagagagcttttcacttcctagtaacaaaacaaacaattgagacgagcgaccctgacaagagagagaagcaaagataagaggccgaaacctgcagccacaagcaagcagcacggcctcccgcttccacgtctcatctgccatggccaccaccgcctccctccacctccacctccacctcctcctctcctcctcccgccgccgctgccgcctcctcgtcccccgtgcccacaccgattccatctccaccggccgacgccgcttcattgccgacaccgccaccgcctccgctgccgctgccgtgggtcccctcgtcctaccccggaccccgcttgcgcgtgccgaccagccgccgtcgctctccgagtgggagcgcgtcctcctccccatcgaccccggcgtcgtcctcctcgacatcgccttcgtccccgacgacccttcccacggtaccctacgctacttccttctatctatctatctatgactatatatgccacttacctttgccaatgctatgcttatacatttacatgctatgccagcaatattgcagtgcatacaactttaatttctaccacctccgtcccaaattagtggtcgctttaacttttttcctgtaacgtttgaccatttgtttcatttgaaacattagtgtaaatataaaaaaaatgataagtcacacttaaagtacttttgataataaaacaaatcataaacaaaataaataataattccataattttttgaataagacggatgattaaacattacaaacaaaaactcaaagtgacaagtattgtgggacggaggtagtacttatcactcactgctttgtctttgtctttgtctttgtcttcgtgtctgcactttttttactcacccaatctttacaactcttgttatttttcctactgaatgtagctcaactgtttaagaaacactgacctttgtaaattttcaacggggatcaaaatgttacgtatattgctatttgattgatggatacacattcgaaaagcatctgtctcttgtggagatgtgctgttattaacgtgtactaccattttataagaaggaaaacgcctcattaatttggaacacagtatattgtcttctctagtttcaactcatcaaaagctttcttcatggatatgcatgcatatgttaccaaaaccaaaaaaaaaaagatgagtgatacaatgttccttatctttctaggttttcttcttgggacgagacagacgatattggaaacaaaaaatggaggaaacacatggttccctcgctccatcccgtccgccgaggatgaagatttcaactacaggttcaattctgtaagcttcatgggcaaagaaggatggattattggcaagcctgcaattttgttgcacacttctgatgctggagacagctgggaaagaatacccttgagtgcccagcttcctgggaacatggtaagtttgcatatacatccgtgttgtctgcgctttaacaaggatgaatcatgaacggaaacctaaaattggtagttgctgtgatatgacaggtttacataaaagctacaggtgagcaaagtgcagagatggtcaccgacgagggagcaatttatgttacttccaatcgagggtacaactggaaggccgctgtgcaagagactgtctcagccactcttaacaggtaggaaaaaattagaacgaatttgtgaaatggattttttttttagataatggaatgagaagtagagttctttcttagatgtatttacataatttgaagtgctacatttttttgaagtagctacctaatcgtctttacaaaatcattgcaccggatgtccatttaagccacgacaaattgggcatgtcatgtcatataacatctgatgggctgaaatgctaccacctccaaacttatttgaaaaataatataatactacatttcttcttagcttttctttactcttctcaggccatcatgcatgactaggtggtctatacataatatttgctccaatattttgcctttttgtttctggtgcagaacagtttcaagtggaattagcggagcgagttactacactggtactttcaacacagtgaaccggtcacctgatgggcgttatgttgctgtctccagccgtgggaacttctatctgacctgggaacctgggcaggttcggtagctcgagagtagctaacttcacattgttttggttatattgtctgcggtcacctggaaggtgtattttgaattttatgtaaatctgtttttgcagccattttggcagccacacaacagggcagtggcacgtagaatacagaatatgggatggagagcagatggtggcctttggcttctagtgcgcggtggtggactctttctgagtaaaggaagtggagtgaggactcttttcagctcaagttcactctaacttatttgtactagtttagttccaattcttctatcgaggccttaatgacgctcatgctatatcttatcttcatccaccaaaccagataactgaagactttgaggaagcgtcagtgcaaagccgggggtttggaattcttgatgttggctaccgctcaaaggtaagtgaaatggacttgccaaccacaaaattagcatgtgtgtgggcaaaatagattaaaaagctctgcattccatttgcaggatgaagcatgggccgccggtggaagtggtgtcctgctaaaaacaacaaatggcgggaagacctgggtgcgcgacaaagctgctgataacatcgcagccaatctctactctgtaaagtaagcagatatgggatatgcattctgaagatttaatttagctcattgctctgaaagtttatgtgggggtatacaaatgacattgagtgaatggctgatcgggcgatatcttgcgtatatgcaggttccttggtgacaacaaaggatacgtgcttgggaacgacggcgtcttgcttcgatatgttggctgacgtgcaaagtgcttcagtttgcctgtatcgtccttagacttttttgtacgtaatatgaacctacacttgtttacacggtcaggtatctatctatgtacctactgcaaaaggctgctgattcgtgttgaattcatccacaaaagagtgtaaattcttgtctgtaactgtagcgactgttccaatatgtgaactgcacatccacatgtaatatctgatatatataaaatggagcttgtaaagtgagaaggattcagatattgcggcctttgcaactcatgggagtgcccaaatgccacttctgttggaacagtacagtgatatatagagttgaattgcttgaaaaatgatttctaaaatttgcctcctttggatggtatcaaaatttaggtatgaacattgaactttcaaatccgatttattttacagtaaaaaaaggtaagaatattgcagaaaccgcataatctcatgatgccactcttgttgaattccggcattgaagacagtttgatatgaaacactagtttagtagtatccagaatgcatgctgaaaaagctttcttttacttaatcgatcacagcttcaaatagaatacacctcgtgtgagtgtatcaatggacgggatttcaggggaaagaaggaatttttgtgacaagtaactgaggatcacatcacgatcggcaaccttatcttgtctcgaaactgaaaagagagaggatttgcaactgatgatgcctgattggtactcctagccctaggaagaaaaaaagtggctttttttgaaggaaaaaaaataaaaaataaggattttttttccgttgcgggacgggagtgaaggcacaccaaccgcctcaccactcggataaacacacacacacacacacacacacacactccctctctctttctgtacagtgtcattccttccccttccgccgcttcgaattcgatcctcgtcgccggccgccgccgctaccccattccgagtaagcgaacgtgaaaacccttcaacatgcgcttgtgcgtgggatctgtgtatttttagcgccggccttatgcggccctccactttttgtgccatcccttttccaacaatttaaccttccttccgctccgccgtttctgggattttttttcccgctctagctagattcttcttcttcttcttcttcttcttcttcttcttcttcttcttcttctgtataatctgttcctcctccgcgcagcttcaacctttgtttgattctgcatgcaatctgatgaatccccgaggtctatgtctatctcgatcccctcccgcctccctttgttttcctttgtgtcattttcattcatcatcatcaacagataaacagtaatctctcctccagctccacgagtacccttttttatttcttcacccatcgattcggctcgtattactgtccgattagcgatttcactatgttgtgtgatcgattcaaaggcgatcaactgctcgaccaagtccggattacccagatttgttcatgttcctgccgatcatatatatatatatatatatatatgatattattactgagtggtcatgttgatcctcaagacaagcttttggtctttgatacctagtataattgcttttaatgggcttttgttgtttgcacctccctaggttttgtgctctatcgattatgcttgtaccttttgctgactagtcagctcatacgtgtacaactcacgctgctccaaactatatctgtttctgctaatttagcggagctagttgatggcttgtatcccctttcttttctcaacgccattctcgtggtgaactgaaggcagttcgtgttggttggttggtgggtttcgtattgaacatgctcatgttaattgtcaatgcaggctctccatctcatgccgtatgcacttgaagtgactgacagaaggccacagagcgtaccacacactcggtgtagcacattggtcgatcataacacaaacatcagcttttcaaaggttaatttatgcctggttgtatataagccttgtcttattcactaggtagattaccggtctcatctattcattcatggaaatttgctgacttggtattctttctttcattcatcagggccacctaatacacaagcctgagaacaggtaaacatccaaacaacatccattggatttgagtatgcttgatctgatctagtgtaaacttaagaggaacatatccgatactacaaacttgaacgggaatatctttaacggtttttgaacatatagataattcgggagaagaaataattattcccatttatccaaaaacatcaccttgctctagaacactgaagttaaggaaatatgtgtcgcttactgagcttcctcccacctgtatatgataagttatcaacagaaatatttcttcatcttattatatgattttgctcttctgctactttattaatgttgtatggctacctcaagtcctcaacctgtatgtaccaccatgttttttttccttattattattctgtctgaatgtctatttatgataccagcaatcaccgtactcaaatactttgtacctcaatatccttgtttttttttctcatttccctttgactggtatccatttctattctgatatctgtcattcatatatctggaaagctacatgtttactgtctgtttgtgctgttgcaggaacattacatttgcaactatttccattgggcacaactcggatcagaaattggtgccttttcttcctaacatattacaagatatcaacaagagaagctgtttcgcatcaggagctgctggcacagagatcattcagttcccacagccaataatactttactggttagactgtccaaatgaaaagaacatgcacgatcaagtcgatcattctaaaccattttccagtggaagtccaccaccaggaagcaccttaagacagcgtcagcataggagaaaaatcaaaaagtcattgacagcactccctcccagcaatgtgcttgtaaataattcttccagatctgttactgctcctgtaagatctgattctgatattctgcatgatgatgataagcctccaagaaagagccctaaaaagaaaggaaacaagaaagggaaacattacaggagagcagtctgcaaagggctcaatttgccatcagaaacccattgtgaagagaatattgatgctgcttctcctgttgaggtacttactgatctgctggctgataaattgtcagaaacctcatcctctgctagctcattggttaaggaagctcattttggtgaagagaatggcggggattctggatgtacaggttcatctaatagaactgtaggtgagatatttagctgcaaggatgttcattacttgaatgatgaatcaaacaattacgagagatcactatgtgcacgtgtttctaactctaatgatgcaatagcatattcattgtttaagaagttggaaagggacaacagtgtgaactgcagtgtcaatgatgaggtgagggattcatgccatccgataggggcccatttaagcataactcatgctgaagattcaaatgattcctttggatgcagctcatgctgctcaaagaatgttgctgatagcagtaatcatactgaaagagtcaagtgcagtagtgaagcctgcagcagcaagacttctcttccagttattcctgggaggagcagacaagattaaaggaaatatctagctacagtttgactgcaactaatggagtaataggcactaataagacaagcatagtggaaaatacagttcaacttctgtgtggcaaaaagtagaaaaacttaatgtggagaacacatctagagcaggatgtatggttgattcagctattcagaacaaggatgtactggaaaacattaacaaggttgcacaacataatctaacaaggtcaatgaaaataaatcagaggagaaaagcatgtaatcagcattcaccagacgagagaattgaaatggagcatgccaaagaaaatgatgcactaaactcatgtcaagcattttccagatataagtacaagaagcaaacatcaatactgtaccaacaaacaagtttatcttctgaccagggtacttctcagtcatcagggaactaccatgctcctaagaacggtattgtcatggtgccaaagaatcacttgcaacagaaagatggattgcctatgatgcaactagtatatgacaaggactccagtgttgatactggagtaggtagcaacggctcagctgatggagatgggagctcacaatctggttttgagaaagcagcgctagcatcttgcaacatgggttcttatttggtcccacaagacacatgcgaggaatgtacatcaaccatgcaagcggatcctcattattcctcaaccgaaaataaggccatatccccaaattcgaattccaggaacctatgtgctgatccttcccctgcagaaatggacgaaagttgttatgtgaagttgacaatggagaatactcctcaagaatgccctaagttgtattctgctactggaaaacaatgtaagttgtactctgctgctgcacacgtttcacagaaatgggttgctgttgggaagaaaaatatactccacttcgatggttcagagacttctgctgttgattcctcagttctaactaattgtattcctatttctgctaatattggtgttgaaaccaatgtttctagtgttcttgcatcagctaacaatgaagtcaacaaattagctgctgagatatctgataaaccaaactcgtctggacatcttgatttgagatgtcaaccgcatactgatactggtactgatttcaacaagatgagagaagctgtttgtgatgcttacagggcccaacagagagtggaagacgtccaagttatcattggcaggcctcttgctgattttgaacaatttatttcctctgcttctccggttctgtactgtagcacttgccctgctgatagaaacttttgctcaccggaatgggtaagagatggcctgtgctttcatcagagtactgatatcactctaagtagaatttggcagtggtatgaagaaccttgctgctatggtctggaagtaaaggctcaagatttccgtaggtctaaaggcttgtggaatagtcctcatcagttcaccacctactttgtgccatatctatctgcggttcaattatttgggcaagctaagagagctagcactggaagagttgataaggaagcagctggtatggatgtcacatctaaaacatctccatgtccgagctctctcccaatcttaacgaaacttctgccacagcaattgcgtgaaacaattagctcatctgatttgtatactaaaggtgatcagcagtttggaaatggagagctcatatttgaattttttgaatctgaacaaccattttggcgacgacagttgtttgacaagtaagtacataatcaagacctctgagaatctgggctttcgttctatcatatgttgtcagactgtactagaaacgaatcagaacaaatggttgataaaaatttgctctgtaaaaattgaaacgcttcaatgtttgtgagtaataatgagggcattgtacatctgcaggtaccaaatgttgtgcatatagttcgagtatgcatgatgtcttacgctgatatcattttattattcttgcactcttccctaagagtcactattgattttgaacatttcattactgcacacttagactcttgttaggatatttacttgtaagatgttcttattgaagtatattaaatgtgaatagggtaaaggagctgattagtggtgtgaagccatcaagctgccaaatatcaggagacccaaagaatttggagctcagcctgtgtgatctccatcctgcctcctggtgcgttgtatgctcaagtattactttcccgttgccgtctatcaaccttttttggatgtagacgcacagaaaaactaattgtgatcgcttgcttaaagaagagtactgtgttgaatttcaggtattgtgttgcatggtatcccatataccgtatacctgacggtaaatttcaggcagcattcttaacataccattcacttgggcactggattgttcagggcgcatcagagcaagctgatgacagtcgtgttgttttgccagtcacaggtcttgagtcttacaatgacaaggtactaaatgactgctactccatgaatcctgaaacatacatgcaggttgactgaagatggcttaatcttggtgatgcaaagaccccaagcaaggcttaaaagaattcttatacttgtaatgcaatgcaatgcagggggagtggtggtttgaggtgggcagatgcagtggtgaagaagatgcagcagagtcgagagaagaagagtcagtgtggagggaagcatccgaggtagtgaaagagagagtgcggacgctgaaggaagctgcaacggtgatgtccagggcaaaggtggtgatgtccaacagatcaaacagacatccagaccatgacttcttcttgtcccggcaactctatcaggagccaaggaagaaccactaaccagctgcatgcctgcctgtacatacatacttactactagtgtgtcttagtgccgtaacaactctcattaattactgtgtctgtctaagttgtgtgtacatatgtagtagtatgcaattagcgttgtaacataaggaaggaaaagccttcgttctcttcttgtacgtaggctgagaaagcaagtttgatgtgagcatcttcatcgtcaatgacaagaagaaaagaaatagaagagaatcatgatatgtttgttttattcctggtgctggagattgaagaaagtagaaaggcatctattatatagagcagtcctatgtagtagctaagctagtagtgacagccagagagatgtagggattgaacatcaagatgcatggaacacatacgtacacatactaccaagtacattgtactctgatctctctgagagcaatagcagcagctaataggaaggaaggaatcatgggcacttgagcttgccgttgtgtggattaaccatggtgtcgtagcaagggcagaggtggcgggtgtcctgcccacttcccgggggaacgcagttgcatcggttgcagcagacgttgcacatcttgttgcacatctccttcttccagttgttggcgcatcgccccgagcacgtcccctggcagtctatacatttagtggtaccattttaatttattagtacaattccatcgcctttcctctcctgcctgtaatgtatcatttacatacctatctttggagcctgcaggagggatctcgccctcttcacctgcatctgctgcacctgctacatcatcatatcatatcatatatgtcgttcaaattaaggcaagaactatatatagataagtagtagtatgtttgggtttgtgttccttaccagctgtggatgggaagaagaagaagcagcagcagcagaagcatcgacatggatgaagaagaagatgagcaagaggaggaagcatggcgccattgcagttgcaggagaagggacgaagaagccattgttggtcttggacttggagccggaggaggccatggatggatctgattctgagctagcttggagtagttaggaagaagaagaagaattaacaagggacagggtttagctagagttgagaggtgctgtgtgtatatatatatatatactcctagctagcagagtgagtgaagaaggtaataagcaggaaattaaataaacaaataaataaagcgataggtgatgcatttgcagatgcagggtaggaggaagctgcctgccctggccgacatggatcttgaccactgtcccagccgcgcggaccatcaccgatcaattgcaatcttagtggtagcagcagcttaaattagtaatgcccaattgtacgtactagctagtagattaatccctagctagctatgtgctcatttacttgtcaccgttggtcatgtgtatttcaacttttactataaacaatttatttattcttaattaaagctatatgatatactatatttgtgacacaatatgcattgctaatatagtatacctatacgaagaatatataacttcataagtaaaaaggacgagcactcaacattaaaaagtatctagtgacaattacatgaaaccgcaagaaacatcagcagtagtaatagcatgaaggggtagtattaaagagtattgctatacgcacccagttgtataactagagacatgcaaccgtagatcaatcatcaaaataagagatcatattcatatgtattgtagtcgtttataatcattgatcaaattcagtcacacttgagtcgaatagttagatcgtttacataataattctcttaaagtaatcaatcaagcaggtggagagggagggaaggttgttgcatctgaatatgtacacacactatactctactctagcagacgatagagtaaaaagtgaaggaacaattaagaagaagacagcagagcacgtacgcacgcacatgcacatggacatggcattgctgagtgcctgcgcttgttgttgttgagcacatgaatgcacgcatcgctactttgatctgttgttgggttggaagatgggaaccaactatgcccgtgccaccacatcacatgccttgtctggtctctgctgctaatagactacggctctcttcttttggaggggtagcaacccctccgggaatcccttccattcacacctaaaatagagcgatgaattaacacatgattaattaaaaattagcttaaaagttttagaaaatggattacaataacttttgtatagaaactttttgcaaaaaaaaaagcacgattagcagtttgagagaagcgtgcacaataaaaacgagagaggtgaggttgggaaccttgagggaagaagacagcctatagagcctactagggtttatattgttgttttctttgggttggaaactaatatctgttagctggacagaaacacttttgatcaactttgtacgaaaaccaaccaaaaccattcgattttcacatccttatctctaacggtttcgtaaaaccggacaacttccatagcttttcgatggtatcgcagactttgatacgcaatgatctgtactaggatagttttctcaagattcactgtctccctctccttcaagaccttaaggattgtacaatcataggctactaatatattaattaacatgcggtgctagttcatgtatacccatgatatacataaatcatgcgcgtgtcaccaacacaagtaacttagggcaccatgccctttgcacaattgatcgatcacaccatcttcttttctaccttctcttcttctaactctaaaatgtcaggcatatgcgaccatcttcttttccaccttctcttctaataatccttatatcttggcttttttataaagattatatatgcacaaattaaattttgtcatgcgtactattaaattgatttacaatttgtgacgctttgaaaggatgtcttcaacttggtggatattggcaaaggaatatatcgagaacccgtggacaggagaacataggtaaaaaagcagattgagaggtcaggtgaagggaggtggcggaggggaggactgcgggtgtatggatttgttgcttgtcagccttttgatttccaaatgggactatggtgtatggagatttgttcttttaagaaaacagtgtccgactcaatcaaagcaacataaatttggaagacttctcaggaacatgtagaaaacaaatatccgatcacatcagaactgcgagggtgtgttttgcgtgggagacaaagtgacagatcactcgaggcatagaagacggacaaattaaaatttgtttggaagccagcttttattttttataataggtaaagataaaagattatggagtaatgccaaacgttattggcttcgttatatgtatgggggtatgaaaacgggccgggcctcttctctaaagtgtgaaggttggaacttggaagtcggagagctctcaatgacttgctgctcccttcctttcggtgggcagcaatggcgatggcggacctttgctttgctccaaatgcaaatgcccctcctcctaccactagcagcccccttaccccaactttcttaagcaagccccaatccctacctaaggcttgccttccttcctagcttgggttacttgagattaaggaggcatatgccactcccactctcctccgccaacgacgactccaattcatccgttagttcacttgccttgcctcctcgtacttactagtctagtactatttacttctttacttcattcataccaacagcaggaataacatcccaacactgcttccaaattgctttacctttcttcttcatattgatattggctggggagtggggaacccccttaattctttccttttcctttttttttactttcgctaaccatcatctcttgttaaacaatttcttcccaactaacataaatagtataaatttaactgcctaaacaatttccaatttcatcctgcattgtacctaaaaatggaaattgtgttccttccgatggtgccaaccaccatttgtcctgtactattatacctcaccaatcacaccgcacccgccgtaataggatactaagagccccatcggttggccaagagttgattatgggtctatttggattgctaccatgccattttttggtagagttttggcactatcaattttttggcagggcaaaattgtatttggcttgctaccaatataaagccaatatatgaattcttgtgaagattattctagattcatgccaatatgaattctagtgaagattattctagattgatgccaaatctagcatgggcattaccaataatttggttttaatccaaaccaagcacaagcacatgtactatttgaactaccaaaatattggcagggctaagctttggtagcaatccaaaatgatttattagtgactacaataatttctggcttaaaagtcattgctggaaaagaaattacattgaaaatgccctaaatttaacttcaaaaattatgttttacaacaaattttggcaacggctgattctttttagaccaaacggtgaggccttaactgtaggatcgaatcacaacaactaagccaactagaggggggggggtgaatggttggtatacccaaaaactgaaaacttttagcggaaataaaagttaccatcgaattcgatgaagatcggtctgaccgagattgatctgccggtctgaccgcacctgtgccgtcggtctgaccggtgtagatcgatcagtccgactgctgaagttgcctgcctgcgcctgtcgccgccgccggtctgaccgccgtgtgctcgccggtctgaccgccgtgtgctcgccggtctgaccgccacgatgccggcggtctgaccgctggtgcgccaccggttagaccgctgaaacccggtgaaacacaaatcaaagaactcttaaagtggataacgactttattgattctctctgtgtttacaaagtacaccaacagcactccttacaaaaatttcgactaaactcgaaaccctaactcaactctcaactcaattgctctcaaaagcgataccgggaagcctcacactccccctctatttatacccgaggtaggcagcctaaagctatgaaccaaactcatactagaagtcctaaacaccttaggaaacactctagtacaagacacaaattttacataaccaatcataccaaatttagactcctttcaaattcgactccgcatcccatacgcacacaatacctccatcgtatgccatatggaatcttcaccaaccacgtgcatcaactctagcctaagtatcccgcatgatctctgaccaccacggacgtcgtcttatccccaagtcgactcctggtccatcaccgcaaatactctcccgaggcatcgagtcacctacacatagaacaaacaaagaaaccatattccgagatcaagctatctccaacttgactcatgagtagcaaacaacagtattacatacgtatagtatccatctagaagtcaaaacaatgaaacaatcacggatatccaaacaaacaacccaaaaccgaaaccgacacagagtcggccggtcagaccgcgggctggccggtctgaccgcacgcataccgccggtctgaccggcaacccttgcccggtctgatcggtcacataaaataacagcacctgtaattcacctgtaaatccaattatctccaaaaccacttcgtaaataaattccaaatatcaaaaccaataatctccaatgccaattgttcatcacaaaataacaattaaaaacacctttgattttacattaacaacaattcttcttttctatcttagggctgtgtgcttggatcttatggtagctctttaagcctccgaggtgccacacttaattgctgcagtttctgaactgttgtcttcagtccatctaactgattttatcatatgcaattggttagttgcttatctgtcccaaacttatccggtatcctacttcttactccctccatttcttttgacaccattaactttttaagcatatatttgaccgtcttgttaaaaacttttgtaaaatatataaaactatatgtatacatataagtatatttaacaatgaatcaaatgataggaaaagaattaataattacttaattttttttaaataagatgaacggtcaaatatattttaaaattttaaaaaatcaacggtgtataatatttagaaacggagaattacaaacttatagagcatacacacttcattatcacaagcacacaacaggcgtttgtgggtatcttgactacctgtacacattgcaaactgtttttttatgtcatctgcagggctatctgaactgaaccccaaccgaaccgttatttaagaaaaagttcataacaaagacatccaattcacttaactagcaaaaaaaatggaaatagaaaccaggaaagaaccatttcgaaaatccaaatgcaaacaagacaattgaccattttgaaatgatgaaacaggtccatacgaattagagtacaaatagagccaggggaagcccagcttttatgaaatagtgggatagagtctacagataatgtgaaatagaatggtgtgtcccagaaacacacaacatgatagcatgtggcttcagaagtcttgcatacttcttatttgaggcttcccatgatgaacaactaagtgcaatcaaatgggaggcaatttaaaggctaactgatagtagtagccaagcgaagcagtagtagaattctaacagtagaacatgacattcttgacgctgtccttgagtgcaggaaggggcctgacggctccaccacctgcagcacgagtgctgcgcgatgtagacgaacctcctccacgaccactcgccattgaaccactgtccgagctatctgactccatgtagaaacgggctctgaacgccgccagatgagcatagtatgctggtggaactgcaacagcaaaattggttgttaattcagccaccacaaatctcttactcccaacatatttatttattaactaattatgcatggaaaagatttcgcagcaactgtcacttaccaatagatacggatcgtgtgcacctcgcataactgcacaacaagtgattgcaagttaagagagagagagactgttcctcgttcaagcccctgagaacaactgatcatggggtaaagaaaaacttacgtgtaacagaggttgttggtgagggtctgcaacgcatcagctgtgaagttgttttcatcccacaggacgtggtaatgagcgggacggcttgtgccctacggagagatgggagttcatcatttcaattctcaacttgtgtatattatgatgatagatggtagaatgtctctcattgttgtttaccttgattccagcatggctgcacaagaagaagtcaaactccgtaggatggcaaatcttggagtcaacaacagtacctgcaatgcaaatgaagaatcaacgacaactccataaacagcgacactagcaaacccgaagctatagccaacctgcataataacgacagaagaacaatactcaccaggcaatatgttcccactcctgtcgactgaattctgatcattgtggttgtgtgcaaataatctcgtgtggtggcgcttctgaaccacaatgaaagtcacctgcggttggtaatttgcttcgagtgatgcacaagcctgagagggagcaagacacaaagattaagagaagtcataaagtctgaaaaataggggaaagttttacctttcggattgcatcaagctcatgcaatagaacctggtaaaattgcccttcactaacaccatccctgtgaaaaggcaaaacttcagctttatacttaagtgtactgatgcggcttttctaatcaaactcaaccctaaactccatgataaaaatcaaccagaaaacaaacatggccttcagctcaagttttctgcatagggaaattaacttgttttgatttcatggctccagtgagcctcaaataataaaatgtcaagaatcatattggctcagtcaagcatcaaagactgctgagattcaacaacctactaccgccaaggatttccagtagtcagcctgaaaccgctaagtatttgaagaatcagcttggctcagacaagcttgagtggtaatttatgcaagaacatacctatagaatattatccgttgaggcttttgaccagttgatcttttgaaggatataagaagttccctgaaaatgtggacatcaccaattaatactttgtgctaaaaagaaatagaaggacacagagaggagagatgttgagtgtggcatgggcatatacctgaccattccaccgcagatgggccctctatgaggatcatgcgtgatgttatacagatcatctattaactcttgtctgtgagattgagcagaaactaaaccagcatactttgtcacttcaggccaatcttgggaggccacaacctgcagggcaacatacatttgttcgcagattttgacaagaatggtcactaaatataaagcattagcttgttcaacttacagcagcaatggatgggctgctatcttcgccagggtgaggatgggtgacatcagcaccgaatataatagtaggcctgtcagttaccaacggaatgcgtctcgacactgcatcaaccagtacagtgttccttcccccaacctataagataaaatttatgttacacaaaacctgaaggaatccatacaaagatgagtagagatatcactagaccaccacccttcacattattcttcagagcaagatttgctaggatttgtttgttcattttaaacacttgctttgtgcacaagcactgggaaaccaatccaaggtcaatttggcatatacgcttcaaatcacctgataccaacagagtcagcatttgacttgaattttgagcacaataggacataaatcaatacaagttaaccattcagagttgcaaatttatataccataaagagaaccattgttatcaggaagcagtccgataagtaaatcgagctccttgtgctgtggcccaagtatgttcattgcatcatggaacctggctttcagagctcgttccacttgatcaggacgtgcatacatagatggaagaacaggctccaaagcaaagtcctacaattgcttgtaaaacagttactactgtacacaagtaaatgtctaaatgatgtaaaattgaatgcactatatagatgcttctgtatgtcaatgggcaaatgcatctggaagcattaagggatacttgccattcctgaggcctggcacatgcgggccagttcacgacaaaatccactagcaacactctcttgcacatttcgagcaaaattgacacatatccagctcctgactctaccaccatttaccattttctggatagcgagaaatgaaaatgataaggtttgagataaaacaggaacacctatttgattaaccaaacttaagaaacaaaatataatagctaggactagagtaagcacaatcaacattgccatatgagtgtcataaagtatgtgcaatgcagacaaagttcaaaagctgtaaaaaaaactgaacataatgatttgtaaaaactagccactacttatgcattaagtattatcactaccttgttcatcatattccactgaccaactctaggcaagcaatccttctctctgccagtctcattatacttgagctgcatgaacaaataggaggattgcgaggttaaaaatgttaaaaggagtttgaagcgatgttaatcatccaatttttttatgtgccttctcatttgaccattgaagctatgcttcatccatccagaaaagggtgacaacatgataaaaatgaacttgaaaaaccattgtttctacatgaattggtttccacctacccgaggggcaggtaaaatccgtgcctcaaccaaggccagacgctcgctgatcttaatgccaaactcctttgcataaggatcttcatggtaggagttgtgattcaccatctgcatacacacaaaagaaaatgtttttttatgtaagcatgtgaacttacacgtacaatggtagagcgtcataattctatgcaaggtgtgacatacctgaattatgtcacgctccctatcgtgtgggcgctgacatgtctcctctaaaagagcccttatctgattctggttcagtctcttggagtacctctgtccttccactattttgcagacctgaataagcataaaagttaagtatgcacccccccccttccaaaaaaaaaatagaattgaaaattttggcaggacaagttaaacaaggaaacagaacaatatcatagagctttgctagctaacctccattggtaggtaatttggacgctgctgattgccaacttgcagacaaggaagataggtatgctggatcgcaaatccatatgtctcttgaaaatattgtacaacagatttcactgtgcctccttgatcaacaggaaaactgtggcaaaatgaacattaatttcaggaagacaataatagtggcataggattgccatctactagtgacttaaaaggcaaatagcatttgttatgaacaaaaagagagagagatcaatacgtcagttcccgagttgcctgagatgtcaaaccagatatccgatacttccggcgcatgttgccacggtgagtaactcctaccttcactcctcttaaggccttcttgatctagggtgttgcataataacataaaattcgttatttaattagttgacaaaaatgatatacaaataagctagacatatgattcaaaaacataagacaaaacaaagccgttgaaactaaagattaatcattgggaacagatgcaataattatctgtatatcttctgtattacaacaaatatactgagttcatttgaggaatagctcttccaatgaaataaaaggtaaagatgagtaaaacaggatcaccagcataccttgacacgctcagcatctgataagggcctcgagcggatgtcagtatttaaaagctgtatgacaaaatctatgactggtaacggctcaaagaaagcagttgccgacatatctgaaaaggcaggaaaagaaaagaagatataaattgagggcaaaatgttcaaaaagtaagagtactaatatacaaaggcatctctgtttaaagttcaagattgatatttatgagttaacatgtaaattttatgtacatgagatccttcatgacatgatcataagcctggggaaaaaaatcaaagctaagtttttcaaattcagaaatgtgcagcaaacatggcattggtgataggataaaaaaaattggacagaccagttggcctcagcctgatgttttaaggcaaaggatttatgaaaaccaggctactttattgctggttccatgagtcttcaatgttttttttttgactggggtcttcaatgtattattacatacaaacataaatgcacatatgcacaagatcatacccatattcatgattcatgagaaagatcatgcgacagaaacagagagagttttaccaatattcagtgacaagcccatttgagtaggacgaatgctctgataaaacccacgccaggtttctagtccctcaccgagggatcgtctcctccccaggtcaggagagaagaaggatcgaccaaagggtgcatatctgtaagaaaaatgggattggaaggatgactcaatagtttggattgattctcctattatctgaatatacattctacgtaatgtttcaaagaaatctaccttgctgttggcaactctcgcaagacaatatcaagaacttgcaaggcctcctggggagcctctgcctgccttccagctagaaattgctcaagacggtgaagatcagctcttgcagcaaacttaatcaccacgttatatgttttctgacgcctagatcatagaaagaagagtcagaatatacaagatgatttgccctggtactagaatatcatggtgatcaaaaaaggaataggggcacacctctccgaaccagaaccatcatcttcctcaagcaaagagatgcgaaattcttttgaagtaaacggcaatggaccggccgtgtaaaggctcttcctaccatcataggctggaagacgtcctcccaagtatgacatcttgtgcagtctcaccaactcttccatcacagcacggctccgaattcgtgatgtaagctccggggtgattgaaacctgtcaaagatgaaccacaaggtggcaaataaaaactgagagattgaaaaacatgtaggaggagcaaggaggaatgtggcatggaaaaacaaacgcacgtcatactgatgaagatccttgtctggcagttgagcaaagaagtgattcgccttcactaaacatctggttccaatactcccacttccagggcggtgaggaaatttaaatgatttggtggacacaggaacatgttggacaatctcttcctggctctcacttaattggtactgcacagacaagtcctgaagctgctctgtgacctcaagagcaagagaccgtggtgatgatgcctccggagaggctgcttctggtgaggagacattggcaggaggctcatgtggagcatccattgcttggagcagctcgggagctatggcagacggaccataatagtgctgtggtctcacactgctgttgtagggctgttgatggcccaaatgctcagcagcagcagtagcaggacgccattgctgcaccaccattgcgccgcgaggttgaggagcagcaccatggtagtagcctgctcctccacggacaccatgtccttgtgggtggtattgctgtgcctgtgggtagtagctgccacggccacggccacctcctcctctcccaccaccacgaggctcacagtcctcaccaaacccaggcagtcttggtctccttgatcccattcagtcgaccaactcaatcaactgccacaaaggagagttaagttgacttcttaccataatccagacaacttcatattcacaaaatctatacagctgcagtccagacattatacaggttgttggtaaattacaaaggcaagctaacgaggtcaatatcaaatactacttgtttattactccagtgtttaggttcaacacggtgttgtttgtaagaatatataccatctatctagacttagctcggatagcatcggagaatatatatgcttcggacgcacggagcatgaactaattaatcaggaatagaaacaatttacagaggaactaacaggatggtaaaggtaaacaaattaaaacaggagttgaagaagtggagaacacgacagtaggctcaccataaagcacacacccaccaaatggcttaaaaccagagagagaaagaagcaaacctaacaaactgatcgagctttttttaagatcaaacaagagagttctgcatattgaactagccaaattaaacactcaagtacattcagttttaccaatggctcaaacatgtgaagagatcgaagaacactgttatgttgggaaaatagagtatataagaaaagtaagaaccagataaggcagggcttttaaacgccgaagatcacgtctttcatagaaaaaacaataaaaatgtggaacatttccgcatatcaatgcgttttaccactagggtattagcagggatagaacaagggagcgtatcccatgcacataggcactcgcgtatacacaccgtgtacaccaactaaaaattatcataaaaaattctagaaaaattcattcatgtacttttaatagtattacatctacgtgcaaaattgcatcttcaaattcattctacatagagaataacaaaaaagataaaattctgacaaaattgcaaccttaaaactgtcagattttttgttacggctaaaatataatgaatttgatgttaagattttaaccctaggtgtaatacaattgaaagtatgtgtatgattttttctagattttttggtgacattttttagttgatgtgcacgtgtctacacgtgaggtcctgtgtgcatagatatgtttatgttgccatagaataaaggataacggaagaacaggaacatcctgaaaactgaacactgcgcatagaagggaaaggcccaaccttttcccaacaaaacaactcacaaaccgggatatttttaggtagtctcacagacgtcgattaaaaagaaaaatcgcagcatgtaagtaaagaaagatagcatcaactcaaaagaagaaagcaaagaaagaagaaaataaacagaaagaggcgcatttcatatgcaagtcggtgttgcaaatcaactcgaacacattacattgttggacgataagcaaacagaaagggagaagcgaaggaatcagtaatcaaagcacaagaaactcgagatatttttcttgtttgaaagtaagggaagtcgagaaagaagttgcaggatagcgggaaaccaactgaaggaaagaaatgaagaaagagaaaacagatcgaagcatcttggatggtaggagggaggagctaagaactggcgatcaccttgggcagacggagagattcagctcacatccagacgaacctcgctgggcggaagatgaagaagagtgggagggtgatgtactagtactagtagaaggagatgagggaaaacgccaagaagaagaagaagaagagaggagagagctttacgctcccactaccagtaatgcagtgctcctgtttctactctctgccctgcttacctctgcttctaccactatctaatatactaccactcctacttaacaagattatttacagtagtaatttcatttctggttggttgcctgcttgctgagatattttatgttaatatatgcatacagtattgacataaaatatctgcatagggcgagtttagattggggtgtaaagttttatcgtgtcacgtcgggtattatatagggtgtcgtatgaggtgttcagacactaatataaaaactaattacagaatccattagtaaaccgcgagacgaatttattaaacctaattaatccgttattacaacatgtttactatagcaacacattatcaaatcatggagcaattagacttaaaagattcgtcttgcaaattagtcacaaactgtacagatagttattttttaatatgtatttaatacttcatcgaggtgtttaaacgttcaatgtgacagggtgtaaaattttatggtgggatataaacacacatagatgtttagactgacaatattatgctttgtaacccaatcagagtcagcatgcttaggcactaataaaaaaataaattacaaattccgcatgtatactgcgaatcaaatttattaagtctaattaattcgtcattagtaaatgtttactgtagcaccacattatcaaatcattaagtaattaggcttaaaagattcgtttcctaatttatactcaatctatgtaattagctttttatctatatttaatattttatacatgtatcaaacataggatggtaactaaactggaccttggttgtgtgtccatggccatgctgcctgggatacaactataactactcccagccatttcatttcaggcaaagcttttgattttagtggtctgtacggtaatacttctagtacaagagaaaagaggataggtttgcttaaccccgaaggccgagtgaggaattattaaagccaacaacaacacaacagtgcagtttacaacagtacgagtggtccacagtggagtactacgctctatatagtgagcagtgggccctttcgagtaggacccacacaagatctctcttcttcaatacttcaacacaagtagaagtatactcgtagtagtagtaattttttaagggcatgtttaagatctgtaatttttttcaccctatcacatcggaaatttaaacacctacataaagtattaaatataggataaaaaataactaattgtaattgatttgtgggacgaatcttttaaacctaattgctacatgatttgacaatgttgcgctgcattgcagtttacaggcggaatctataatttattttgttattagggggtgtttggatccagggactaaactttagtccctatcacatcggatgtttgacactaatttgaagtattaaacatagactacttacaaaactaattgaataaatgagagctaatatgtgagacgatttttttaagcctaattaatccataggctaatcatggattaattaagctcaatagaatcgtctcgcgaattagtccagggttatagaatgggttttgttattagtccacgtttaatacttctaattagtgtctaacatccgatatgatagggactaaatatttctagccccatccaaccagccccttaaactacgttaaatacttcaaatacatgtccgtatatccgatgtgacacgacaaaaaaaaatttaagctctgaatctaaacacagcttgagtgatcgagtgctaaggtttttactgcctcacaattaatgatggatgtgatgatcatcttcattagtattatgcgccagtatcacaattaactcatccggattcaggaggaggggaacgatcattttgataagcggggctttggctttggctttggctttgcaagtgataagtgagccaaacaattgcagtaagcaatggcatccatccatcagcttggcattggcactttggcagtggcagtggcaggaaacacatgcatgataggaggatcgtcctttgttttgcttttgtacgataggaggatcttttcggtttcaaggcatccatcatccaatcctttggcatttaaaccctacgacgattctcagtactattccttttcaactttagtgtacaactttttttttcttctcctctgaccaatcgaccctccttccttccttccctccttccctcccaactcgctattaataatagaacaagtttgttattgcagaacaagaaagctatcgatacatgattaatagagtacagcatttgcattacgtagggtaggattggattgtactaccagataaatgtcctgctaattgtgctcatactgctattaattagagtaccggatcgatcactcctttcaagcgaggagtgatcagcataggcatagcagcatggattccagtaaagtttgctttgctcactgatcatgaattggcttgggcggctataaagttagttaggcggcgtcaccagtgcactaatacgatcaatatgaatatgaaaaatgctagaatgatttatactgtaaatcggagggagtagtatatacacttctgcaccatgttttagtatttagtactactagtatatactccaagaaattgtatcagtacacgtacgttactactttatcttgcatgacgtcaggatcgagatcaaaactacgcgctcggcgccgtgcggcaaatcaaacttgaaagcttgttggatggatcattgcacattttagtaagttagttggagcagcttttgttttcactttaaagtaaaacgttgtctagttggtgcttggatgaatggatcttcatgtttcagacatgtcatttgttactcatgcattatcttaatccatctaaacctttatcttaagcaaaccaaccaagcaccggtacttcatggtatggcaaagctggcagcatattagttctgtccaaatttttatttctaacttaattttagagttgtttttttttctcatcatactctactttccagcattagcttttaatgtaggttggagaaagacccagggatttgttatgcccacaaacttgaaacaaaattaggaaaaaaaatccactttaactctcttaaatataggccagatcttaccctactaaaatcagatataatgactcttttaactattaaaagtaataaaaatgacttctaaaataatattaaggggatattggttaacattgccgtcagtccaatcatcataggaattgaaaaatagagagggggcatatgccatcccacctctctctctctactttcttccctatcccctcctctctagggatgcaaacgggtttgtccgcgaatccgtttataggtaaaattagtgggtaacccacgggtttaactcactagggttacaagcgggcttatcagcaaatccgcttataggcaaaattagtgggtaacccgcgggtttgactcactggttacctattaacttaacctataaatgagttcataaattgacccacttgcatctctagatgcgataaaccggatcacgacacaaaaatccattagttatcatctatttaacctataagtaaattcgtgtatcggtcctgcttgcatccctcctctcttccccaatatttcctcaacatcgtagcagtgcaatgcacataccagcgacggaagcagcagcatagaatgctctcgtggcctgataggcgatagtggaggcaatccaaactgctgcctccaagcatcattcactcattcctcatcacacgagagtcatcgtcctggtcagtagcgctcgatctccatgccctgctccacggatcctcctcctagccgcaagcatccttcttcaccttcgatggcgtccttcgttcctcttccttgcaactgtcggactgtccttcgaaacggtatatttagcgtcgcaacctttctggaggcgtcattcttttttagtgtctctgctttgtagtgtcgttgtacttgtaggctcagcgatgatcggttcggtacttgactcctttctcagtagtatgtgtttgtgtggttggtggtctgtcaagcttttcggattgtgcactatagtgcatgtttctcgacaaccaactatcaataaaaacatacttgtaacttttttcttctatcttaatatcatttggatgacctttcttcggtcatccgaaaacaaaccacaacagcatacgtcaatgagaaacatggcccttttctagttttcaactgccccagcagctagatcctcatatgtccggttcccttttttactcctagggactgtatttttctcccgctatatttaatggataggcatagtctcgtgttgttttcctttaaaatttttttggcattgatctgatgtggggataatcatcgatttttgggccacgtttgtggctttgtgcatagatcgtgaaacacagctgcccatgggcctacttgggctgcatttgaaaccatatccatgcaattcttcttctgactttggtgactcgttcgctatgaactgcggagccaagtccgtatcttatttgtttacactttactagaaaaggtatctatgcgttacaaaacattaaataactctaaaaatacattttgtttcataatctatgctcgtgcgttgaaacgagaaaaactaaagtacatcagacattaaataactttaaaacgattttttaaggaaaaaatacgaattaccccccaaaccatcgtggtcgaccgagttaccccctaaaccataaaaccgaacattcttcacccccaactatgcaaaccggataattaccccccccccccccgcctcaatccgcgatggtttaatcttatgtggcagtccagtcagcaaatcttttaataaaaaaatcggtgggcccacctgtcagttccccacccctctctacctctctctctcttctccctccctcaccggatctcaccggcacgggctacggtgtaacaccctgaaaattcgaccgacaaaatcaaaactctaaaaatacggattttcaaaaactttttaaactaattacatcatgccgatcttattggtctatttaatcgggatttgatctcgaagattattaatcgtgagtaaagaatagttaattaggaataaactttaaaaacaaattggtaaaataaatccaaattaaaataaagattaggtggggatagaaataaataaaatgttatcgcgaccatatttggatcaattaaatttaaatacgatggaataagaattaacctctaattaaaactcaaataaattatataaaaataaaatatgagtaatattaatctagggtgaattcattagttaagataacacaaatattgagtaaaatgcatatatgcaaaattaggaattgtggaatcaaatttatatggaaaatacactaaaatcgggttaattagaaaacagcactattcattgccccctaggtgttagatcgcgttccctagccctagccccttctctgcggcgttgccctcgcgccccgctcgccgtgcgccgct

SEQ ID NO: 28865 - DNA, 728 bp, Oryza sativa
tacagagtccatcacatcgccgcgcgccgtcgccatcgcacgcgcgtcgccgtcgctgtcgcgtcgccatgcgccccgcgccgcgccgcgcgccgccgctgccgctcgcccgtcgcgtcgctcgcgccacgcagccgtcgcgtcgcctcgcgccgcgcgcccccacctcacgccttgcgccgccgtcgcgtctcccctctccccattatctcttcccctctcctatataaaccccactattcccactctttccctccatcctcaccccctctcctctacccactccaccacgccgccgcctccacgccgccgcgtcgtcgcatagagccgccgcgccgcgccgcgccttggccgtgccgtgttccccgccgccatcgcagtcgccgtgcgccgccgccgtcgcagccaccgtgcgccgccgccattgccgttgccgccggtaagccgtgccgccgccgcctttttcctttcctcagccggtcgcggtaggcaggagagaagagaagggaagaaagaaaggagccgggaggagagaagagaaggaaaaaagaaagagaaagagagggagagaaaaaggagagaaaaagaaagagagggagagaaaagagagaaaaagaaaaaagaggagagaaaaagagggaaaatagaaaagaagaaaaggagaaaatagaagggaaattgggggagaaattaggaggatttaggaaataaaaatggtcggggttaat

SEQ ID NO: 28866 - DNA, 1861 bp, Oryza sativa
gtaatagtatttcggtcgaaatcccgagttaattataaaaatatgtttcttgatcagattagattaaaattggtagtaatttagatataattaataactaaacaattagatgaattcttatagattattatagattatttttggtaatcttcataagtcatcggttcacggtagaaattcggatttaattactaggaatcttagccgtgtattatatttaatcgtttagtcatagactaaattaaactgtataatatttctaggatttcgtccgatatttagctcgtaatagaaatttctaacctattatatggatataatgctcgggaagagtaaattaaaaacttatgacaacaaaatatttatacctgcaaaatagtttaagccgaaattgggtttgccgtagttcgcagatagtaaagttaataaaaaggaatcgactttcacattcgactttcatttggatttttatttgaattctaaccgaattcaaatcaatttttgcacgtaactatagagcccgagggagttgcggatccaagcgaaggccaagacccgcaagactctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaattatgacaattgcttagaaatgctattctagaatcatgcatactcatatttatcaaatgctatatgcttgggcaattaccttcgggaaggtaattgagatgcggcatgtggagacatgagcgccacattgccatgatgttgatgacatgatttgtgaaaggagaaataaaattaaaacaactgttttcgactggggcagacggaggatttgggtggtatctggaacaggctagtaccgtccccagtcaattaaggaccgagccatgaagttaagcatgaaacgacccccgtacaaccgtacttctcgaatgggtatagacctagcggattagatagccgagcggaggcaatattcctgcatagatggttcacctctgagtgaggcaggtgcgctacgatgggacagccgttgaggtagggccaagaggcgtgccctacatcggtgttgccattggtaggactgccatgagtgtgtgagagagagaacttaacttgaaccataatttaatatgcgtgtgagacttctctttccccgggagcgccagaactcctctcactgctagaaacatggacacctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcagttattgagcaccgggacatgtattacacttggctagactctaaaattctttaacttgtgtgggatgggatatcgcatgacaatttttatgctgatggagccacttcctgagaggcgggaatgtggacgtcctcagaaaaccataacgactcaatggcgggaagctatccttgggatcacaatggatggtggacagaaccgtcattgtttaatatgaacattggtattaaaacttgaacagtctatgctaggtcttaggcttgtgaaaagaattacaaaacttgctttgtgcaaaagaaccatggccatcctttgaattcctctgtcatgtgcatcattgctgtgatggcttgctga

SEQ ID NO: 28867 - DNA, 1199 bp, Oryza sativa
acgcgcgccgaccgctggccctcccccgtgcgccgctacctgtctttgcctccgcctttgctgccggccacacgagcgacctccgtctcaaccaccggcgcccgagagacattcgcctccgccgccaaccgtccgcctgcccccacgacgctgcccacctccccgcccctgcgcgctgccctgtgtgagatagagaagacaaaggagagagagaaagaggggaagaggtgtatgactaatgggtcccacatttttttaataaataaaatgctgactggattgccacgcgtacgttacgtaggataaaatcgctctggattgggtcgaggggggtaattcgtccgtttttaaaagttcagggtgagcaatgtctagttttcgggttaagagggtaattcggtcgattgcgatagtttagggggcaattctaccccaacccccccccccctttataatctatgcggaagactgtggtaaaaacttatacacattaattatatacatgacaggcgcaatatttgttacatagattaaatagaagatactttgtgttgtttttaaacactacatacggatacggtgtatatgagtttgataactttcctccgtttgatttagattataaagtagatcatctactggattatagagataagttaaacatttcaaaaattcgatgaacaatatgagaaaaacagagcctcttatgcattagtacaatatcatattaaccgcttcctgattagaccattatatcgtttacttcaatcctacatcaaatcttatccacgctactgtataaacccaagtacatatctcctctgtaaaaaaaaatataaacaaagaaaagaggtgctgctagccgtgctgaggagatagaactagagaagagctgcagggtcggacgaaatgcgcgaagtagaggttttcttagcgacagacgaaataatatatgaatacataatcatttttaatttttataatatatatactccctccttttttaatagatactgttgacttttgagcacatgttttgattattcgtcttattaaaaaatatgcaaatgtataagatataaatcatacttaaagtacttcgagtgataaaacaattcacaacaaaatgaattataattacgtaattttttaataagacaaatgatcaaacgagcgacaaaaagtcaacggcgttatct

SEQ ID NO: 28868 - DNA, 8841 bp, Oryza sativa
ttttttaatagatactgttgacttttgagcacatgttttgattattcgtcttattaaaaaaatatgcaaatgtataagatataaatcatacttaaagtacttcgagtgataaaacaattcacaacaaaatgaattataattacgtaattttttaataagacaaatgatcaaacgagcgacaaaaagtcaacggcgttatctattaaaaaaacggagatagaatataggtaaggtaaatttattattaaagcattcttgcttggtagtatttttatagttggtatgtggagtaaaaagaaggaaacaataatattgccatgctagattaatgaaacagattgtacataaaggcaagacaagaggagaagacacagctcacctgtgctatgtagccgtagaagtgcagatgcagtcggaggaggatattcgctgtgtctttctcctctcatctcaagtggttcggtttccattttgaccgagccatccatttgctgaataaatgaatggtgacggctgatgccacttccctctcctgtctgcaactcatctgtcacagtttcagcgaaagcgagtaaaatgcaaggagcaagatataaacaagagtagacattttttacagtatatacaagattcataaccgcattttccccatatctatatatacagtcgtcgataaattctacaggtacgttcaaatagaacgagaagaaggagcagaacagtatatatacgcgtacggtaggaagagggtatgcacgtcaaaagaagattgaagaagaggaatgcattgcaggcagagtgcagtgcagtctccatcgcatgtatattcagatgcaatgtattccggcggcttgctaaggctagtccacgctagtatatatgatgaactgaacttgttctattgacgtgcactgcaacagtgcaagtactctaataagctttagctaccactgctactactagtcagcaaatcaaagagtcttccaaaaaaaaaaaagggtcagcaaatcaaagggaaacacaaacgccaagtcctacacgtcttgagttgctgcacgctgtttttcctcgccttctttgctccaccacacaatgctgctactgctagtcctgtttctggtgcacccagccacccctgcccacacctatagaaaaccatgcatgtcttacatgatcatgataactttaaacgatgtattttttataaaaaaaattctatctacaaaaattttctataggaaagttgctttgaaaaatcatattaatctatttttaaaatttaaaatagttaatactcaattaatcatgcactaatggctcacttcgttttgtgtatctttctaatcttctcaatccccttctccccaaagtcagtcttacatgattgagagagaagagtgacattatgcaacacactagtcttgctcagtagtaggctcatactggcaggtggcaccgttccatatcctgcaaaattatactccctccattttttaatagatgacgccgttgactttttctcgcatgtttgaccattcgtcttattcaaaaattttatgcaaatgtataagatataaatcacacttaaagtactatgagtgataaaaaaactcataagaaaataaattataattacataaattttttgaatgagacgaatggtcaaacatgtgagaaaaaaatcaacggcatcatctatttaaaaaacggaggtagtatatatactacttatgtcacaaaataacttcaattttatacataattctctggagtatttcagaaaataccctaaaaaacaaactacgtactccctccgtcctataaaaaaccaacctaatactaaatatgacacatcctaatattataaatttagacatacctctatccagattcattgcactagaatatatcacatctagtaatagattcgttttttttttggaacggaaggagtatgagttatgaccagtaagcagcactgactctctcaacgataaactcaacagtatgtaactgaagggatcagtacttgagatgaaaaagaaacaaggacagagtagtaaaatcaggctaccatccatttagggcatgtttggagcagagtataaaacatgtgaataacacaggaaacaaaacttaggaatttgtttgtattgaaaaacacagcaaattaatgtgtatgaacaaaagtaataacaaaacacctgaatcatttttctcgtatcatgtcccttgtgatctttattacttctacttcgattccactggtataaacagattttcgtttttgacattggtatggtattcagatagaatacagcttcaataattaatttatattgtactaatatgtttgtaaagaacttggtccaaaaaaaatgtgtttgtaaaaacataacgaacatataatacttttcaaggtaaatctatgcatatgtattgtatgcatctaacattaatattttagtataaataaaaatgtgatgtatgtattattataaaacctgcaatttgaaaaaaaagagagagagagagatacccaaaacaaaaaaagaaaactagtgaaaaatgctacaactaaaagaagacttttccttaggccactatagaaggttttctatcacctgtcctccttggtccaactatgtcgagaatcgatgaagagcgggcccagcgtcaccaaacgggtgtatggtgtgtattcttctcctccaaagttgcaatcttgcctctgtgtgtgtggtactgtagcggtgctctttctttggtgggtgccacgtaggagaaacccagcaggagtcatttccaagtgtcaccagtgagagggcaggagggcatgtgagttggcgataaccctatcctcctcctgtcctggcccttgtcttcttcacgtctctccctccctccctctctagagcctatagccatagctcatcatccaccctctcttccttccttccttccttccttccacacagaccagaccaggcatcccgacactacacgcagactctcgactttgtcactagcatcattgcttgatgatcgatgctgagctgcaaccaagcaccagcatatcctttccttcattccttcctggtgctggtagaagaagaacaagctagctagagtgataagaggtaattgtttcctccaactcattccaaccttgccttttgcctgccaaactcctcatcctctgccactgcataccatacgtgtgcgcgcctgaatgcctgcctgcctgcctgatactgatacatacacacagcacacacgccccgctattgtaagtgcggccaccactagctgtgtttctgctctctgtgtttatcaccaaattaaagcaacgacactcacttggtctgtttctttttaaaatattatttctcctcctcacctcacacatacctgcatattatttgcagctagctaccttgcagatcgatctccggccagcgattgatcccatccagtataataatggcggccatcacgctcctacgttcagcgtctcttccgggcctctccgacgccctcgcccgggacgctgctgccgtccaacatgtctgctcctcctacctgcccaacaacaaggagaagaagaggaggtggatcctctgctcgctcaagtacgcctgccttggcgtcgaccctgccccgggcgagattgcccggacctcgccggtgtactccagcctcaccgtcacccctgctggagaggccgtcatctcctcggagcagaaggtgtacgacgtcgtcctcaagcaggcagcattgctcaaacgccacctgcgcccacaaccacacaccattcccatcgttcccaaggacctggacctgccaagaaacggcctcaagcaggcctatcatcgctgcggagagatctgcgaggagtatgccaagaccttttaccttggtatgtagtatgtctatcttcttaattttcacccctgccttgcagcgtgccatccattttttcttgccatgcatcatatcatggaattcatgctgctttctcatggcaggaactatgctcatgacggaggaccgacggcgcgccatatgggccatctatggtacttcaacaatcaccatgtcttgctccactgttccattgcttccctaactatgtatcagtaaatattaaaagcggaggtaatttaattttttaattcaaatcatcagatatcccctcacgtttaatatgagttgaaggtcactatatagtactccctccgtttcaaaatgtttgacaccattgactttttaatacatgtttgaccattcgtcttattcaaaaaaatttgtgaaatatgtaaaactatatctgtatatgaaagtatatttaacaatgaatcaaatgatatgaaaagaataaataattacttatattttttgaataagacgaatggtcaaacacgtactaaaaagtcaacggtgtcaagtattttgaaacgaatggagtattgaatagtaacctactgtttgagttgaaggttgctgtactacttactatttaacagcgactagcaagacacaaattggtcaagttttgatgtaatggtcagaattaggttattgatgggagttataacagacagaaactttgtcgtcagacttcacttgcatgcgatgcatctgtagatacaaagtcaatgaagaataaagtactaatagtactagtgcatttcttttaaaaccactatctatgcaagcatcacaattggacttgtagtaggctaaatggctccaactgtttcaagacatgtgaaaaaggttgagagaacatgttctctgagatgccaaatgaatatgaatccgtactactaacaatttcaaacttttaaatgagctagttcaggcatgaattttgaaatctgatgtatacctttttttttttgcagtgtggtgtaggaggacagatgagcttgtagatggaccaaatgcctcgcacatcacaccgtcagccctggaccggtgggagaagaggcttgatgatctcttcaccggacgcccctacgacatgcttgatgctgcactttctgataccatctccaagtttcctatagatattcaggtaactagctggtatatgcatatagcgaaaatccaaatgatgtaatactgctagactatattggttgctaatccctatggattccctgcacatcgcaattctagtgcaagaagaatagacctactaagttgacgaccaaatagttgatcggtcaacaatatcatatgacttgtcagccattagtctctgatgccactgttaacttttcacacaatttattgggcttagtccaggactccatgtggccacaatgcacagtattagtctaggaaaaagatcaatccaaggacagatatggtaggacttttcagaacagacaactgatagagcacagcccatcaagtagaatactaaggggaaggccataattcctatgcaattctatggagttgttaacctgaattaagcaggttctatacagaataaaagaacttgctcattatctatgatgacaaaaaaggaaggaaaagttccactgagaattttactgaacacatgaaaacccacaattggaaacttatcatctgtcctttgagtttttacagaccacatggtgtataataatatgactaatcaaatgcaatgcacgtatgccagcctttcagggacatgatagaagggatgcggtcagacctcagaaagactagatacaagaacttcgacgagctctacatgtactgctactatgttgctggaactgtggggctaatgagtgttcctgtgatgggtattgcacccgagtcgaaggcaacaactgaaagtgtgtacagtgctgctttggctctcggcattgcaaaccagctcacaaatatactccgtgacgttggagaggagtaagtgtcaatacagtggttttcactaatggtcataagctgtagaacagaatgtcggcatatatatagttcactgatcctaatacttcattttattttcacagcgcgagaagagggaggatatatttaccacaagatgaacttgcagaggcagggctctctgatgaggacatcttcaatggcgttgtgactaacaaatggagaagcttcatgaagagacagatcaagagagctaggatgttttttgaggaggcagagagaggggtgaccgagctcagccaggcaagccggtggccggtaagaagagtcacttgattctcaaggaaacataaagcagattattattgtcggtgcttctatgccatggtgtcaaaaggaaaataaaatatcattgcattgccccgttgcaggtctgggcgtctctgttgttataccggcaaatccttgacgagatagaagcaaacgattacaacaacttcacaaagagggcgtacgttgggaaggcgaagaaattgctagcgcttccagttgcatatggtagatcattgctgatgccctactcactgagaaatagccagaagtaggaggcgggaagaggagataaagggaagatgatgagcaggttaggcttagataggaaaaatcagacagcatctgccttccgattaatgttgaggaaattatattattgtgtgtatcatacatagcatgtatagggaaaatgctgcaggcaggcaggcaggctaggtgatggttgaatatttccttcacatcatgtatgtatatccttccttgatgctacagcacatatgtatgtatgactctgaagaaagagcaacctgtatagtagctaaccggctatggcctatgtatgggccgcagaggtgagcaaacaaaaatcatcatccatggattgattgattgattgattgatacagtactactaaagcaagcatacatacattatccagggaaaatgcagaatgagtaacaaacttgagagagagagagagagagagagagagcaaagcaagtactccatgagcgaacaagtcagttggtcggttgacgaaggagattgcaggaggacctcacctcaccatgtggagtccgtggggcggcgcacgctgtggcctggacatcactggccggcaggggattattggggttggggccattccttcacacgaccggaagaggagggccagccgccgccgccgccggcggcggtggcaggagtggagtctggagggtgcggagagttcatggctgttgaagttgggctttttttagtttgggcccaatataagctgtagcatgaattcccgcgctttatgggtttgggcgggattcccttctccgtgtcttcatttgccaaaaagctagcactagtactatagctaaggtggtgttcttttggtggtgtttgagttcctatttggatcagggattgaagttttagtacatgtcatatcatgtcatatcggatgtttggatattaattataactatcaaacgtagattattgacaaaactcattccataaccctggactaattcgcgagacgaatgtattaagcctaattaattcatgattagcccatgtattgctacagtaaacgtagtctaattatagattaattaggcttaaaaaatttgtctcgcaaattagctctcatttatgcaattagttttgtatttagtctatgtttaatactttggattagcgtccaaatatctgatgtgacagggacttaaagtttagtccctggatccaaacaccacttgaatcttctgaagataaaaattaagtgtttcacataaaacaatgtggtaataacatgtgattaattgagttttactccctccgtccccaaaaaaggcaacctcgtatttgatgtgacattttctagtacaacgaatctggaaaggaaatgccacctccaatactgggttgtctttttttggatggagggagtaattattacaaacttgaaaaatggattaatctgatattttagaacaactttcatataaaaattttcacacgaaacgcatcgtttagcagtttgaaatgcgtgtcacgaaaatccaaaactttatccactacttgtagtggaaacgaacatgacctttctcctaaagacgaagattaagtttttttacgcaaaaaagactagttctacctacgaacctggacacgtgtgttcaggttcctagctaggaattcctttttttagagaaagtagtaatacttaattaatcatagaaaaaaagtatgaattaccccctgaagtatcaagtgagtacgagttgcccccctaaaatagaaaaccagtcatttttcacccttaactatcgataccggatgaacccacccccctctcccccccgagcagatttgtaagcgtttttggtctgggtggcaacctagtcagcaagttttttattaaaaaaaaggatagggcccacctgtcagatatctcttctctctatctctttccctctcaccccctctctctctcccgtcagatgccggcggttgcggctcacgcgctgacagcagtgggcgcctcctccgctcaccgccgtcccctcctcccgcggtcgtcaatttcccctcctcgcgaatgcctcgattttgccggttggtgcggtcatcgaagcgcacgccgaacgcaagaaggaggtcggtgttgtcgacggcgtagttggcgtacactgtgccatgcatcccgagcatccgcagggagagggggccgtcgctggggaagtttccgatgcccatgagggtggtcgtcaacgggatgcccgtcagctccacgaagcagcgcagttcatcgccagacgcggagcagccgccgactgatgtagaggacgggttttctggcgtcgcggacgagacagatgacttcgttgagcaagttg

SEQ ID NO: 28869 - DNA, 1238 bp, Oryza sativa
ttatggtgtagtagtttcagaagtagatatctgatatcataatgcactattacagtcagtcttaagcattcatggatgtttaagatgttagtctttcagaaatcagaatcacctggatggagtaccttaatttgcctggcttacaatctagaatagtgtttttgcttgtgaaatggtaggtaattatggagacctaagagatggattccatctgtgtaggagttggaacttggatttcttttttgctataatactgtctatgttgctgctaaaaataatccactgcgtgtaatagctacggagtacaaaagcaagcccaatatttttttcagcttgatcaactaggtacaagatggaaagctagtgcatgtgctgtttgcagctaatgtttaagtaatgtatactccattttacacttgtgaaggtctttttaagtgaaatatctgcggctgtcgtgatgcccgtatatacggtcaaatgtattgaatatcagaaagcgaagggtataaagaaatggaggaaaaaagaaggcaagaaagagatgttgcataaacgctctccattaaataattcagctttcatccgtgacgtttcagatgaaagggcagggaaccaaaaggcaggcaaaggtgtgagtgaggctgactagcatttcgcttgctcttatcatcttaagatgatggccggtaaacgttcctgaccagacaaggccccgtgcgaaaattcgatcaatcaatctatgagtggtaacaggaatctatctgatagtatggtatctgtcaagagattagttacttgttgtgcttgtcagcttcatcctctaggtaaagcctgtggtgcattgcatatgtacaaaacctcagcttgaagcttcagttgggaaaacagaatggtataaaacttcagttcagctgggagtacaaacaggtagcgtataaagtagagtagtacacatatacacacacgcagatggagtggttggatggatggatggatcatgagcagtgatgagagacgtactacgcattagcacttgcagtgtcaacgtaaagttgatggcactggcgccttgcaatttccctgtcctgatggactctctgattctacgcttcaacgactttatgcttgatgtggttatccattattataactaaatgttgttgcaacgcctgtgttaatttgtttgcctgtcatacatacatacatacatacatacatacatacatacatacatacat

SEQ ID NO: 28870 - DNA, 239 bp, Oryza sativa
  unsure (1)..(239): unsure at all n locations
nnnnnnnnnnnnnnnnnnnnnnnnnnnnnnnnnnnnnnnnnnnnnnnnnnnnnnncgctcgggcgccggtggttgagacggaggtcgttcgtgtggccggcagcaaaggcggaggcaaagacaggtagcggcgcacgggggagggccagcggtcggcgcgcgtggcccgtgggaaggaacgcggccgcgatggtgagcagggcaaggatcgcggcggaggctacccggaggagcgggcg

SEQ ID NO: 28871 - DNA, 679 bp, Oryza sativa
taccgaaaagcgttggagcttcaggctttccttgacatggccaaagatgatggtatttctaatagttcagtctatatgttctgaactttcctctgtgacctatgcaatgactcatcttcctgtttccattagatcttatggaaggttacagagcaactgaactgatgtctgaggactcgcaattgatgactcaatgcaaagctatagctgacatgaaatttacatatgttgtctcgtgccagcaatatggaatccagaaacgttctggtgaagcctgtgcgcatgatattttgaggctaatgacagtgtaagtttttctttcccttgaatgcgcaggagagctgttgtgatagtgtaagttttaatcaaatattgcaatgatctggatatatgttatctgtatgtagcacaaattgccttttttttcttgctttatttcttttataatttatgcaatcaagttggagcacacatgattgttcttagtgcaacagtgcaatcgagtgtctttctgtgagtatatgtgaattgggttaaaacaatgagtaccatgtgcattatttttagtagcgagtaatgaaataaatggtagctttgttatttactatgctgggagtaccatgtgtaacaatttgtatcatctaaattcatatctattgaagaaacaacaaaaaacaaa

SEQ ID NO: 28872 - DNA, 1414 bp, Oryza sativa
tgattcagcaacgtagatctgcattcaagttgttacaaacatcatagctaatcagttattgagcctgataacattatttgttcacttttcatgctatgccttaatacaatatgggtacggtttgcactgttaattcctgccgtttgggagttgacatggtttaatttgtgtttgctggatataggtaatgcacatggtttgggagttgaagccttgcgaatgctcatgcaaatggtcctcaccaatgaggaagagcttaaactgaaatatttcaaagatgatctatccaccaaactttgccctgtggaagcttttctaaaggcagtgctggatattccatttgcgttcaagagaatggatgctatgctctatgttgccaacttctatttggaggtcaatcagctcagaatgtcatatgctactcttgaggtatagttgagcccttggttgaatattttgtacaaattgttttgcaccctttgttgaaagaagcaaaacaaaactttcatatgcaattgggtattatgcatatcaatatttacacaaatgatttgaatctgtgaacggaatagaccctcacttactgtttccttggttataggattactcatctctgagggtttcttatcggttttcatacaggcagcttgccaggagctgaaaaacagcaggttgttccacaaggtccttgaggctggtttgaactttggcaacttgatgagtatcgatacaggatctccgaattcacatgccatggaacccaacactctgctgaagatcgttgatgtgaaaggagctgatggcaaggctgctctcctgcaatttgttgtccatgaaattgtgaaaccggaggccacagtcccgtgtgcaaaacgaatgcaaatactactcagcagtatgatgtggaatacagaaaacatggtcttcaggttgtgtcaaaacttgcggctgagctgagcaataccaagaaagcttcatccatcgatatgatgaagctcagcagagatgtttcagagctcggcgtagggcttggaaagatccacgacgtgttgaggctaaacagcatggtgacctcagcggacagcgcgaggcggttccacaacacaatgagcatgttcctgaggcaggcagaggaggagatcctgaagctccaggcgcaagagagcatctgcctgtcttgtgtgaaggaggtgactgagtacttccatggtgaattgagcagcggcgacgaagggcacatggcgagagtttttggcagtgtgagggagttccttgccatgctggaccgaatctgtaaagaagctggagaggagatgaagagcagcggctgtatgatgggtagagactggaatatggctgccccaatgggaatgacaacgccttgagctgcagcaatgctggcatatttgttatg

SEQ ID NO: 28873 - DNA, 709 bp, Oryza sativa
ttacttataggttaaatagatgataactaatggatttttgtgtcgtgatccggtttatcgcatctagagatgcaagtgggtcaatttatgaactcatttataggttaagttaataggtaaccagtgagtcaaacccgcgggttacccactaattttgcctataagcggatttgctgataagcccgcttgtaaccctagtgagttaaacccgtgggttacccactaattttacctataaacggattcgcggacaaacccgtttgcatccctagagaggaggggatagggaagaaagtagagagagagaggtgggatggcatatgccccctctctatttttcaattcctatgatgattggactgacggcaatgttaaccaatatccccttaatattattttagaagtcatttttattacttttaatagttaaaagagtcattatatctgattttagtaggtaagatctggcctatatttaagagagttaaagtggattttttttcctaattttgtttcaagtttgtgggcataacaaatccctgggtctttctccaacctacattaaaagctaatgctggaaagtagagtatgatgagaaaaaaaaacaactctaaaattaagttagaaataaaaatttggacagaactaatatgctgccagctttgccataccatgaaataccggtgcttggttggtttgcttaagataa

SEQ ID NO: 28874 - DNA, 1157 bp, Oryza sativa
ctactgctatattgattatatatcttataactcaccgtcacatgattcctttcccccctagtttgtcaagaagcatggaaacgaagggaaagatacatcgtctaacaccgatacacacaccgctcagctattatctcaggtcaaccatctcagacaggagatacaatctctaggatcaaggcctgttacagttgtcaccaatgctgctagatcaggtaagttcctgctgactagttactatgttttagttacagacttatgcatgggtcacagatcatacaaacataaatttcacatgacactagactttgtgtatgccccgatgtcgacatctcttgctaagaattaatgcgattttagagtgttagatatttctattacctttcgatttttttttcagacttggtctgttgtttttatatctacatgttcgacagagctacaattgcgttgtctgttcatatacagagtataccattttgcgattcagttcacatgttcttttctttttctttccttattattatttgtcatggtcttggctatgcactactgattatcattatattattcgctgcattataaaggttcttggacacgtgatagtttttataattgctaataaactttcatcatgctcttttgcctttaaacatacacaattacatatgtttgcccctctaggttacacacattctttctcaaatgtccttgaacgacattcatgtaaatccttcttctgtaggacctggtacatttactataacagcggtggttgttgctggggctgttggctacgcctacattaagtggaaggtaatgtttgattctttcacctcaatggaagtacagaatgaggaggacataatctttgattattctagttgctatcttgatgtttattgttctgtccgtcattctagatcatggacgcaagtgcatattattacaatcctatctgcttgccatttcttgtttcactgttctagctagtttctaaagttacatagatttgcagggctggaaactttctgatttgatgtttgtcacgaagcgtggcttatctgatgcttgcaatgtagttggcagccaattggacaaggtttcagatgatgtcactgtaagtttttaacttctttcagcaacgctgaactcaa

SEQ ID NO: 28875 - DNA, 538 bp, Oryza sativa
  unsure (1)..(538): unsure at all n locations
nnnnnnnnnnnnnnnnnnnnnnnnnnnnnnnnnnnnnnnnnnnnnnnnnnnnnnnntaagtgagggtctattccgttcacagattcaaatcatttgtgtaaatattgatatgcataatacccaattgcatatgaaagttttgttttgcttctttcaacaaagggtgcaaaacaatttgtacaaaatattcaaccaagggctcaactatacctcaagagtagcatatgacattctgagctgattgacctccaaatagaagttggcaacatagagcatagcatccattctcttgaacgcaaatggaatatccagcactgcctttagaaaagcttccacagggcaaagtttggtggatagatcatctttgaaatatttcagtttaagctcttcctcattggtgaggaccatttgcatgagcattcgcaaggcttcaactcccaaaccatgtgcattacctatatccagcaaacacaaattaaaccatgtcaactcccaaacggcaggaattaacgggtaccgagctcgaattcgccctata

SEQ ID NO: 28876 - DNA, 651 bp, Oryza sativa
ggttaagtgttagaaaatatcaaaggaaaccttgcggtgtgtattcatactctcatgatctccatgcagatcaagcctctggtacagccaaccaaagatataatgaaagagccgatccgggatttccagtggcatgaatttttccctcgtggtacttaagttgaaaactgatgtttttaccttttggaatttttggcacacttatttcaatctcaatttgcattttgcagctaacaataacattggtgttgttattgcgctgtgggctccaataattcttgtgagtgttgttcattgtttcctgttaacaaaagttgattagccaatattttgagttttatcaattgatatgtccaggtctacttcatggacacccaaatttggtatgcacttttctctacattgatcggtggtatctatggggcttatcgtcgtcttggtgaggttggtaaaatgttttgttatcaggcattcattaagtcattttatgactggtttgatttgttggacctgctttctctgataaaacagttttcttgtctaatataccgcgtactgcatccaatagcgtataagaaaacaatgttcttggactgatgttattcacagtgacatctctacgtttaagctacctttcccagttatattttg

SEQ ID NO: 28877 - DNA, 764 bp, Oryza sativa
  unsure (1)..(764): unsure at all n locations
nnnnnnnnnnnnnnnnnnnnnnnnnnnnnnnnnnnnnnnnnnnnnnnnnnnnnnnttgcaagatgctagcgctgctttctcaaaaccagattgtgagctcccatctccatcagctgagccgttgctacctactccagtatcaacactggagtccttgtcatatactagttgcatcataggcaatccatctttctgttgcaagtgattctttggcaccatgacaataccgttcttaggagcatggtagttccctgatgactgagaagtaccctggtcagaagataaacttgtttgttggtacagtattgatgtttgcttcttgtacttatatctggaaaatgcttgacatgagtttagtgcatcattttctttggcatgctccatttcaattctctcgtctggtgaatgctgattacatgcttttctcctctgatttattttcattgaccttgttagattatgttgtgcaaccttgttaatgttttcagtacatccttgttctgaatagctgaatcaaccatacatcctgctctagatgtgttctccacattaagtttttctactttttgccacacagaagttgaactgtattttccactatgcttgttcttattagtgcctattactccattagttgcagtcaaactgtagctagatatttcctttaatcttgttctgctcctcccaggaataactggaagagaagtcttgctgctgcaggcttcactactgcacttgactctttcagtatgattactgctatc

SEQ ID NO: 28878 - DNA, 1327 bp, Oryza sativa
gttcatcaaaatttcagaacagaacgtcaagttgatgccttattccaaccattcaaagagtagcgtgagtataaacgaggatctgtcagccaatagctcgattattgccggagtccccaaaattcacacacaaaataaacaactgactcaagctggaaatcctcatattcttcacctaccgagccaccgatgtgtttcgcagctactatgatcaatcgtgtcgtccagatagaggacacgtcggtagtggcggcggcggcagctcagatcgaggaccggtgacggagcttatctatggcgcccctcggcggcgactcataatgaatgaagccgccccaccggcgacagttcagatcaacaactcccctcggcagcgcggtggcgcagactgaggacaaccccggcggtggggagtggaaaaaggttttgacgacaacggcggaagcgccggggtggtggcttgaggaagaggcgcccacgaaggcgatgtgtttgggcaccgcaatgcccaagccgcacgacgacacagcactagctgctgcagcaaagcaaaaccacacccacgacgacgcggcggcggtagcggcagcggcggtggcggaaaccaaacgaccgaaaaaaaaaacccaaatggctcgcccgcgatcgccagcgcggctgctctcaacctcgacggcgacgcccacctcttcacgtcgccatcaaaccgagcacacaggaggaaaaaaaaccgagcgattcgattcgcgagggaaaagcatcgaagcttatttgcgggggtgaagccaaaaaaaaaatgttccaaatccacaggacgaatctctcaaccagacgacctcgagacgcaagcctcccctcccaaatggcggcggctgaggcgtaggcggcggcgagcgaggccaacgaacggaagggacgatgaaccgaccgcgccgcgaagaaatctctgaaatctcgtggattcggtggggggagaaatcgatcaatctgtggagacaacgtgtcagagaaagagaaaaaaaaactggtaaccacagcgtgtagctgtagcataccacctcctccttcgacaccagccaaatcatacactgcagcgcacgatccatctcattcacacaaagcaaagcaaatccccggttcaggaagcaggccccacacgccatggccccaccaccactgacacgcgacgaaaacattggtctcgctctcacgcgcccacctgcccatgttagcggagcagacattttacctcgaacatgccgcggagacagctcatccatgatttcctcccccccctcccccccgatttctccatcggattctaaaa

SEQ ID NO: 28879 - DNA, 873 bp, Oryza sativa
gagacatacaacatatagcactcagatctgaacaaaatatcaaaaaatggcaaatatagcactatcaaccattcatgcacatgcttagaaactactatagcactcaaatctaaacaaatcaatccccaaaatacaagtagtatgctcagatttgtagtataccttgatttgaagaggaatggaagaggaatggaatgcccagatttgttgctcgttgcccccgaggtccttgccgcctgggccgtcaggagagtcgccgccctcgccgtcgggaaggtcgccgccgcgccgccgggagtcgccgcccgcgaccgcccggagtcgccgcccgtcttccactccgtcctcgagtccgcctggtgcgccgccggaaggtgtgtgcagaggagggaggagagctctatggctttggcacaaatgaaaccggtgagaagagaggaaagaaaagggggaaagggacgaaaagactaatggcgatcgattgccccgcgatcgggcgatcggatccccttcccaccttttttttttcacaccacattcttttctgttttagtaattttatattacatctaaagtttatacacctaaaatttacacatctgagcgaatgtttataagtcaaaagggtatatacccgattcaaattcgaatttgaattcatatattttttatatagcactacattacttttctgttttggtaagtttatataccgaaagtttacatatctaaagtttatagagaaaaagtttataagtcaaaagtttatataccccgatttaaattcgaatttggattcaaatatttttatatagaatatattttatacgcgcaaagttttacggtataagatctatgcacgtgaataagggt

SEQ ID NO: 28880 - DNA, 4893 bp, Oryza sativa
  unsure (1)..(4893): unsure at all n locations
ttgtttacaactttaaatataaaaaaacatgagtaatatgtgatgttattttataattattacatgaataattatataaaattattgtttaattggttttactttcgtggattatttttatcgatttttgtgcttgtcatgtagatggatcggcaatagatgtacgcggatcgacggtcgaaagagtttatcgacgatgtgcattattttctgagggtggccgaaactaacaagcataagggttttacccgttgtccatgcactaaatgcaaaaaccagaaggagtattctacatcaagaactattcattttcccttgtttgagacgggcttcatgccgagctataatgtttggacctcacacggagagctaggggttcaagcagaagaagatgaagtagaggacgagaacattctggactgggctcattatggtggatttgaaggaaacacaacggacgaggtggacggggctgttgaagataacgacgctgcaaatgatcttggtcagatgttgcgggacgtcaaggaaaactgcgaaagtgaaaaggaggtcaagaaattggaacgtatgctagcggaccacaagacgccgttgtacccaggttgcgaacaggggcacaaaaatttgggtaccactcttgaattcttgcaatggaagacaagaaatggtttcaggtttcagtgacaaggcatttggcgagttattgaaactagtaaagaatattctcctggaggaaaataagttgccaaaacaacacacgaagctaagaagatagtctgccacgaagctaagaagatagtctgccctctaggactggaggttcagaagatacacgcatgtccgaacgattgtatcctctatcgtggtgaggagtacgagaacctagaagcatgcccggtctgtaatgcactacgatacaagattagacgagatgatccaggtgaagttgacggacaaccttcaaagaagagagttcctgctaaggtgatgtgagttacattactttttagcagaagaaggctggttcgggaggtgaggtcccgtgcacgcaaaatggagcggcatattttcttatgattatttaagtatttactaatttttaaaaaatggattaatatgaatttttaaagcaactttcgtatagataatttttgcaaaaaaatatactgtttagtagtttgaaaagcgtacacgcggaaaacgaggaaagtgagttgggaaagttggggaaaaaactcagcctcattgacgacacgagcataaattaatcttcgcggcataaattaatttaatcacttttaatcgacagctaatgacgctaaattaaaaataatggtcaattaattaattaatcaatcaatcgcgtgagtattcngctccaaactcgtcgtaagtttgccaagtcgtgcactcaccacgtgaacttgccgcgaattcgcatcactcctatgcgacaacgatatcattctgcctattcattgtaaacacgtatatttctttaaaatcaatgaagaaaaactatttttctgctaaaatcgttgctcggcttggctcatttgttagctaactcgtttagtgcgcgagaaaagcgatgcagatgacgagcgagcaagctgtagtcatgacgatgcttaaactagagttatgaccaggtgctatttgagtgctcataggcaatgggtgtgcgcgtgttgtgttcattcggtgatatgactagcataaattaaatttttgtgatataaaaatgatcttttggacccatggactttataaatgtaatacaaatgtcggaatatctaggtcatacaatgatcgaagcgtgtatttcttatgtattaaatgcaaatgcttattgaacaatttgtaattactagtagcatgcctgtgctaatgcaacggtgatatttaaaacgtaaatcaaacatgtgcgtacaagtatacatgacagatgagtgatatgaagaaacatacatgacttaccattgcctataaattataaattatatattgaaagaatataagaacatgatcttttcgcttatacctatgttcataagtcaaaatttgaaatttcaatcttaaatttggagttgattttaagattttttttcatcgtagtttattttttagcttttgcttttagatcgttatgaacacgtatataaaagttttattcacaaattatttttcatttgcaaatatgccgtttagtttattcctcgaaaaagctaaataatggcaccgaaaatttaggaaaatatataaatattagatttattatttcattaatacataaaacatctttaaaatgctttatcatttccgtagtatgaacaatctccatctgctacaacgtacacgcagcacactgagcctagcattgcttctgttctccttaaaggcactaaacaaacataatattaggacatccaagaagtgcccctgcttaaaaagtaggtcaaaatccttaactcttatctcacatgagtttattatggaggcgaagaacacacaattcgtttgaaatattcaggggaaccttagatattttttttctcttcaataacaatttgtttggtcagtgtacctctacaactgcagcttcatatatagcttatctctaattcctgcacactaacagctgttaggaaatcagaaacagccttgcttactacaaattttttccaaagactataacttttatgtacaagatttaccaataattctaaaaaacaatgagacattagggataaaaaaattggaacttgaagataaacaactgttataagcaagagccgcttgaatgactaacaaatgaacctccatatactgaaggtgatgctcaggatgcattcataattgccaatcaggtaattttgtattgctaacaatgctcagttgatgcatctttaatcaaagtcagttgcttggaatctgtgtagaaataaagggaaacagtcaatacagtaaattttgccatcaaaactgaatgatttttgtgatatcacttacaactcatatgactacaatttatttgtaccatcagagatacattatctgcattcaaaaattttgaaacaacataaattgaatttctgaaccaatgcatcaccctcaacaaaactgaattaaagtatttcagtgtattacacgtgcatagatgtaaaagcacaaacatgtattcaatggaacctattttacttaggtccaagaaatctcctaatagataaattagaatcaaattaatccttagcattatgtgcatgtgctacacaaataattacataaagagtccaaacttaactttacacttcacaattaattgtctattttttgacagcaaaataaacataccatactgtctttcagagctaacaactaaagatattggctcatgaacaatcaatgttataagaaaataaataaggaatcactatgtcccacaggatactgagagtctagatggcattagcgttcagcacttccctgcagggaactgattttagatggcattagcattcagcacttccctgtaggaaaccgacagaggagttcaatttaaaccaataattctaaattagaccagttccaatggtgaccagatcagcaagtcttatgcacttgaattacagacaatgatcaccccaatccttctcacttatatgcaatcttgtaatttgatatacttgaattttaatccagtaacgctgaatgaaaataatatatacgctcaaataaacatcttcaaattcaatccagtacatagccaaagcaaacaatagcaaaaagattggaggcttggagcagattaccagattgagttctctcaacagaatttctgcactcccctgtgttatatgcctgacattgcaatattgtggcattcaatcatagcctacataaatctttcccacagggtaaaagaatatatcagaaggcaaacggagaggggatgttagacatatttggtctgtatacgctaacattaatcaactcactccgctcaaatccacatgcaagctggactgtctgaaaatacaattggaccataggaccagcgacgggaaccaaactcactacaaattaaggaaccatctgttaaatttttgagatagataagaaattagtgagagcacaaaacctaatagattgttgaggaaatatcataaataaatccaaatcaaaggtcaccatacctgacaactgcactagagcttgtattttccagtgagaacacaaacatacggtgtagtccaaatatatcgtctagattaatcttaatgaagtcctcaacgtatatcttctaccactgacaccacaaaatattcaaatattctcctattgtataatgcttgaaatccaggttaatcataacaggtcaggaaataaactgagtattgaaggtattctccctctagcacctctcaaatccttatcaccgtcttaacagtaaataatatgtcacaatacacacatagtatatgaagaattgcaccccaaccattccaagtatatgaagaatcagtccatacttttgcccaaattcacttttatattcctgtttggttctatcagctttcgaaacttgtggccgttgttaagaatggcttcataattataaaggaaggcatgccacattacatgtgcacgattactcaatgaacaaatcagatcaccttacaccatcattttctaaagaccaattccataactgatgctacctccatcattcaggacaaagtgtttcacaaaaagctgaggaacttgattttcttgttgtactaaaaaatgtaaaaaaataccaggtgttttgaacataatatgtttcagcctttcagataaatgatgataaaaaaaaggcagtcataatatgttgattgaccaaaatat

SEQ ID NO: 28881 - DNA, 735 bp, Oryza sativa
agtggtgtccacaactccgccagttaaggtcagggttgttgataaacaacttcctgactgtgttggtggcttcaaggtagatgctatcgatccaattttaagctaatacctctaaatgggtatgatgccatattaggcatggattggttggaagggctgggggtcatgaaaattgattggttgcagaaatggttagagtatgaagaacatggggaaactataagaattcagggggtatttaataatgtggctgaatgtcagatgatttctggggctcaactgagaggcttgtgtaagatgggggctcttattttgccgtcgaggttgagagcagccgccccggcgatcgcgggcgagccatttgggttttttttcttccggtcatttggtttccgccaccgccgccgtcgctgccgccgcggcgtcgtgggtgtggttttgctttgctgcagcagctagtgctgtgtcgccgtgcggcttgggcattgcgctgcccgaacacatcgccttcgcgggctaatgccttttttttctcctcaggtagcagtgaccaacaaaacaagtagagattcgggtggtgcttttcatttacgcgtctgttcttcgccctggatttacatgtgtcagcttctgtcttctattgggatgtttgttctttgtgattcagttgcttttagtgtgattcctgcactagcacttgtgctacctttctgaaatttttcgacttgattgagc

SEQ ID NO: 28882 - DNA, 689 bp, Oryza sativa
actctagaggatcccccagctgttgacgcgtggaccgaaaaggagttttcgggttacagccgagtatatatgaacctacagggtcgcacgcttaatgggccggaataaggggattgcatagagatccaatatgagcttaattcggatagggatccgaataggagtcctacgggccttggaggcccgagtgatagatcctatatattcgtgaggggtgtgaccggcagaggcattgcatcacgtgagaaaccctagccgtcacttccctccccgagtaaaaccctagccgcgcgcgggtgctagcacatctgcgcgtggcgttccgtccctgtacgtgtggataccggtagaggcgccgctggtttgcggtgctgatcggcgtgggagtacggcgaggagaacgcacgaggaggagaaggtcgagccggtgcgatcgactacttcctctacatcgacgcgcactgcttcgcgagagtttcttcgacttctcagcgtcttcttccgctgcgcagcgcgtcgagtggtaacgatctatgatctaatatttgcatggttcctggtttacgtgatagaaaattttgatttatgctatcgtagcctacgcgtatcccaacagacagcataatgtagcttggtgctctggcggcttggctgatgttcaaagtggatagtcggtgtcttgctcgttt

SEQ ID NO: 28883 - DNA, 646 bp, Oryza sativa
cggcgtggaaaaaaaggaggcggcgccggcttcttcctgcgattggttgggcagtgatggcgtgaggacgtggcggccgtggaagagttgggcggcggagtagggcgcacggtacggcatcgacgtcggcgtatgaggtcagcaggtgacggtggcacaaaccacggcgacggcgacgctgtgggcggcggcgcactaatggcgcacggcagcggcggctgtggcgctacatgcgcccacaggaagaggagggaggtgggaggatgcggctcagcagtctgggccggcttgggccgcgtgagtgagagaaattcggtccaaagttaaaaaggaggaagtctaattttcctagagattcaaataattgatttagaggaatttggacggctagattttgaaaaggatttgaattcggagatattgatacatggagaaggattttaaaataaggatgctctaatttatttgagtgcaatattttgagagatagaatataacgggatttatttaatgcactcaaatgagagggaggggaaataaataggatgttagccgcaaattatttggcaaggattttggggaagtatttgaggctaataggggacttggattttggatgaaaagataaaacctattttcttggcac

SEQ ID NO: 28884 - DNA, 645 bp, Oryza sativa
  unsure (1)..(645): unsure at all n locations
gaacctagaagcatgcccggtctgtaatgcactacgatacaagattagacgagatgatccaggtgaagttgacggacaaccttcaaagaagagagttcctgctaaggtgatgtgagttacattactttttagcagaagaaggctggttcgggaggtgaggtcccgtgcacgcaaaatggagcggcatattttcttatgattatttaagtatttactaatttttaaaaaatggattaatatgaatttttaaagcaactttcgtatagataatttttgcaaaaaaatatactgtttagtagtttgaaaagcgtacacgcggaaaacgaggaaagtgagttgggaaagttggggaaaaaactcagcctcattgacgacacgagcataaattaatcttcgcggcataaattaatttaatcacttttaatcgacagctaatgacgctaaattaaaaataatggtcaattaattaattaatcaatnnnnnnnnnnnnnnnnnnnnnnnaaactcgtcgtaagtttgccaagtcgtgcactcaccacgtgaacttgccgcgaattcgcatcactcctatgcgacaacgatatcattctgcctattcattgtaaacacgtatatttctttaaaatcaatgaagaaaaactatt

SEQ ID NO: 28885 - DNA, 407 bp, Oryza sativa
ctgcttcacatacacctcctctgccaaatctccattgagaaaggcagacttcacgtccatgtgatggacgtgccaccctttttgggcggcgaccgcaagcaggagacgaattgactccatgcgcgcgacgggcgcaaacacctcgtcaaaatcaatcccaggttgctggacaaatcccctggcgacgagacgagctttgtgcttgaccacctttccggcctcgttcttcttcaatttatagacccatttgagtccaattgggcgatggccatgtgggagatcaacaagctcccaaatcccattgcgattcaccgcgtccatctcttcacgcatggctgctcgccatgcatcatcaccctccgcctatgcaaacgagcatggctcaccaggtccagcgaggagcaaag

SEQ ID NO: 28886 - DNA, 147 bp, Oryza sativa
ccttgatgtctacgatggagctgtctccaaatttgacggtgccggtgatgcttcgatcgagctcagcaaagacgtcaccacggcccgtcatgtggttggtggctcctgtgtcaaggtaccacgcctccttgtcctcagcgtccgtgg

SEQ ID NO: 28887 - DNA, 597 bp, Oryza sativa
  unsure (1)..(597): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaacaaccgggcaagatttcgtcttggaccgccaagcctcctttgacccctttcttcagtcgtttatcgacttcatcaacgatctccgagtgcggggcttgtcggggtatgaagtcgttgcggacttcgttggtaggcggatccagctgctccaggctcgggcccatctagcctttaactattccaggcctgaggacgcgacccaggtttctcctcggggtatctttctcgtatttatcttgacatactcacgttcgcattcctcttgatttatcgaaacttggtcctcgattcacaggtttgagcagtagggccgtggagcgccaagtcgggnnnnnnnnnnnnnnnnnnnnnnnnnnnnnnnnnnnnnnnnnnnnnnnnnnnnnnnnnnnnnn

SEQ ID NO: 28888 - DNA, 535 bp, Oryza sativa
  unsure (1)..(535): unsure at all n locations
nnnnnnnnnnnnnnnnnnnnnnnnnnnnnnnnnnnnnnnnnnnnnnnnnnnnnnnnnnnnnttgcaagttgaatggcccaatttggagttcgaatgaattagatatgaattttagaagttctgagccatttaaatgaatttctataattaataccaatttattgcgcaattattaaatatttttccaaaggaaatgataagtgctgacgtcagcaaaggggaagggtgccgacaggtgggccccacacgtcagcgggtcaaagggggtggctcatggtggactcggtccaccgcagcacaggcgcgcgggcacaccacgtggaagaccacgtggcggccacgacggcacggcggggcgaggtggcaaaggcatggcgccgaggtggcgccacgtgggacaccagcgcggggcggcgccagagccacgtggacgacccggatcgccccgaaggggatcgggcggccacagctagcgggaacggcaaaactcgccggccgaccggccggggtaccgagctcgaattcgccctatagt

SEQ ID NO: 28889 - DNA, 1405 bp, Oryza sativa
  unsure (1)..(1405): unsure at all n locations
nnnnnnnnnnnnnnnnnnnnnnnnnnnnnnnnnnnnnnnnnnnnnnnnnnnnnnntgagtgctatatgttgtatgtctcaatatatgtgtgtatgaatatggcagacctgatttcgtatcaaactttggcattgtagatggacagcagaacaaggtttctgatttatgcggctgcatcgtatatgttgctgccaatgatggctatggttattgagtctagaaaaaagaaaaggaaaagggttccaaggagagaagggattacctatgggccaatagatgaaagggataggaaaagatttgattatcttaatgacaagatttggaaaaatgatatcatctgtgtgaatatgctttggcttaaacgagcaccttattttcgtttttgtagactttttagggatcgtggcttgcttgtggatactatatatatgtctgttgaagagcaagttgctatgttcttacatacaatcgggcacaatgttagaaacaaggtagttggcactaattttgataggtccggtgaaactgttagccgatatttccacgtagtccttcgtgctattggtgacatgagaaaggaattaataaggtcaccatcaacaacgactccatcaaaaattctagggaacccaaggtgggatccttattttaaggtatgatatattatgaagtaacaacttccactggaatgtaaccccaatgtatagtaaactataagctctcaaggtggcatgtaaaacggataaaaataaaaagaaattaggggaacacattcaaaaggtcactaaggacagatcagaataagagctggaatataatgcaagttaacagaaacaaccaaaacaagcaatgaatgcaacaaaaaaatcacaacagtaaactcaaaacataaaacaaatcgctaaatactgtactagtagaatggtagtggaaccaaaattttgtgacacattaagggcctgcttgggagtttagtttttttttaagtaaaacacctgtaaatttggattacccaaaaataacagtgaaaccccctctaggatctacttcatctgtttgtaagaactgaatcctacatggccatagcaatgtgtatggacatttgtgtctaacagaaatttcagttcataggatcaatctggaactacaaaatttgataaacaaatatattcagattgaatctcattgttcatcaaaatttcagaacagaacgtcaagttgatgccttattccaaccattcaaagagtagcgtgagtataaacgaggatctgtcagccaatagctcgattattgccggagtccccaaaattcacacacaaaataaacaactgactcaagctggaaatcctcatattcttcacctaccgagccaccgatgtgtttcgcagctactatgatcaatcg

SEQ ID NO: 28890 - DNA, 6219 bp, Oryza sativa
cggcttgggcattgcggtgcccaaacacatcgccttcgtgggcgcctcttcctcaggccgccaccccggcgcttccgccgttgtcgtcaaaacctttttccactccccaccgccggggctaccggggtgtcctcggtctgcgccaccacgctgccgaggggaattgttgatctgaactatcgccggtggggcggcttcattcattctgagtcaccaccgaggggcgccatagatatgctccatcaccggtccttgatctgtgccgctaccgacgtgtcctctatctggacgacacgattgatcatagtggctgcgaagcacatcggtggctcggtaggtgaagaatatgaggatttccagcttgagtcagttgtttattttgtgtgaattttggggactccgtcaataatcgagctattggctgacaaatcctcgtttatactcacgctactctttgaatggttggaataaggcatcaacttgacgttctgttgtgaaattttgatgaacaatgagattcaatctgaatatatttgtttatcaaattttgtagttccagattgatcctatgaactgaaatttctgttagacacaaatgttcatacacattgctatggccatgtaggattcagttcttacaaacagatgaagcaggtcctagagggggtttcactgttatgtttgggtaatccaaatttacaggtgttttactttacaaaaaaaaactaaactcccaagcaggcccttaatgtttcacaaacttttggttccattaccattctactagtacagtatttagcgatttgttttatgttttgagtttagtgttgtgatctttttgttgcattcattgcttgttttggttgtttctgttaactcagtatattctagctcttattctgatatgtccttagtgaccttttgaatgcgttcccctaatttcttttattttttatccgttttacatgccaccttgagagcttatagttttactatgcattggagttacattccagtggaagttgttacttcataatattggagtaatattatattctcaaactagtgtgtctggtttgtctaagccttgctctttgatatctgctattctgttctacaatcttctggcatgcaattatgagttagcttaacttcctgagttcaattgtgcactgctctgagagagtataaatcaataagttcagaacgtagcaccagctttgacaatcatgcgctgattcttgttaccctgttttctaactttgcaacattttgtactgctttgacaagtatttaatatttgcgagtagtctatcaagttttgagttcagcagagataataatttcgagagtatttgtttgcaggttgtcaaatgagtgactcaataatctagaaaatttatatcatgagaaaaatgtgccattcatgtgaatcggaagatgcaacaatggatggggtcgatgatggccttatctgtagtacttcttgctataatatgtgtggccatgctgacaaatcttcaataattgatggtgagattggttgtccaagcatggaaataagcccttgcaacactccttatggcactcctctttttagccgagaaagttcttgttcaagctttgccagttgcttttcaagcctcggtgagtgttgttgcactgttctcctatagatgaaatgctgtcattgatatcatttgctattttttttgctagcataactaatattttttatgccatttatttcctagatgactacctagttgaaactgactctgaagaggaaattgaggtcttagatactggccaacttcatcccggcatcttattctctgatgaatcgatggagcaaagaacagtgggttctgtacaagtggaagaatgtcaagtcagtcatgctgctgttgttgacgatgattctagtatttccattccgacaaaccagaacatttcatctggtcaacagcagttggagatacatcttgatgctaccaatgaaaattctgttccatccaatgttattatagatgcaaatgtaacggatcctcatcaagatgtcatttccaatggtggacttatagaagcatgttatggtgtaccattggatgatattgatctcaaacaatccaatatcttagatggtgaagagattactagccttcctatggctgacaatgaaatgactccactgaatgatcaaattatggaccaaattgatgatatgaaggaaattagtactatagtttacaacaatacaataagcgctgagcagcatgcaaattcaggttcagagtttgagaaaggaaatgaatccagtgaaaacctttatccgctagtaatgcccagttttgatacagaccctcacatttggttaccaccagacccagtcaataaggacgatgacactgatattgttgctaataacgatgataatagtgacaacaatgatagttgggtacagtcaagtttcaatattagctttgatgcaaagagaaacaagactagttgtgaagaccaattgcagaaagcaatgtcggaagttatgaatgggcaattcaagattcttgttagtcgttttttagctgctgaagggctctctttgtctgatggagaagctgacaagaactggcttgatatcgttgcttcactatcatggcatgctgcattacttgtcaagcctgatgccaatgttggaaatgcaatggatccttgtatgtatgttaaggtgaaatgcatagcttcaggatctattgagcaaaggtaacctaccaacattcttcctcattctgcttttttttctttgcttagtcatgtagacatgccttaactagctcccttttctatcttttttttttgacagtgaagtcatcaacggccttgtttttaagaagagcgctgctcataagcagatgcgtgccaacatgaagaatcctagactgttacttctgcagggtgttgttggccattcttctgcagggctattgtcaatggattcaatgaaacaggtgtgcatgtatgcccttagtagcatatttacattatgtacagagttatgtcatatgatacaagatatgcaaatttcttttcattgtcattgatcaggaaaacgatcacttggagaaaattctcagtgatgtaattaccaaatgcaaacctgatgctatattggtggagaaagcagtctcacgaaatgtaaatgaatatattcataaacaaggagtcactgtagttagtgacatgaatatccgtcggctggaaagaattgctcgttgcactggttctccaattttcttgttgcagaatgttcttgcaacacccaaccttattaaacagtgcgagtctctacattttgaaaagtttattgaggagcataatataactggaggaggaaagagatcagccaaaactttgttatttctagaaggttttcgaaagcctttgggatgcacggtatgttcttttcctatcttgtttttagtttgtaggtcatctgttctctttatgtaggactgatcttctcatggtggtcagagttgttctttctctgatcccttgagctgcatttagtatattctttcagtatattatttacattatatgtgttagccttctatgataaatatttttttctgccattttttttgacaaactggtatatataatgataaaatataatcctgtccatttggaatcaacaaaaatatattaattaattttgaagctaatgaatttccttattccagacttgacatcatgatttagactgaaattgattgaatcagataatataatcttcattgttggggttctgaattagaatcttaccttgcatttgtttgtgttatttagtgaaattatgttgatagaacaaaccaattagctttttaaatatacttttcccccatgacattagagcttcacaccttgttacctgcttaacattgagttatatcctaaagatgtattagtacagaaattgggacaaagtttcatagataggattgagttgctcatattgatattgattatagtatttctttttgaagaaaaaataactttgatttgtgcgacaatgttagctaatagccatatatcacccaaattgcttttaggggctttatatgttatgcacaaatgcataagatatgaattgttacaccttggatgtactaaaccatttgtgttaatgaattgaaacaaaatctaatcagcttaaaactattttgtagattttgctaaaaggatcaacaagtgaagaactgaagaaagttaagcgtgttcttcatttcactgtttttgcagcttatcatttgatccttgaaacttcattctttgctgatcaaaggttatttgcaacgggaaaaaatgccatggagaaaggcaactgtttgaaaactgatccacagctgcttgttccttgtactgctgctccgtcctccaaattctgttctgatattgcacaaaatagcgaccccacacaacatgctttgaacattcttgcttctgatggacagtatgttaatcaggatgattttgttaatccagagaaatccgtatgcatgcatgattccaaaattgaaacatctagagagcacgcggacagaaaacttgatgacagcaacaacattcagtcatattcatcattgccagttcctgacccctcgagaaatcttattggcgatatgtcgttagattttgccaaattggcatcatgtgatgactttgccggttccacctctggagctccttcaaacaatggggttctgcagacgtatggggcggatggcaaagattgtctagaaactattagtgatggaatatctacagggactaggacttctttagattctcagaacatattgatttcgatgtctagccaacatatcagaaaccaagcaatctgtgagcagagtcatctttcccgcataacttactacgggtattttgatacatcacttggtcgttatttgcaagatagtttacttaatgaggtcatacatcttaactgcttgttgatttggcagatgcttattttatcttatgatgtttcaattgacaatatattatttgcagaaacacaactgcttatcttgtggtgaacctccagaagctcacatgtactcttacactcaccacaatggcactctaactgttcttgtgaaaagccttcccttggatgtaactctttctggtaaggatcaaggaagaatttggatgtggactaggtgtttgagatgcaatggtaagcccacccagagggttataatctcttcctctgcgcgtaatctgtcatttgggaagttcttggaactcagtttctcaacacattctgctgctaagaagctatcaacatgtgggcatttgctgcatagggactgcctacgcttctttgggtaagtgcgttccaagatgctcttacctaaaggacaagtctttcctaatgacatcactaaagttacttttttcatgacttgcagaatgggacccaaagttgctatgttcagatactcatctgttgaaatatattctgcctttaagccaccattgactttggagtttcataacccaaacaaaaaagaatgccgggaagttgaatttaataatgtatgtctctccaaaaaaattttctgaaacatcctctttttagctaattacatattttaatcctaatatacttggttattcaaggtacttcgaaaatggaggctactcttatctgaagccgaaaataaaatacaaatcttgaaatcaggaggctctggtcaagccttgggggaaaacaccaaagtttcagtacatgaggaattatttttggaagtcaataggatacttgcacaagaaaaatatgaatttggggtaagcttgatatcaacttctattttgttctcctattccttcccagaagatttggatctacttttgatatgctaacatatcttgtcaacacgaggtttatccgaagacatttgacttccttgtaaaatctgggacttgtgctcacgagatccttgggttgaactggctacaccagctacttcttcttggaatttacatttgggatgtccggttgcaacatattcttcaatactgtaaagctaacgctgcatctccagatagtactatccagataaaaacaccagagaacaagccaaagaattctgaaataacttctgttcatggggacacactatctcttaccaacgttggaatggaaag

SEQ ID NO: 28891 - DNA, 22193 bp, Oryza sativa
tcagtaatccaagagcctgggtcacatgttagtccagatcatcgtgaagatggtggatcatatgaagtcgacaaatatgcacatatctctgacagtttttgtttagaaaagttaattgacttaccagttaagaataatgaattgccagaactagccagaggtaatgaaatgtatcctgttgccaagccaagcaagtgttttgatatattccttaacctatttgatttcttaagtaatgatgccagaaaatgggtctggggtagttttagtcacctggaaaaggagtacaagaaagagcttcagggtggttctttggacaagtttcatctcatcaacaaatacatccccaccttttcatcactggttcagcttaaatcccaaatggacatggtacagtttattgttggccctggtggtagtatcttgtccattgttgaggaagaggcatctagtatgattgcttatgcactattgatatctgagcaacaaggaatatattcggaagctgcaattgtaaaggatgaagttattgctggtagaaaaattgataaagtaacaccaatcaactcgatcggagatactcctgtgccatctgcaattttatctccaaatgattctttagaacaagatcataacctatcaagaaatgtgtcatcgttatcatccgaggaatcaacatctggattttatgattcttttctatctgccttaaaagatctgcatcctgaattttgtttgaataatgaaaagctaactttgaagagcaaatacactgttctgtgtatatatgcaaaacaattctacgatcttcggaagatttgttgtccatcagagattgcctatatttcatctataagccgttgtaaagaatggaatgcacaaggtggaaagagcaaggcttttttttcgaaatcaatggatgacagatttatcatcaaacaaattaagaagactgaatttgactcattcttgaagtttggccttgagtacttcaagcattttggtgtatctcaggcctcagttaaccccacttgccttgccaaaattctgggaatatatcaggtctgccaaaattttgagtacttcaaacatttctgttgaatgtaataaaaaactacttataactaatattgtaattctctctaacaaccatgtcaggttaaggaaatcaggaatggcaaggaggcaaggaccaatttcatggttatggaaaatcttttgtttggacgtaatataatacggagatatgatctgaagggtgctcttttctcacgatatgttcttgactcaaaaaatcctgagaatgtgctattggatcaaaatttcattgaagatatgcgtgctatgcctatctacattgaaggcaaaaccaaaaacctcttggagcgtgctatttggaatgacacggcgtttctaagtgtatgtgtacctattgccagaaacggatttccgctagtgtatatgtattatttttcttcataagagtatattcaggatgctagctcttctttttttgtccttttgcggcgacatgatgatagctctaaagttcacaatttgcatttcttttatttgcagcgcatgaatgtcatggattactccttgtttgttggagtggacaaacagaagaaggaacttgtgtttggaattatagattatttgaggcaatacacctgggacaaacaattggagtcttgggtgaagacatcactttttgttcccaagaacctatctccgactgtaatttccccgaaggagtacaagataagattcagggcattcatgtctcagtatttcctatcagttccagatgcttgagttgatgagttctgaggcgttgaacacactctggcttttggtggctgaacttatgttgagtatggtttggttaaatgcctgtttggcatacagtaaatcatctcatgagttcaactttaagtttcattttattcattttttcaagtgtgggtctatcaccatccatactgcttcgcagctgctgtacatagcatttaggatataggttccctgggggaccacaaattttaagcaagggagcggtgactggacctacatataaccaacatgttccttttttgatgagcattaaggtggagttcaccttttggacaactagcttggagtgttatagagaatatggcattcatgtattcatttgtgttattaggagtaggtttctggaatcaaatacatatctaaatatgtgtcaattatagcttgttggttaagcatccatagtggtatgacgtgttattgtcgtcctaaattcctaatgctatttaaatcagtcaatgtctcttataaactgttcacttatttataagttacctcctaaaagatctgtgacaggtgatcaatcgaaaaaaatatttccatgatttgttaggatttagaaaaatgagttgtgattaatctgcatatatccggacaattgtattttgttgatttagatatatggacagaagtatatttctcctgcacctgtgtaaactttggggtcaacatccaatcctacacttgtacctttgcattctttagctgtttacacaggtctcctccccaaagaccaccacgggacttgagctgccttctggtggtcatgtaagctgtcgatactgcacaccaagtggtaagctgtctagcgcttctgtattcattgagatggagatgtcgtatatggtgaatccacaaactgggtatgttaacaagcttaaggaacgggcaaagatttctacaccaagattctcatatttaccccagagcgggattttacatggatgaggctcattgctgataagtgcggtgcggtgctgtgttgtgctcatgtgcgacccggcgcacatcagcaggcttgtcaccacgatggtaaataactaccagcatggaacatttatttatcttgtatgtgtaatgtagcagaatctcttattaatacaatcaaaattagttgctagaattgttttgcttctagttgccctggaaactcattgcaaaagagcttcaatctttttgccttcttagtcacttggccatctagtaaggcatgtctgtttaaatcattgaatgtcacaatgcaacctttccttgtttcaggtttttagggtgacaaatatgtatatgtttttgtgtacgttgattaggttgatactatagttctgatgaaactattttgcaggtatcatattcaaactgagtttgaacttagtttatcaaagatcattctgattttcagaataacaaaggtaacattttgaggtatgtttacatgagcatgatataactacaaaattatattttccactagtccggacaggctgattcttaagttggatcatttccatagcaaaattattgggctatttatggttttttcctctggtgatggaaatcattctgatggactaagtaatcagcatttcttgttgttatcaactgcagtgtcttgttaatttttacaccttttagaaactgcactctccaaggggcatatacacaagataatatcacaagataactatttcttaagcagatttattggtaccattttcatatggcttgttgagaattgagatagtttccgaactttgagaaagttgactgtgaataccataacgatacatttataaatagatagagtaacttttgttacagttgtcgtaaatctctttgttgcatttttcatgttttacatgctatctcgcttgggaatgcaagcaagccagcctgcaagagggttcaacgctggcttgcttgcatattcttatgcttcgttaccctctagaattgttttatttccctaatatgggctccccagctaatgaaaagaaactccagaataatatgggctccccaaataatgaaaagaaactccagaaaggtcttctatgttgctggtgctgcttaatttggcaagttcaatgttcttaacgtccatattataatgacaatattgttccatgctccactgatacaattttcttattcctacaaggtagtcatactttggttcctgagcatttgctgtctattgatggtttgaatcttgttgcttttgcaggaatgccgtagtctctttaaccactgcgatgtggttacatcaactaacaagaatctaacaggtcctagaggtggtacaatatttttcaggagaggaaaaaattaaggaagaggactgttcttttttctcaaggggatgaaaatgaattgtgactttcaggacaggataaattttgttgttttccattcaaaacaactatgccaggacgggaggtccccatggtatatattgcttccttggtgataactctgaagcaagttgcaacacctgaatataaagcatagattcaacaagttaagaaaaatgcaaaagttttggcaacagctttgcttagaagaaaatgcagaattgttactattttagatgatggaaaatgattagtacatgccgactgctgggcgatggcacagataaccactactttgggatttaagaacttcaggcctaaccggtataattgtgcctaccattttcttaattaatttattttttaatccgtgagcacggttgtatattcatttcattaggcctccctagaaactgaaatgtcattgcatgataaacatatactccttccggtttcataatttttgatttgtttgacaatgacacggtctgtgtttttctattataaatgtaatgtattcctttcttccaaaaaagtcttatttcttttttcaccaggatcaaggtgtaaactcattcatcgtgtaacacaaccaatgaacatgcaaccaataagtattaaaatgacttattggattccaataaaaaatttaatatagcacatattgactccaaataggacttagacttttagaaaaaccaaaaaataaaataggacttagaattttggaaggagggagtatacaataaggctcccatcggatggcctaatcagtaaaagaaaaagccagattttgaattttcaaacttaattttgagattgattttgagatattttcaacgtagtttcttttacaacattggcttttaagtcaccaagaacacatttataaaaatttcatctataaatttatttttatttcctaataagccgttttgacttattaggaaataagccaaacgatggggacctaaataaatacatgtttacttttattatagagctttgaaagatagatccatatatgttattctagttcttttaaactaaatacgtttaaagttattgatagtcaaagttataaaagattgactgcaatctttgtccaaaacgttatttcctccgtttcataatataagacattctagcattgtctacattcatatagatgttaacgaatctagacatatatacgaatctagacatgtatatatgtctagattcattaacatctatatgaatatgtgagatgctagaatgacttacaatgtgaaacagagagagtaactattatggaaccagagggagtatgcttactaaacttgaaacattagtgcctgttattttcttgagttgcttaaagtcttgtcagtggcactattcctcttggacccatttgtttctatagattacatgatgtgtacatgcatatagtttataagtagtatgtaaactagatggatgggcgcgccctggcgcgccgcctgtggatagttggattgccgggtgtaaacgttaatgtcatagcattatcagttcagttaatggagtggatatggtgcaaagaaactgacttagactgtaagagtataagtgtcatattactaaggtttatgaaggtaataaaatgatcagcaacataatataacatagcaagttatacagaaggtggtgcatcgttcattgggtatatgagtaaacaaaatcgtcaatgacagtgataaggttgttcttaacaactacactacaacagtaggtgaagatgatgtctttaacataacatttacagagaaacaagcagcatatagcagggatataaaggttataaatacttagcatagtggggttgtcttacggcagctagtaggtgttgataaagtattttcatgatagtacaaggatggttcttctgcagcgcatgatcaatgcattcacgttatatgtattgttgcttgtagctgattcgtttcgtagaagtggaaaatgcagattattcccacttgtattttattggccgttgcaaactctgaccatcctgcttttagattgtaccgatcatctgttgacttgtgaagaaccatggtggttgatgtgtttcctgcagtatgcacttgatcctttgttgtcttgtgttgggtgagtggctgaatgtatttttctgagaattcttttgtgaagtactgttattaaaagtggatgttaggcatttatattgcataagagtggaatggtagtgagcgaaagatctctccactcttgtcttacttcatgaatgtctggttgatagtaacaagtagaattagaatttgcttgagtgatgcgggaatgtcgcaatatctttcacgtagttctttagttcgcttgatagctttatacttttgttgtagtagcacatatctttgacagtcctttttggttggctgtgtaaaacaaaagtagaaataatagaagtagataagtatttcagttagtatgggaaaaaatattgatgaattgcattgcaattagtatgtaaagtatttggacctgtagaagatgatccagtatgtttgttgaggctgagttggatgtggtggtttgtgtgctgtttagtcttgctagctctatctgctttttctacgtttgaccaaagcttcgtctgaagtgcgaacggagcaagaaagacctgaaaaaaaagttaaggcaatgtatgaacgaatttgaatggcaatctgtaaaaaaaagagaaagaagtggacacgtgcaattggaccaaataacagaaacaatcaaccatagccgaaaacgtggtcagaacataaaggaaagcactaaacactcgaaatggcaggaggaacaaacacgggcggtgacacagaagaagagtaggatgatgattaccaacagcagatgtcctatgaaagaacgaagctataaaaaaaacaaaacaaggaaacatatcattggaacgaatataaatataaaacggggtaaaaattatagaacaacaaaaaaaaagagataggagaatgtgcatttttttattccaaaagaaccaaatagataaatcaaatgacacaagcacgatggaaacatataatcaatgagaaacaaatatcccccgacgaacaaaaacaaatcaaagcaaaacgataagaaatggtaaatataacaaagaaaaaaaggcaattaccaagcaagaacgaaggttcacatgatgtgatgaagatggcgtacgacgaatcactgccttgtgatgagctctagcagccgatgcagatggcatgaaccaatgaaaccagcaacagcaccaaaaacctgacaaaaaaacatgaaaaaggaccatgacaaaacatgaacctgaactaaactaaataaaatgaaggggacaaaaaaaaagaaaaggaatgggaaagaccattaagagaacaacaacaacattgcaactagggtaactatcacgagaagccattcagacatacttataaaatgagagaaggagcaggaagaacgagaacgtgtacaggcatgcagcaaagaaagacatgcacagtgacacctaatcaactaacagtaatagaactcgccagcacacccacgcaaaacagagaagggatcgcatgattgacacgcaaagagatggatcagcacaaacaagacactataataatcaattttagcctctataccccaacatatctgtgtattccaaaaaaaactcacagaaaacaaaattttatcttcttcacattatataatcaagaaagacaagtactaaacgaaaaaacaacaagacacagacagaaagcacaaaggagccatagtgaaatagaaggaaaactgaaggcttaacaagagagagaacagagggagttaaccggaagaagccgtttacaataaccagcacgcgtgtgtaacacacggcgctaatccaggagattaaccggacagccgtgattagccagttataaccgcgggcacgaggaggcttcaacgcaaaccagcgacgtgtaaggcagcgaaatagccagaaaacaattccaaaaaaatgagaaaaccgggatagttaggagaattatcattaatcatagctgaaataactctgtttaacaataagaagaagaaagcatttcttggtacctcaaggccaaaagcaacattttattcttacatcagcactaacaaacgaaaacatccacttgtgtaagatgaataaatcatttttccccaactaaggtaaaaagcacagaaagatatgcatggttaacatactaatagagtgacgcatcaatgcacagtgctcaatcaagtcgaaaaatttcagaaaggtagcacaagtgctagtgcaggaatcacactaaaagcaactgaatcacaaagaacaaacatcccaatagaagacagaagctgacacatgtaaatccagggcgaagaacagacgcgtaaatgaaaagcaccacccgaatctctacttgttttgttggtcactgctacctgaggagaaaaaaaaggcattagcccgcgaaggcgatgtgttcgggcagcgcaatgcccaagccgcacggcgacacagcactagctgctgcagcaaagcaaaaccacacccacgacgccgcggcggcagcggcggcggcggtggcggaaaccaaatgaccggaagaaaaaaaacccaaatggctcgcccgcgatcgccggggcggctgctctcaacctcgacggcaaaataagagcccccatcttacacaagcctctcagttgagccccagaaatcatctgacattcagccacattattaaataccccctgaattcttatagtttccccatgttcttcatactctaaccatttctgcaaccaatcaattttcatgacccccagcccttccaaccaatccatgcctaatatggcatcatacccatttagaggtattagcttaaaattggatcgatagcatctaccttgaagccaccaacacagtcaggaagttgtttatcagcaaccctgaccttaactggcggagttgtggacaccactcctggaaaatggtgaatcatctgttcatcgacaaatgagtgggtactcccagagttaatgagcataagaagttcagtgccttgtattaatcccttaactcgaagagaatgggctgaatcagtgccattccaagcatgaactgagatggtcatgaggttgttctcctctgggttagactcaaggattgtctccaaactgtctgtttcttcctcaagttgaaatgcctctaactccaccacatgcaactggacggtctgagcacacttatggtccttactccaacgttcaccatgggtaaagcataaccccttagaacgtctataagaccttaattgagaaaccttgtcatccttgggagtagttctggcagactccaagattctcttttcctctccaggcgttgccacaggactcttctgacatacagtgccctgaactggtctagtgaaagccttggtgaagctagtaccctcagccttcctgaaagaaattttcttattcccatccaagatttcctcctgaagcatagccactgagcaagcagcatccagatccactggtttctgaatcatgaccactcctctaatctcatctttcaatccatccacaaacttggttaaaaaataaggaggggtgagagcattatcataagaaagcaggtggtgcattaagttgtcaaacctttcaacatactcagctacactgccagtctgtcccacatgaatccattgccttatcagggttgcctgtctatctctggtgaacttatgacagaccatgtcacacagctccatccacgaaatgcccaccatctggtgccgcaccgattgcaaccaaaatgaagcattaccagtgaaattcagcaaagccaccttaacccaattggctggatgcacaccatacacatcaaagtaaatttcacaattatctcgccataactgggtattctcaccatcaaattggggacaagacatgggggggacattaccaccgttgctagccataccatagtatccatatgctgatgactagaattttcaagagtgaaagggcttgcagaagtgaactgaggaaggcgatttccctgtggagtaaacaggaaaggatttggggaattaccattgagatcatcttcattcaacatctgactgggtccttggctgccttctgccttgaacaacaccttctgttgaacatcccgctggcacttctccaaccctgcctggatcgagttcactctctttgccaaatcgctaacagatccccccaactcgctcaccttctattccaccatgggtatgcgcgattccaccaccgccttcaacgactgcagctccgctagattcaacgcatcggactcctcccgtctcctccctcttcttctctgcatcctccatcatcttcaacaagagatcgagcttcccttcttgagccatgatttgagctgcttgtttcgtgatatacctaggtcgctccaggatgaatttttcccggtttcacctcgaatccagccaaccagatcaagggagccccaaaagcttttgcggaatcacactgattaacagcgaattcccacctatctaatggaattttcacgggcggaccaagggaatcaatgaaaccaggaaaggaatcgagggctctgataccaattgttagctacctaacaagaaaactgaacaagaactcaagaacagatagatcaacggggattccaacgaatttccgccgtttccgccgccaccaatcgccgcggatttctttcttatcatcgatagccaaaaacagagttttcttccggtctcacctcaccaaccctcccattacaggccaaaacataggctacacaataacacacgcttacagagcccattccggcccagacaaacgaacattagcctcgcgaagttttctttccctcccgccatcagcttccttctgcatactacttccaacatcctggctatcagcagcaggcgccttaacagttcaccgcgggaggacgccaccgctgggtcaccttctccgttgccaccgctgtacagacctctccaagctgcggtcaaggctcggtgagcatcctggacacccaagaaccccatgcatacactccattcacttagaaactgcctccaactcgacatgcacgcacatccgagatcttccaccgctcggacccaccggcggcgctcctccgatgtccactaaccgaggaaagtagaggaatggaatcgcaatatcatgctcttcatttcgtcttttggtcgcgcccccaaacgagtcaccatttgttgccggcgccggcgagcagaggtgccgccatggctgctctgctgctagatcgatgggagaagaaatcaggacttcactttgtaaatttaacaaactgtagagtcttttcctcaaaagcacaagacacatagtactgttgcaggacctattcgtaattattaaaaacaggaaggactcttaatgaaaacagctattcaacaagtgctgaattgttcaaatctactttaaacttcaaaaatgcataactaattcatcttaactccaatttaggtgaaaccaatttctgtagattcacgaaaatatgaacttaaaagttatgacataaaaagtggtactcacagtatgaaaatttatcactaaaactcatctaatttaagtcacacataaagcatgcacaaacttataaaatgcatataaaattaatcttagctcaaattggtgcaaacttaatttctatagatccaccaacatattatctaaaaacaaagtaaaataaaatatgtacatattttacatcaaatgccttaaaactaatatctttaaaatgactagatttagataagctgaactttagaaattcatatagaattcatcttaactcctttttgggtgaactcagatcctatagaatcatcaaaacatatacttccaggttgtaaaataaaaatatattcttactctataacaatagcccttaaatatttatataaggaataaacaacctagtgtacatttcaatttgtaaaatttgtagaaaattcatctttaatccaaatgaagtgaaccaaatttttatagaactggcaagtaatgagcttcaacatagtaaaataaaatatggcagcttctatacagattatagctctaaaccttaataggtaacctaagagctaatcacatagtaatggttaggcattatataggtgtagtggtatttaaatgcactctaactaaattcaactaaaacttaatagaccagataaaccatagttccattcctatgcatcaaaacttatcacacttagctcatacataaactacttctagattagcatagtgaataattaacatagatcatgcccctatttataaaacgtgtagtaaaatactaaaaactctaaaattatggaccaaagttaaattagttaactcaattactcattttgtacatcactggcaagatggaacaagttatggacctagaacctctatatcatacactatagggaccatatgcctacaacccgttacaacttgtaaaatacattagaaattcatagaaactctaaaaattgtgaaaccaaatgtgttagtcttagagaactcatatattcaccccagcaaactcaaatataataaatatcaccttacaaaagcatttcatagcagcacctaagcaaatactatactataccgataaaacttctaaaatccataactctcaaatggaatgagataaaatggaaattctttcacctaaattcagtttaaaccagcacctacccactgtgcacagatcatgcattttagagcattttggattttccgcatatttcggtgtttaatcgcataacatgtaatttatatagattgtcgcaataacggtgaagaagtgaattaggccctgacttttaccattaacaaggcaagtcccacctccctctctttgaatacattgctcctatgttttggaggttattgaaaatgtttgcaaatcctgcatgtcgattgtacattaatacgctaaaaccttgtaaaacttgttagaataacacctattgattgcattatcacttgaactccacatatatccataacctacattcttagccctagaaacaacaagactttatctttatatatatgagttataatgacactatgatactacgatgcttagccatgcttagtatgattttacttgtcatttgggatcatattaacatgaaaaatgattttatctaatttctggacaaaaatgaataaatggagaatttgagaaacaaaatgatgaaaaaccatgaattttaagtttgggcctcaagtggtacacatgtgttgattagttgtataccgatagggggagagtgtgcccaagctacttaaggacttcactcaatgtctgttcattatgtatatagtacaaccacatgtgctagttatgggatagtcctgtagatggccaaaaggcccgaggcccgacggcccggcccatggcacggcattttggcccggcccaagcacggcacggcccgatggaggtcgggcccgtgctggcccggtccgaccaccgggccgtgcctgggcccctccaccggcatgttgggtcggcccggcacgatgtgccggcagctaggcccgatacacaaaaaaataagggagtaaaaatagacatattatatgccatagatgaaagaatagggatctaaaatagactttttttatctacatatgtcagccaaagaggagggatggaaaatagacttattttagctatacatatgtcagcccaaagaggagggacggaaaatagacttattttagctatacatatgaaatagcccaaagagaagggatgaaaatagacttattttaaaaaaggcccgatgggccacccatgccttcgggccggcacggcacgacccaacagctggtgggccgtgcctgggcgggtggtgcagcccatgggccggcacgacccggcacgaagtgcctatcaggccgtgccggccggatggctgctgggccatgcctagccatggctgggccgggctgtgtcgggcgggccctttggccatctatagatagtcctagcttagtaatctatttatgatttagccttacattctagtaggctggtgtgtatgagttagtggttagctcagaggagcttcctgttacagctgaggcagtagtctaggtgactaagcgtgtccaatacaacggtattgtgccacgtggtgggtttactcgagggtagttcgtcaccacggcgttaagtttaaggcgtgggcccgccacttaatggttctaggtcatatttccagtatgcctaggatggaggaacgcgtatacccttgaattttgtttttgatcttgttcatacccattccgttagttgactgtttaattcccttgaaaaggaccattttgtccttagacatgaaggaaacatgaaaattgtaaactactcattccttctcaaattgatcatcatacaatagaattcaaaatttctcaaattgatcatcctataaacacatggacacgaatttcatcaaaatacaattaatgcagcatgagagaaatgtgtgcatgctaaggtgtaattgggatgatgttttaatcgatacatgcattgcgggagaatgtgtgcatggtgtcttgattgatatggtttaaattattcttggtcttagtgcataaacttatatgatgatcaatatgggaaagagggagtataattttgttacataagactactatattcatgattttttgttgtacaaggtattattcatggcaaagtttatttttacataatgacgtaaaaattaatatttatttacttattaaaacagtatatgtagcatttttatggtagttcaatattttcttttcccagttgtatatattatatagaaatgctttccaaagctatgtttatcgtttataaaatgctgcacgtacttttttaatatatattaaaatttttatgtacaacaaacttatgaatattatggtcacaaaacaaatttctatacttacatcaatatagtccataaatttctacatattccacatatattgaagggtaaaactgacttttctacatgtattaaacgggaaatttaactatttgtcacatttaggtttttcaattatccaaatacccttcttatatttgctcatattttttgcccatcttagatggtggcttcttaactatttgccactttgcctatgtggtatgccaaagtggcaacacaagagaaaaaacagtgtgggacccgcttgtcattctctcccctagctgtccagccggcgacgccagcgaagaggccaaggcggcggccggaggaaagtttgacggccgcggcagcactctcctcggtgcacagagtgggtcctcgtcttcctgcaagttcaaagaaaacgaaaccccttcgttcgggagcgcgttttgatgcattcatccagtggtgttcaccatcggaggtcgccgttgtcatttctctctctatcaggaccatgttgttggtcgcgtttctgcggttctgattttctttattgccaacctccatcatcaatggatgagtctaatcgtggggcacatcctaccatagtccttattaccgtttgatcatcagagcatccacacccatgttgagtattacgagaacatgagtatactatatatgcaatagtggtttttattcatcctaattatcattaaaatttctaatcaatacttagcctaagaaataatttatctgtagcgaagcatgtgtatttcgctagtacagtcaaaataacatatattttgggaccgagacgatgtttttaatttttttttaaaagaagttcaaacaatttgctaacaatcagccaaaaaaaaatatccgccgacctggcccaatcaacgcctcccctcatccacaccaaccatctgcgctgcgctccgcctccaccgccgtccttctcctctctcccccaatcaccgcccacgccacccaccaccatggcctcctccgcctccgtttctcccgccgccgcctcccaccaccgcctcctcctcccctgctccccgcgccgcctccaccgccaccgccaccgccctcgcccgcgcctcctccgctccgcccgcctccgcctcgtcgcctgccacgccgacaccctcctcccctcctcgtcccccgccgccgccgccgccgcgtgcgcctccaccgcctccgccaacgggttctccgactggctgcgggagcacgggctgccgccggggaaggtggccatcctcgaccgacccgtcccctgcttccgggagggcaaggacctgccgctgcactacgtcgccgcggggcaggatctcgaggtgcgttagcaagcggggatttcggggttgattccggtggtaaatggtgtgagatctttgactgtggtgggctgttgcaggctggggatgtggcgttcgaggtgcccatgtcgctcgtcgtcacgctggagagggtgctcggagacgagtccgtcggtgagtgctcttgtgatctattctagtgttgaattctgtagtttggttgctttggggttgagagaaaatggcgatttttttgtttcctggatgcacatttcacagtatatgacctaaatttagcactgcaatagtcctcctgttgggggcattttgtgtaaatggcagaatctggttttaatttatctgatgtccaccttataagtacaccgaaatcagtaaagtatagcttcacttcaaggaattcataattgttagtaagaagtaagatataggttgaattagttgactttgttaagtaatcttctatctgttcacttcaatttatttcaaattttcaataccatgtagggcactggatttgatattgttaccatcaatattaatatgtgtgtgttttgaggaatgctttttgaatgtttttaatccgtgttcaactggttcaagagtctgaatctgccggtttgatatgcaactttagctaatcatatctttcttgcgtatcttcaggatataatcaagtattatcaatctctctttgtgtgaaatgttgtgcattgtaattaaacaatgggtttatagcaatttcatctttcaaccttaggtgctgattcgaattttctctctttttaagcagtctcttcacgagattgcattttctttactattgcatttgtcataaaaggtaaggtcacaatttttaataaattaatcatcaaacaatgttagcatgagagtaatataagaaagtagccctatgtttacaactttgttaaaaatagtttaatgtgaaattgtggatatgtttacattggcatgatatttctgttagataggtcttccatgcattatttcttcagtccttgtatatttgtttgctaatacctgatctgtgaaacttatttgtggtttatgtctgtccacttgcgctaacaccaaaagaagaatatggaaattgatatgtccttttcatgtatggtatttgttttcatttttgtactatggtaaccagctgatattttgaaccatacagctgaattgctaacaacaaacaaattatctgagctggcatgcttggctttgtatctcatgtatgagaaaaagcaaggacaagattcattttggtatccttacattaaggagcttgatcgccagcgaggaagggggcaattagctgttgaatctccacttctgtggaccgaaagtgaactgaactacctgaagggtagccccatcaaggttagtgttttttcctatccactatatgtcaatatattatgagcacattttatgcagtgtcaagtaatatacaacttagattttctaatatttcaggatgaagttgttgcaagagacgagggaataaggcgagagtataatgagctcgacacactgtggttcatggcaggttcattgtttcaggtgctttcttttgaccttccaaaatgttcctgtctctgggattctgttgcactagctgcttgttgttctcatgtcaactgttatgcagcaatatccttttgacatacctaccgaggcttttccatttgagatcttcaagcaagcttttgtcgcagtacagtcttgcgtggtccatttgcaggtaacataatgagcaatgagatttcatttatcaaaaaaattagatattaccccgattggttgttggttggtttaaataattatctctggtgttgaactgaagtttaagatttacttagagtgtacaccatttatgaacagaacagtttagtgctaaataccttgcccatataatagattatacaagcctcgcagtatttttgtcaaattcaataaatttggaaatttgcttcttcaaattatgtagatttgttctgtaagtatttttttttgtttcatatgttttatttgcttaatacttcagtttgggatcaacagttcatagcatgccagccttttattttattactggataaatactgaacctgctcgtcgctaagttatttttatttttcattgaagaacagaaagttagtttagctcgaagatttgcgctagttccattgggcccaccactattgacctacaagagcaactgcaaagcaatgctgacagctgttggtgattctgttcggttggttgtggatcgaccatacaaagcgggagaaccaataatcgtctggtataatattttcttcagatgcattaaaattcttgttgtacctcatcatatttggcaacttcagtgcttatttactgtttgcatatttcatttctgttgtttgtgcatctccactgtaacgtcaagctatgcaaattgtacaggtgtgggccacagcctaactctagattgctcctcaactacggttttattgacgaagataatccatatgatcgtatagtgattgaggtggaatttgttttgctattgttctacattcatcttcttattggatttgtgtaagcaatactgaatcattgttacaggcatccctaaacatagaagatcctcagttccaagagaagagaatggttgctcaaagaaatgggaagctggctatccaaaatttccatgtgggaactatgatttcctttttcttttccatttggaatgcaactacaaatgttgtatattgacatgccttaggtgcattaggtctgtgtgggtaaagagaaggaaacaattgcagaaatgctgccctatttgaggctaggatacatttcagatccagatgaaatgcaatccatactttcttcagaaggtgatacatgtccagtaagtctacttgcccttaattggccttactattagaattttcagaattttcagttacggttagaatttttaattacacatatgagataaaatggagcagggcaaggtgacagtgtcgtacattgttgttttatttattacatttttggggtcattatgcttgcgcagttagccagtttatagtttctgccttttttctttacaagactccaaaagcactttccaatgggctcagtttttatggggcttctgcctttaaatattgcttcaagccttgaagacccagaagtattgatctagtgtcattagtcattactatgtttgtaacaaattgaagctagacaaacaggcatttgatctgaagatcttgtgttatgtgaaatgcaataattacatctggttgaacatttaggaagagagaacatttcacaagtagataatttggaaaatgcctttacatttgaagctttcttttaggccatcacatttgtcattccaggtttttaggatttcattcaagttataagttcatctaacccattatttatttttagtcgggttgatctaaggtgcagattgttcaaaactaaaccggcttgctacaaagcaaatccatcatacatttaaagtgcaatattttgccatgcaaatatcccacagtagcatgtagggtttccattgagtttttatggaagttgagcaatggttctaaatagactatgtggtaatagtagtgttatgcataacactgtgtaaattgtgacatgtttccaactatgattataggtcagtccatgcacagagcgagcagtacttgaccaacttgttggatacttggagtcacgattggctgattatccaacaactttggatgaggatgatgctatggtaacgagttgcaaagcactatgtgtatgtttttttgtaaaatctctgatacgtaatgtaatgaagagcatttcatttctctggtattgggcagttggcagatggcaatttggaaccaaaaaaggaagtcgctactaggcttgtaagattggagaagaaattgttgcatggttgtctccaggctgctaatgagttcataaatgatttgcctgaccacactgtgtcaccttgccctgctccatttgctcctgaattgaaataaggtaggcaaagctcaataagttttcactgcttcccaaagtaaatttattagaccgtttactgtgtaccatgttgatgtaattgatctaatagactgaattttatggatgtgcagaaaagtaaagcatgcagcgagcattaattcttgcaacatgggtgtcacttctaatggtgttctcattaatgatcacatccagttgaagtgcattagaaggtaataaatctgataaattgttactcctttaaaatacattcaagtagtaggatttaaaccagtactaatattgctctggtattataatttttttattgttagaagtttagaacctactgaaagtgtgtaactgaaagataaaataccaaataaaacttatgattcaactattccattgttacttggggtacattctcccaacccttgccgtgcttttttttttcttgttgtgcgcgaacaaaaaatttaggaattgtctatgaatctctgaatattttttttctatttctgaactttcttaattttaaaatttaaaaatagacccttctaaaacttatttccaaaatctgaaccttttaggcacgcgaaccagggtggcgtcgcaaaacaacactgaccccacccacagcgggcgtgatagttttattctaccacgccaactatggtggtgtggcaagacaatgctaaataatgctaccatgccagccaaactggcgtggcagtattgtttttcctactgaaagtattgtttggcgtgaccaaaaggttcaaatcttgaaaataagttttggaagggtttatttttaaaattaaaaataaagaaggttttaaaaaataattcctgaataattggtgaagataacaacatagctatgtcaatggtagtcaccacacctaaatcactcaatactttttaacttaactaaagtagtttcttgagcataatttagctacttcatttcttcctaaaaatagttcctatagttataacaggtcatttggaacataaaaatggcaagaccagaataagaggcacaggaaatcagtaatgcaatgacagaatacaggaatgccctctgtcctgtacgcaacacaggaaagcatagcatggtaaaaatagtcccatttggtctgtgccttgttccttagtggttgggcactgtaaattaaatggccaatttttgacatataaagtagcctctattctctcttatcccagtcctgtcttttgcatctccttatccctcttctcacctgtgcaaacttgaggggagaagccagaccatccgctatgctgcatcaataactttggctaggttgcactgcaacacgcacaacagtaggagtatgtactgtgtagaacttactgtgagaagtcggatgtgtgatcccaggtcccagctgaataaatttctctcttttttttcattttgaaaaacatgtaatttgcagccatatactgcaatcgatttggggaactaaatttaaaagacagatgcatgaatgaaccacatcaagaaatcaaaattcagc

SEQ ID NO: 28892 - DNA, 4713 bp, Oryza sativa
ccccatcccccctatacactactctctttcttcctcctctccttcttttcttcctactacaccataaattttttaaaaataaaaaacacaaagttgaaaaaatttatgtatagaaatactatatataaaaaaattgaattcaaattcaaaattgaaacgggtatgtaaacttttgacttataaactttgcgtctataaactaatatttaaattcaaattcaaatttgaaccgggtatgtaaacttttgacttataaactttgggtctataaactttaggtgtataaactttagatgtatagaaatactatatataaaaatatttgaattcaaattcaaatttgaatcggatataattcaaattcaaatttgaatcgggtatgtaaacttttgtcttataaactttgggtctataaactttaggtgtataaactttagatgtatagaaatactatgtataaaaaatatttgaattcaaattcaaatttgaataggatatataaactttgatttataaacttgaggtgtacaaattttaggtgcataaatttactaaaaaaggaaagtaatgcggtgccaaaaaaggaaaccaggtggagggaggggattgatcgatcgccgggtagcaatctcgagtgtagactgtggaccatatttggtgtgcattgcttgtttagtgtgaagtggtaaagataagggcacatcagcagagtgtagactgtggaccatatttggtgtgcattgcttgtttagtgtgaagtggtaaagataagggcacatcagcagttgcgtgacattatgtcggtggcatcatatagggtagcttcccaaaagttagttgtttatctgttctttcaaaattttgtaaatgaatcctcagtagtgcttctttgcaggaaatctgaagcctggctgacgggtgtaatagggatttcactgcccgcatgcagatttggcgattagttgcattgcacacaagtgtgcacggatgttttgttaacctagtggcttttatattcactgagtagattctgtacattctgatgattgactgagatggtaatgccaatgtacatgttcagtctcatttgtcaatagagattctgtacatgttatatttttgggtgttggcatgatttccgccgttctcttttcatggcctgtttgatttttagctgtctgactacacagcagagaattgtatgcaacagtttactgtgatggctgccaaggaatcgcattcatttgaaatgctccaccatttttctgtctacagcaattagtctccctaccctgatgattaatacctttttactgggctgatttcaaatctggatgatccacaaagcatgaacttgagaacaaatcgtgctacataatttgttttcttcacattctgccactactgattaacagatggatgaatcgtgatgatgaaccatggcttgatactcgcgggacgatttgagagcccggtaatattagcagagatgataacagaaaggaagaacttggagtaaatttaggtgtcagtcattttattgatcctttgctggatgaagaatgctcctgtttaactctctgatggaacatgcccaacgcagtgatacaactacgatccttcaaacaaattcgtgacaccaccaaacaggaacaggtcttttttatagtccactcttacaagcagtgtaagtggtggcagctaaacacatttatttcagtgggcctcaaaaaccaataatctcatttaattcttttaatatcaatttttgtttgtgcatctccttccaactctctctctctcacacacacaccatctatgagatgaaataacatgatggcaagaggtccatttcccgagagtaaactagacaagagttgatggccatgctactgagtgcctgagagtcgtttccatctgattatcctatttcatttccccttgctgaaatcctctaaatgattttccttttcttcttgcaatataatgcatatgtacatgatgctcgaccacgaagtctgaccaatattggattgggagccaacaggaaatgataaagcgatttagccacatgtcgcacatcttagtatttaagatcaagtctccttgtggggtgaacaactcatgagtgaacagtggcttgcgctagttcattgctgtagtgatgatacagattgaaaaaacgccggctgggagaatgaaggcatcttcatctccatccatactcttcagcacatggattctgggctgataggattctactacccagcagctgagcatatacacatggtgaaacacataacattttcctctcattagctagggaaagagcttgaatgcttgatgcatctgcttggcctgagcatgctaaattaatccaatccgttatcatgttttcttcctcttgtaatgtattaagttgcttgtcgcgtgcatgtaatcaagtaaaaaagaactatactaattggattggaaggcgcagtgaaatgttaataaacaatattccacccaaatcatgagttaaccatatcgattagttcctcggcattaaatccttacttaattagttgcagattgatatatcatgcccatgcaacatgatttcatcctcacctttcaagtaagcatgtgtggctgcattgtgttatatgtgtaaaatggccaaattcaagaggaattgagcggatttgttaaactatgtgaagaagaattatacgatacatataccagaaccatgcctatgggttgataaattatctaaaagtattggacgttaaagtaaattttcaattaaagtatattaaacaagacataatttccccgcaaaaaaaaatcaacacatataattatgcaccaaagatgggtacacaagctacctcattttgtcttgttagaatctttaagaaattcgtccagcggagaattgatttacgcctgtttgatttttagctcagtctgactacccagcagagaatagtatataaaacaaaaggagtaaattgcattggtagtacacaaacttgttaattgcgtgtaatttagtacataaacttataaaatactcgttttagtacataaacttgtctatttgtgcaaacgaggaccaaaataacttgccaatgttgattttacgaagttgatgttgattaggatgtgatgtacacgtgtaatgagtatgaacactgctatatgtacgactgctctatccgaccggtgtatgacggaacggcagagcagcacaatacttaacggcgtaagtcggaacagcaccagcagcacagctcttgacgtcgtgtaatacgcagtcgtacgtcggtcggacacttaagtggtatgtatagcattttcgaatgagtatgcatacttacatgaaaaagtttttgacagcgtatatgaaacaatttactgtgatagctgccgaggaaccgccattgatttggaatgttccaccatttttctgcctccagaaattggtctccctaccgtgatggtaaataccatttactgggcggatttcaacatctgagtgttccacaaagcatgaatttgacagcaaatcactacttcgaaacaacacatcagtatcggttcgacaaaacctaccactgataatggtttttcatcctataaaacactcgcactagcattgatgagaagataccagtgtcggatcatataaacactactggaaaactgatttttcatgggtggtgtaaaattcacaataatcccggtttaaataggaaccgagactaaaattatttttagccctggttcaaaagaggcacgacactttatgatctttagtcagattggtgttatcaacctggactaaatatcatttttagtcctggtttaacacgttgtcaggctgtgtcaggccctccactatttttagtcccggttgtttataccagccgggaccaaagattgaaaaaaaaaccgctcccacacgcacctcctcttctccttttgtccttatctccttgtgctccccgtccttagtctttatctcttcatcctcgtcctccactcctcctctcctcccctcgatcccagccgcctccccttcccggccctctccgaggcgacctccccctcccctctccttagatccctcctccccttaccggccctctccgtcagccggcggtggctggcgaagccgcgtcagtggcgtcgggcggaggcaggcagcggcagacggcgggcgcagccgcgtcggcagcgtcgggcgaaggcaggcagcagttgggggctagtgacgtcgtcggagccgcgtcgacggagccgcatcggtgggaggaggcaggccacgggcgtctatggcggttggtggcgggcggagccacgtcggcggcggcgggcggaggcgcgtcggcgggaggaggcaggccgcgtcagcggcggctggcggaggcggagcctcgtcggcggcggcgggcggaggcgcggctggcgggaggaggcaggccgcgggagtcggcggtggcgggcacgattcggtggtgggtggtggcgatttgatttgtgaggtttttgtgaatgtgttgtgatgtaacatttgatctgtaaattttttatttcaatatgatctgtgaatttttgatgtcaatttgagtatgtttgaatttgtgatttgatgatttgggatgtcaaattgagtttggtgtgaaatcaatatgcaaacagcaaaaaaaacaatgaaaaaaa

SEQ ID NO: 28893 - DNA, 8211 bp, Oryza sativa
aatgaaagaaaataagaattttagtccactaaaactgggactaaagatgagtatatttagtcctggattaggcgtcccggttgtatactcggaattgaagggagttacgaattgggagtgaagatggtttctccagtagtgaaacaaccggcactgattgttccacgtaccatcagtattaatttataagaacattgatactgataattaaccaatcggtgtcggtttaagtcgcttggagtggatgagctggcgtattggtgggaaaagtcacctgtcacttatggtcattacttcctctgtccaaaaaaaactcaacctcgtactacgatgtgatacatagtagtacaacaaatctgaacatactctacgtccagaatacaagcaactgctattctaatgattggacaattatgacctaaactggatgtgtcagatccaactctcatcatgatggccaagtggaaataacccgatctctctcacatacttcctccatctaaaaatgcaacctacaaggagatgtgacccctccttcttctagtacaataaatcatgtgacccctcctagtacgacatatctggacaacgtatgctcatattcgttgtacagtaggttgaatttttttgaactgagggagtatgcaatcagcgatatcgaggttggacagtatacttgataaaaaaaaagattggacggtgcaggtaacgtgctattacagaaacaaaagccgaagcgaacgaaatcaaacagctgagaaactgattgtgatcaaggagattttatagcgacttaaatttagtaaatccgattcctttataagttttgtttgtgcaactccttccaacttgcttatatatacaccaccatctatgagatgaaataagctagaagagatggtggtcatgcttaggtgagtgcccgagtgtggtgtatccatcttattatcctatttcattttcccttttgcagtagtccagtaaaaaaaatgtcctttcttcttgcactgcataaatatgtgatatttgctcatgatgttcgaatcatatgggattggaagccaccaggaaatgataaaatgatacagccgtatgtgttgctcgccgtgtgcatgtgtttcacacatcttacctagtgaaaagtaaatttcaaaatgctactaggatgagccacatcatcaggtgaacaatagccattggatcgacaaaaaaataaaatagagagaagagagttgaaccattgattatagaggaaaggaaaagacgaagaactttcgaagctttccagcaatgcggaacgcgagagaaagggaaaagaaagaaaagcagtattgaaagagagtgggggcgttggctggtttatggcatgtgatataatttgcactatgcacactcagtaaaagttattttataaataatccttcaaaattatttataaatggactcttggcttataggctcatatgttatctatagataatccttacaacctactaattctaaattatcactataacgttaatatcacaaagtttgttatcacataaacatctaataaaattttctatgattttaatgttgtaccctggatcacctctttagcgtaaaagctactccctccatcttattttgatcatctctaaagagcacaaaggccaatattgaaattaattcgtatccaataaggtgctctatcgtttcattttcaacaaaaattaattcacactttaaatgttgcatgagttgagccaattaaaattaatatttattggttgcatgcatgcagggcgttgctccatgcacatttactctttacacaaataaacaaagaaatactttgttaggtgatgattattttgggaaaacctcaaaaatctaatgtgatgatcaatttgggaaggagagagtgataggtggggcttaagaactagtgtttcatctatacctgttgctttcaggtcattactgatccattacacttctcccaagcacatacttaacaaaatgaactttgtttactgatgccaatttaaataacatgctcatatacacatataacatgatggttaaagtcgtgcgaacgtgtgacatcataggccaattcaaactgaaaggtttgaagaaggttgcaacaaccaactatgccacgtcagatagacataccaatctcacctatgcatttaatgtttttaatcttaaaatatgtgaatagctagctcttgcatgagacccaattctctttattttttaattttttcttctccacataagtttatagcctactattatacttgctctaggaggtgagctaggctaggtactatttggatcgggcttttctttcatgggttgcatcgggagctagagagtagtgcaagcaaccggcacatcgcatctttatttcctcgctcctcatccgcagcctcgttttctctttcctctggcaccacagtctaccggcgatgggccgacctcgagccagtgacatcgcagcctcccaaagaatgagatgctcttcgtcaacctcaagggaatcatcgctgttgctgcttgccacagccgatccaagttcatgctgcggctaacagtgtatctagaatttaggatattgatggtccaacttaaattttttttaaacaccgtagatctaatgatgctaatatataatacaagtatagataatgaaataaaccaaaagtgtaccatgataaataagacatcttaaaatacataaaattagtaattaagtaaaattttgacttatatggacaaaaaagtttgaagaagattaccatacttcttctagcttcttcttatcgggtctacgcaatatctctatctttctttatttttaacaaccagtaatctacaatatagtactaatatcacaatgctcattgcacaaaagttaaaatcttatatagtgaaagtagcaagctttcttgcacaaggatgtgccacatcattaaaaatatattagccgtcggataaagagttcggataaataatggtcattagatcgaaaaagtgtatgtattaaaaaaaatcacaaatgagctaaacatatggaaatttttggaggtttctgttatctattgtcctagccaagtatatatactttgtaaacaaattaacttatattaaaatcttattaagggttaaggtaaactaatagaccatatataaaagttcttaaacaggatcaaaagtcacgcagagcgcgactatatgactagtttaaaactgaaaattgaaaagggtaaaaaacctaaaattgaaaaatcaaagtcatcccgtcggccgtcgcggtcttgcggaacagaacggagagagtcggagacgcgcgcactcgcagccacgcaggccggccgggcaccgggcacgtggtggcgcggcgcagacagcggctggctgcgggcggcggcagggcgggccggcggcggttggagtaggcagcgtcagttaagccgtcggccgtcgcgtggttggtcctcactcatccgttgcgaatgcgatgcgtgcagcggcagcgagaggtggtggcactcagcatgcggcgtagcagcggggcggccgtgcggcgctcggcgagtcggcggccggcgctcgcggagtcgcccgtcaatgaagccgtcgccgtgtcgcgtactcgctttgcctaactcgcgagtcgcgtcgttaatcatgatgcgatacaatgccgcgcgtgagaaatgaggagtcgacgaggagaggtgcgtgagtgcgatgacatgtcatagacagtgagtggtaaatcattaattggcacatcttaaaagtgacaaataatcaaatgtcccgatcattggagtcattgcaggcttacagctcaccgggttcactcacctcacaccttcacccgtataaactaaaaatgtccgttccaacacctacatggagaaggataggatagagaacagccaacactatgataatagcttaacaagaacatgcatatattggggataaaatgactccactgccaagaagaaatcaagccatgtccagaagcttttattccattcaggattcagctcatcatttcataaaaaaaaaagaaagaatggaaaacagcaaggaacatgcatgtgattgaatcctgattcccctccgcggttgccttgcctgcatgcactcgatcagcagcagcatctgcagtggcgcggtgctcgctgccgcagagacctcatcttggctttggctccaccgatgagccgtggtgtccccttcactttcttcttcccaagaacgccatcatctacttctgtgaggctcctcttttgccctccagaacaatcacaaaccaaagacttgagtttacggagcgctcctgctttaagtctagagagttcttcaagtttatcggccttgcgatttatggaataatatagtgagcaatcaactttttcccgtgcatcatctgccgcagcatctgcctcctctatctttcgtaccacatcagctggaaaacactgtgtcaatccataaaaaaacacatttatttgttttatctatatatttcataaatattttttggttgcgaatgttaatttatacagatatgaattcatctactaccttggagggtaaccattttaccatcatttgaggggtcagaatcatcaccataacatttgcatacttcgcgtgatccttgataatcgtgccaatgccaggaacaagcttgtcacattgctcacgcagcatcttgccgtatgcatttagcagaacatcagctcgacacagctcaccagcacaagctataaatgttcttctatcaatctggatggatcaacatgaacatgataaaagaaagcattacagaacttggtcaggctgtaaatgacaattgattcaaagcagcatcaaccatctctagccattaaaaatcctggacttagaaataaaccagacactaaccattctgaattcatgaatgaataaatttttcaataaaaaattgacatcaattagacacaatagagatatcaagttttgttttctctgggtcatcgggccaaccaaaaactcaattaattgaactaggtcagaattcaatgaaaggaaagtgtgataactgataactactgtactagctaagggcaagttttatagtaaggacagttgccacgtttaattttatctatttaagataagatgtgatatatatatatatagacaatacaccacatctacactacctccaacatactaagccaaatgattttatttgtttgtccaatcccctctttctttcatctcatttttcttagggtttgtatggaggttgcctctaacatgaggtgtggctcacttactctttcctcacttaggcccggtttggttcccaaaaacatcacatcgaatctttagacacatacatcgaatattaaatatagataaaaagaaaaactaattgcatagtttgcatggaaatcacgaaatgattcttttgagtctaattagtccatggttagccataggtgctacagtaacccgcatgtgctaatgatggattaattaggctcaaaagattcgtctcgaggttttcaggaaagttatgaaattagttttttcattcgtgtccgaaaaccccttttgacatctgatcaaacatccgatgtgacacctaaaagttttcttttcgctaactaaacaatgccttatttcttccacctcatcatccaattctatttggtatttttagaggcaacaaatcaaccattacagtacttgccctaaatgacccacactatgctaccaccattggtttcagtgtttcactacttggatccctacacatacagcataacaactggcacaacagtaagtctgaaattaagcagaaaatataagggtgcacgctagaaaagggcacaactgcaagaaagctcagttcttaccgttattttggacatattgattctaaatttagtcatgcaatcttttaacacttgaggtaatgggccaagatactggctagtgatgttttccctttctgctggtacaaattcacacagaagattccttaacccccacatcagttcaggcataacacgggtggagaagtgctttttactcccggttcgtaacccccctatagtcccggtttttcaaccgggactacgaatatgggactaaagatcgctatctttagtcccggtttaaataaccgggattaaagatggatcttttagttccggttggtgttaccaactgggactaaagatccttctttttagtcccggttggtaacaccaaccgggagtaaagagagaatagcggcagttccagatggtccccttttttttattttctccctattaacaaccaaatttggtaatatcggcatcgggaaagaagattagatcgaagtaaagtcggaggcggagatcgagttcggaaacagagcaggaatcggttgtagtccagatcggctacgattaggatcggctgggtctgagtcgggctaggtaagccgatgcagccgattccgacaatgcaacttgatgtatgacatcgggttgaattgaggtgcttcaaggtgattgccgcacatggatagagtcctgagaaggcaattgtatctattaattaggatgttttatgtaattttcttagagatatgcttgggcaaaagtctgccgcaaagacttatggtatcttagagtttgttagagatagttgtcgtgtccgttatggacatatcttgtaattttcgggtataaatagacccgagccctatgtaacttttaacacacacgttcaatacaatctcggcgcatcaccaccttttttgctttagttttatttcgacgagttcttgctttcgggttgagctgcatcggtttcgatcttcaacaagaggtaaaacttgtaatggcggtttgcattctcgggattagtgcttccatctttatgacactttaatcttgtttatgtaattcgtcgagttatcatatatcctacataatccttggcaatatcgatatccaacctacaataggctaacatccgtcaatagaagacagccgattaggttaaataccgatgttgccttagattatataggatatctaccactctatgacacatccaacggcttgattgtctagatattgtccttcttttcatacttatagctgcatcagttaagtttgaccttatgagtcgtgattagaatctcaatctctagcccgcttcttggttgctgattagggtagtatcggagtttcagccgatcttacctgatttaactacttttatccctttacgttaagatcttgctgcatttaagtatattaggcttgtgtttagtatattctacttgctttaatatcttaatatagagtagtatcggagtattagccgatacatgctagatctatctgatcggctatgttatgaacgtatatagtctcattattaatatatatttcgatctaagtgatttatactgtctcggcatggcgaccgatctatcccaatcacttgatttaagtatatatcgatataaagattatatattggtaatatctgcagccgatcgagtagattcagtccttccttatttattaatgactgccgatcgacgcatatatgacattggctcaaagataaatgatgtcatcggcacctagctgatcagctatcatttatagatttaactgcggtttctttgcttctatttcttgttgattacaggatcaaatcaactggcacgctcatacattcgaaggcgagctttggacctgcactggagttaagcagatctcccaggcctcgtattttctgtcaacactcccaaatcttattttctcccaaatcaagtgggaagcatatccccaaatcaaagtaacatcccaaatccacatcacaaataaagtaacatcacaaatcttaaagttacatatatacacaaatcaaatacatcacaaatcctaaaaaattacacacaaatcaaatacatcacaggtcatcttagatccatccaataaatcacaaaattatacatgtgaatcacaaattaaaaaaaaagagaaaacaactccgttgctgccgcccgccatggccgccagcccgccgccgccgtcgccccagcccgccgccagcccgctggccgccgcctgccggatgggaaggggaggatgggcaggaaaagggagaggaggaggtggaggaaaggggagg

SEQ ID NO: 28894 - DNA, 15403 bp, Oryza sativa
aaccgaaactaaagtggtgatctttagtcccggttggtaacaccaaccgagactaaagatcctcggccccctgacatcaatctgacaggggatgaaccgagactaaagaaccaactgggactaaaaatcatagaatgcctcttgggttttcaaccgggactaaagatcatttttagtcatgggattattatggttttgggtcgacccagcaaagatcatttctccaccagtgtaatatgatctttctgggagacatcaactttctagcaagaaaaggttacagagattagtcaactgtgactacgattcatgcaaagacaaaaaatactactccttccatttcgaaatgtttgataccgttgactttttagcatatttttgaccgttcgtcttatttaaaaacttttgtgaaatatgtaaaattatatgcctacataaaaatatatttaacaatgaattaaatgataagaaaagaattaataattacttaaattttttgaataaaacgaacggtaaaacatgtgctaaaaagtcaacggcgtaaacatttcgaaacggagggagtactaaaaatagatgtaccgaccagatcggtttcgatggcacctctaagtttttcatcctcaacaatcaacggttttccacatttacagtatctcaagatgcgctcagcaatctcctcaggaagaccatcacaatgccacactgtcgactcatcaatcttaatgaatttgatcaataagatgagctggtaacaacagtcacagcatgatattaggtatacaaaggttaaggcgcaaagtcacaaatgaaacataggagccctgcatctttccaacagattgctttttgtcattattattttctggtgtagggtggctacttccgcattattattttgcagtctaagattatttgattttagtcgtgatgtacttttagttgtagcaaactctttaaatgacagtgatagccaaggaaaccacataaaactaaattaagctagtttatctacggatatgagtaataatcctggatgaaagtaccaagcagaaaactctctctaatgaaagtaaatatggtagaatcaggaagacccaacttgtctaacaaaatcaaacttggcaaaacgcgaccacagatgctgcaaaataacaatacagagtgaaaaatcataagaataattacagacaataacctgcaattaatgatgacttgggatatatattgcgtatacatacctgttcagaacaaagtgtttgaaatgcaacgaagagagcgaatcccgacggcgtcttcagcaccactagattgtccacgtattcgagttccatatatacgctcaggccttctttaattgatccagttcacaagagcacaacaaattaatcctagttagttcagcgcacactcaactcgattagggcaactattacagtgacgctttgcatctggatatcacaaaaaacgtacattaaaatcagtgggactgtggggtacaccagtttacaacaatatatatatatatatatatatatatatatatatatatatatatatatatatatatataattataatgattcgatcatatcaggaaatgcctcacacaggaaagaaatatttgctcatggatagatcgatgctagagatgactaaatcaacaagatcgttgacatggaccatcgataccaccacagctcgaatttgactacaatatcaagctactacctatatacgatatcccgatccagatcatcgatgccaagaaaggactcgacgatgcatagcaaaacgaggacccaatgctattacaggagaggtgtaggaaggaagaaagcccgtggacgcatgcgcccgcgtacgtacctcgagtgcaggctgcggattcagcccacggtgcacacgaggtggagggtggggttatataggagcattcctagccgcaaatctaaatttgatccgttatattttccatccaattggatggctatccagaaaaaaaaaatcctctccccatattcctttttcactttcttctatattttagtattacattccaactaacgttaataacgcaatatatactttataatggcaatatctgtaaatcttgctaaaaaatccaaatttattgcattacaaatctatatctatatttatatctatacctaattaaaaaatacataagggttccgacaattttttttcgtccgtgcgtattcttttcgccgttttttttttcgtcgtctttttcggttttattcccatccgcttcttttcatgggttggcatggctgttgggcccgaggatggtggcccgaggaggaggaaaggaagagaggtggctgctgggcccaagtagagatagggatgacggcccaagagggagggatggcagcccaagagggaggagaaggaagaatgggccagatttggcccagaattaggagagggtttttagtttgtttttactttaaattaattattaaaattatatttgtattattaaaattagcaattgagctttgaaaaattcaaaacaagtctagatagtatggttcattcgtgaagaatttaataaaaaatatattcagtattttattttaataataacatgttatttaattctaattctaatctatacctctatacctaataaaaaaatacgtaaggatttcgggtgatctgtttaattgtcgggtcaaaaccgcggttgatatagtatatgtatcttccatgtaatcacctctctcctttttacacatatattacttgcactgtgtatatgtgggcctctcctggaataagtctactttccctcccccctgtcaaatcatatttgcgcgcaaatttttttttcctcgaccactagcacggaacatgcacatccggttgatgaaaaatcaaaactatagcacctctttcttcaacaattttttgatgattataaaatcttataatgaactagtttttaattcaaaattttaatttaattatattatgtacacaaaaatcctaattgtaactcatgatttttttaaaatatatatattcaagcaaattcccacattgaatttcaccttaactagaccgtataacaacaataagattaaaataaatttcagccgttgcaacgcatatacattttttctagtatatatcaattaccctaatctcatttttatgttcctctgtcatatttgtccaatcatatttctcttcctctcttctttatacctatcgacatgagagagtgatagtgcaggctcaagtgtgggcgcgggtggagaacaaaatgtcgacaagggtggcacgggtgcgaggcacagtcggcgtaggcacgggaatggggagctagggtcggcgttggcggcacagcctcgagcgttggtggagcaggcataaggcccgggtggcacggccacaggcgtgggcggaggagcgggctaaatttgggggtttctttcaccgggatagtgggcgcgctaattttggaggcactgatgcgtatcagctgcaatttagttgatggattggatgggatagatgagctgctgagaatgctctaataagataatgttgtggtctaaaaatggtgaggtattggattcggttttgacagtgttagtgatatgccctagaggcaatcatagagatgattgtatcatatactatgtttacatatttatccgatattgttccttgaaatagataactcattattggttaatgaatatgtgattctttcatgagactctttatgttatgtgttactatttctaaaggattcctgatcaaatatcatatgtggaacaaatatgtttagatgatcagcatatgtattaattgatgatcatgtctcatcgatcatggtatagagataccaaaataataatgtggacacatgttagtgaacatgttattagatagacccaacatgagacactgcaagagccatatgtgttgtgtcatcagtgatctcatttagtgttggtgttgaatccatagacctgaggttatcatggtttctaacatgtgtagtaacttactcagggactgctaaacgctactccgtaactggatagttataaaagtagttttcgggtatgctatgaaacatgcagtgggatatgaataatcaagatgggatttgcccctcctatggagagatatctctgggcccctcgatgttatagattatggaagtgcatggccataccaaaggtgattgaggagtcaatcacaagttatataatctatcaacaggttcgagtgaatgattaagctattagaggatgacacatatctagccttgagcttaatcgatatcgtgaggcaaaggggttcatacaagtatacactataggttcatccgatatgatctttatgtatgcccggtgggtcaatacgttctgctaggggcagctgttgacgcgtggaccgaaaaggagttttcgggttacagccgagtatatatgaacctacagggtcgcacgcttaatgggccggaataaggggattgcatagagatccaatatgagcttaattcggatagggatccgaataggagtcctacgggccttggaggcccgagtgatagatcctatatattcgtgaggggtgtgaccggcagaggcattgcatcacgtgagaaaccctagccgtcacttccctccccgagtaaaaccctagccgcgcgcgggtgctagcacatctgcgcgtggcgttccgtccctgtacgtgtggataccggtagaggcgccgctggtttgcggtgctgatcggcgtgggagtacggcgaggagaacgcacgaggaggagaaggtcgagccggtgcgatcgactacttcctctacatcgacgcgcactgcttcgcgagagtttcttcgacttctcagcgtcttcttccgctgcgcagcgcgtcgagtggtaacgatctatgatctaatatttgcatggttcctggtttacgtgatagaaaattttgatttatgctatcgtagcctacgcgtatcccaacagacagcataatgtagcttggtgctctggcggcttggctgatgttcaaagtggatagtcggtgtcttgctcgtttttgcgatgcctttggcaacgatgatgtgataattgtggagttggagctgctgtgtcgctaagcgacaaggtcggcaacaacacttgcctcacgaagtcaaagcctttgaattacttgcaacaagctctttatcaatggctgtttttttgggctccgctattgtccttttttcacggtcttagttagaatgttgtggttgtggtttttgccagtttctcctaattaactgtgcattgtaaggtttggtcatgttttcttcttaaaatatgacacattcttctctatataaaacgccgcaacggcatgaccgttcgaaaaaagacaacataatgtaggggcctaatgtgcagcaaacatatatttttgcatacaactattggccaagttttagttaactccattaactatccaagctgtgttattttattggctcctttttgtgatttgcatactggtttacgctgatgtgctaatgacatgggactaaatgagcgggtatgttggatgtttagatgccatatggcatttaaactctcttggtgcgcacgagtagcggcaaaaggagaggaggaggatgagcgccattttataggccgggggaggaggggaatggctggcaagcaaggtggccggccatcaatggcgacagtttgtcggagattaaatttagcgaattaaatccaaattgaaaggggcaaacatgggaaaataaagaggaggaagagaggaaccgatttttacaatcaactagtaaggtagcccgcgcattcgcataggcatgtatcgtagactgtgtttgagaacttataatgatgaaatgttaatcggaacttataaaagatcattttatttatttatattatttgagcacatttaaaaaaacattaagtaattggactattttctctaattaaaggaactcgatgttttatgcagtggctcaaactattcatatttcagttagttatttttgtttacgaagtgtatgtttaatttagctatacatgtttcaaaacatagcatggtgcgactctatgttgttgagttatttctttttcttttggcaaattaaatataaaaattttgttctggtactattgatttaatttagctatgcatgtttgtagaatttttcataatgacataatatttattgtcaaaattttaaggtatttagatgtggtgcaaagtgcatgggtggactgtgcccaaatgctataattcttatgcagcaaaatatatgcatatataaatattacattgttagtttaattataaatagagaataattagatagaaatcagaaatgtatagcttataaaaaaattgtagttgtttcaacattgattgtttctcttctagtttagtagctacaaaaataaggaatgggagggcagtgttttctacatgtgagatagaggaggtggagggattttagtgaaaactgttgatgcaaaaacacgaggcctggaaaatctgcttaacttcagtgcaggtccaaaaatcttgcttttaggttcgtgagtgtgccagttgatttgatcctgcaatcaacaagaaataaagacagaaaccgcggttaaatccataaacgatagccgatcggctagttaccgatgacatatcaattatctctgagccgatgtcatatgttaattgatcggcaatcatgaataaataagaaagaactaaatctactcgatcggctgtagatattaacaatatgtaattcttatgtcgatatatacttaaatcaagtgattgggatagatcggtcgcgatgccgagacagtataattcacttagatcgaaatatatactaacaatgagattatagatgtttatagcatagccgatcagatagatctagcatgtatcggttaatactccgatactactctatgttaagatattaaagcaagcaaaatatatcaaacagaagcctaacatactttgttgtactaaaatcataacataaagggctgatttagcatgtcaattatgtcaattatcaattatcattcataagatataaagctaaaccaggtaagatcggctaaaactgctaccctaattggcaatcaaaagcaggctagagattgagattctaatcacgacttataaggtcaaactcaactgatgcagctataattatgaaaaaaaggacaatatctagacaatcaagccgttggatgtttcatagagtggtggatatcctatataatctaagtcaacgttggtatttaacctaatcggctgccttctagcaacagatgttagccgattgaaggttagataacaatattgcctaagattatatagaatatatgataactcgacgaattacataaacaagattagagtatcataaagatggaggcactaatcccgagaacgcaagccgccataacaagttttacctctagttgaagatcgaaaccgatgcagctcaactcgagagcaagaactcgtcgaaacaaaacgaaagtaaagggtggcgatgcgccgagattgtattgaacttgtgttgttgtattacatggggctcggggtctatttatacccgagattacaaaatatgtccgtgtcggacacgactcttatctctaacaaactctaatataccataagtctttgcggcagacttttgcccaaacatatctataaggaaattacatgaaatatcctaattaatagatacaattgccttctcaggactcaatccgtgcatggcaatcctcatgaagcacattaactcaacccgacaacgtgcattacatcatattgtcggtattggctcaatcggccaacctagtccgacttgaactctgtctatcctgatcatagccgattcggactttagtcgattctcgctctatttccgtaacgatctccatctcgaattccgctttgattctatcctcatctccgatacttggatttccaaatttggttgttaacacatgcccctcaagtccggaatatttggtaatgtttcggatttgccatatccgtgtctccgagagtatcgctcattgccatttttccgaccgttaccgcctcgctttaaatactaaccgtcgtccccgagaaatttcacaccattagctccgttttcaccgcttaagccaaccttgtttctttctctccggcgatcccctcggagcaccatacgtccccaaggcgatttcccctccggccaaatattctgcccgcggagatgtcgtcctccgctagtccgttcgtcgcgccatcggccgaatacgcagaggtaagtatccatcggctagatcctctcttttcgcaatagattggttcttccttgcctcatcttgttttcatcttctctgttcttgtttacatctgtagcacttgtccaatctggtcgcgatcccaagtttgtcacatgagcatcactattttcttggtccgatcggcaatcttgatcccactgagttcatcatcgccgaaaccaataggatcccttttagattggccaacccgaatctaggtcactagaagaataccttcaaatcttggccttctcttgagaaaactttccctgagaaaagttgggctgtgtggtataagtgtgtatcggctagcaagcaagttcgctgggacgaattaggaatcggccaagcgcttgctcttactctagcaaattcggccaaggatgaacccctgatggcctccgcagcatacttttggtccaacaccctcaacgctttcttgttcaaccaagggccgatgattcccactctgctcgatatcaccatgcttactggattggatgtaactgcatcggctaaccccatgagcttgaacaccaaaaaccagtttgattttaggaccaagagcataggtggctggtctggctatgttgctgcatacacgggcaaaggatctgtcacccccgggagcacacggcttttcttctgatgtggcttgagaaattcctcttccgcggatcaagctgtggccctaccaccaattggcaattcttagccgaagcccttgagaccaagaggcagttccctctgggtaaaattcttctcagctatctgtaccaaatgttgagcaatgcatcggccaagatagccacaggctcagtagtgggtgcaggtggaccatggtggcaattgcaaacatggcttaaccttgttgtcatgatggttatgaatcgaccacctttaacatagtctgaatttccaaggttggagcccactactaatgatgatggggcgccgatgcctatcatatggtgaagctgcatcaacaccagccaattctggagcaaagctatcggctaaactgctcaaagactggttctgcagtttctatgagggcttccagagagatgtagggtttggttcccatatgaggattcagtgaattttgatctcccggtagacttcacatttgaggatatcaattctgaaaaatttgacaaatctagagaagtcttctcgactgctattagtccatgcatccttcctgtcggcatccatcaaggaagaaacatacaagcttcttatgagttttaccatccaatgagctcagctagatagtttggaatgggacagctatcaatcgacttgttctttgccgataagatccagtacagaggagaaatctcatcaacattgatgatggatcggctgctcaacatcccaggacctcctttaggcagtatcgagaacatagagctggcaaggttcaggagtaggaattttgacagatggtgggggtgaatggaagcagcatatattccatcagccggcctctatgtacatgatagatttatttccagatgttgtccctcaggtatatttttactttgtcaattctgttggaataattgttagccgacttgaatcttgactaacttctttctttgccttgcagacaacagaatcttctcctcctcgcaagagcaacagtggcagggacatagaatatgctccaggccttctaccaaatggaggtggattagctcccccagtcatcggctatcatgcccccaagacctcaagtctgcttcaagggcaaatgagagaaccagccgatgttggcaggttatgcattcgaaatcatgaatgactaatgcataaaataaagatatagaatatagggcatttatgctcaaaggagaggaataataacttgccttgctccaacgcaataaatccgagatagccaacctgattatccaatgcttgaaataccaaaggttgccatccaattataatagactctactgaagaagaggaagaactaaattcaataaaagatcgataagcggctaggagagctagggttcagggtatagtatctcctttatagggtatagggattattgggctatcatttgttggcggtaggtttaggtagtataatagctagggtttagttatatgagagtcgattgtggaataggatagcatatcggctaggctctatattttatatggaggttccagagggttggaggctagaggggattaagcaactactgtcacttatattttatgtgaaggctctcgtggtttggatgatagggaatatactagatatttgatatggttaaataggtatgtggctaatatgggtcaaggttgggctttggtagaatagtggttagggtttagttgtttaggccggtatcgagataggataaatatcggctagggttttgggtgtttgctagtcgtcattagagttgggcaacatgacgactagatttggtatcttctctagccggtgtcggtggataatatatcagctagagaaataggaggtgggtgcaggtttagtggggcggaagtgttactccgacaaccgtgagttgtgacggagtggctaagattacacagagcttgagagcaaactgtgtggcctgctgtggaggtcgaggaaatagtgaagctccaaccgttgtacgcgtcgaggcgtggggtgctagagtatcaattcaaccttgggtttgggttttgctaggttttacaaccaacagtttgacgtcatggccagtagaccgtacggacgtccacatagaaggtgtaaagttttaaccggcggcttttagtggctaaagggtattttaaaaataacaggaaatatttgaaaggtaaatataagtttcaattataagtttaaatcaaatatttattcaaatggtatttgaataaattaaggaaattcaaataaaatcttaaaatagcaaatttgatatcaaaatgaaggatttgaatttaggtccaagttttactggaatcggattacggtttaggagatatgggcttctaaagattggattttgaattaaatctagaaattgcgaaatagtactgtagggggcccacctgtcattagctgtcctttttctttttcttttttttttctcttcttcttcctcccgattcctcttctctttttctgttggcaaccgaaagggagagagaggagagggcgagcggggcgcccgcccttcggtggccggaatgcggcgacgccggtggcatatcgtgttcccgctcgatgcgtactccaggaggtcggtggctggtagagaggaagaggaaggaaaccagaacggaggcggcaagaacttgctctgaccgcttaaagaagtgatgatggtggctgctatggagtgggagagaagggggaaacgggaaaaatgggctcgtcggagggaggcgaagccggtggtgcgaggagaggggaagaggagctacggatggggagatcgaccgacgacgtcgacgatcggccatgggaaagagagagacggagctcgaagagatcggtcgatgtgggaaaaacaagagggggttcgttcacttatataggccatgaaaggcggtggcggatgacggttgtagaggagaaacacaaggacgattttgcgacggcggcgtggaaaaaaaggaggcggcgccggcttcttcctgcgattggttgggcagtgatggcgtaaggacgtgccgcccgtggaagagttggccggcggagtagggcgcacggtacggcatcgacgtcggcgtatgaggtcagcaggtgacggtggcacaaaccacggcgacggcgacgctgtgggcggcggcgcactaatggcgcacggcagcggcggctgtggcgctacatgcgcccacaggaagaggagggaggtgggaggatgcggctcagcagtctgggccggcttgggccgcgtgagtgagagaaattcggtccaaagttaaaaaggaggaagtctaattttcctagagattcaaataattgatttagaggaatttggacggctagattttgaaaaggatttgaattcggagatattgatacatggagaaggattttaaaataaggatgctctaatttatttgagtgcaatattttgagagatagaatataacgggatttatttaatgcactcaaatgagagggaggggaaataaataggatgttagccgcaaattatttggcaaggattttggggaagtatttgaggctaataggggacttggattttggatgaaaagataaaacctattttcttggcacaagagtaattattcacaatatttgtaataatattattcttgcaccgagaagggtattctagccacacgattcaaatcggtggctaggtcaaaaggaaggatttggatatttgaattgaggtttaaggataggtttaagatcaaaggattggttaacaattaattccaataagattggaattgctttggtttaggttctagcacaatatgggaaggtttcttggaccataattcataatagtaaaaaggttttcaaactaaatttaaataaaagaaattttaggaaaaagaaggttttagattgaaaccaaatcaagaaatacctcaagataaatttaaaataaaaatcacaaaagattttgaacatcaaagagagattttatgcaagttaattttaggagggccctctaattatattgtcctaggtttaggaggttattgagaacataagaatcatcatgatgcaagattagaaaatagttaattttcaggatgttacatgtcacttgaacacatacatgacgtgtgaaggggtgggaagtgggtcttttccgtttttatattgttaagatagcagtagaaaataataagtataccatgtttaagttaaaataatcgatggttaggtgtattatgtaatttctttagaatttctaagatttattgtaaactactggaaaaaccatctttggtcggtcgcccaaaaaccacaatagtcccagttcgaataggaaccgggactaaagattatttttagtcccggttaaaaactttttgatctttagtcccagttgatgttaccaatcgagattaaagatcatttttactcccggttcaaagaagttattgggtcaagttaggccccaatcatcttagatctttagttccggttctttatactacccgggaccaaaaatcctcccgagcgcacgtcgagtcctctctctcagttttatagataagaccgataaaaaccatatccacttcctctctcattaaaaaccatctccactctccagcctcctcgatcccatctcaatctcaggtgttctccttctcgatcggctctagcatttttagtcccggttagtaacacgaaccgggactaaaagttgattttttttttgtctcggttatttcaccagggactaaagatttatactcccggttgcaaaaccgggagtatagggggttgtaaaccaggaggaaataccatttctccaccagtggtagtgtcacatggtggcttaggagtgttcataggagtcccgtgtggtggtttgagagtattttgtaggaattttagttgacttttagcatataatggatagatatggcatgctaagttgtcgaaatgtgtgcctaatatatctctacatgtttctttagggaatatatttctacaagtaaaattatactggtgtaaactacatttttctgacattgtagatctattttatttacatgccagtgaagttattatatagcatgaaacaatataataatgtcactttcttttcataatttttacaagctaaattatagttaagaggtgtattaaattctaatttgtgattttagttataataatgacacaaatagaacatataatttcatccgatagcaaaaaaaaaaacttcctttaaagagaaacagagaggagttatgtacatgcgtatgcacgggaagaggggacacctctttgtaagaaatagaaaaatcaaactaatccaagtatccaacggcttggagtggtgtgcctattaattttagtgaaatcaagggctaggtttttttctcagattttttctaatttattggagcgtcacgtggcattatagaagcatttatataagcatcatgtgacagcttagaagcatttatagaaattttcacggacttttactatataatataatagatagattggatatcatcgatataatttagcgaaacatatttgtagaattattgaaggtgacatataatataatatgccaactagagatgaggggagagagggaatacgtacgtacaggaggccaggaggggaatgtacaggtggtggggaccagtgtggagagaggaggattttatttttttatttgatctaatggttaaaaatgttggagccaccaatttaaaagaaaatcaacggttatatttttagactgtcacttggcatcttaggagcgtttgtaggagaacacgtggcggtttaggagtacaggtggtggggaccggtggggagagaggaggattttattttttttatttgatctaatggttaaaaatgttggactaaccaatttaaaggaaaatcaacggttagatttttagactgccacttggcatcttaggagcgtttgtggagaacacgtggcggtttaggagcgtttgtaggaagtttaatggacttaggaggattttattttattttatttgatctaatggttaaaaatgttggagccaccaatttaaaggaaaatcaacggttagatttttagactgtcacttggcatcttaggagcgtttgtaggagaacacgtggcggtttaggagtacaggtggtggggaccggtggggagagaggaggattttattttttttatttgatctaatggttaaaaatgttggactaaccaatttaaaggaaaatcaacggttagatttttagactgccacttggcatcttaggagcgtttgtggagaacacgtggcggtttaggagcgtttgtaggaa

SEQ ID NO: 28895 - DNA, 3065 bp, Oryza sativa
ggtttaggagcgtttgtaggaagtttaatggacttttagtatataatagataaataatagatttggaggagaatcgatcatgaagcaagatcaagggattggaagcgcttgagttcgtcggctgggagaagaacgggtggcggctggggaagacgacaactcgtcgcgtccctgggtcggctgggccgagcccgagcaaggagggaaggtaactggggtgaggcggctgcagcccaagggaaggaggggagagggggattgttcaagagagatggtccgagggagaggatggccaagagggagggagagaaggaacaaattcaccttatatccataatttgtcaccgagtttaaaattcatccacaaaccaaaatactagatataatggatctctcaatttacaaaactggatcacctgaggttctaggtagtattatgcccggttttagctaacctggcaaactgagtcagcgtgagacccatgcgggctccacatatcaatggcctatcttcctctctctctctctctctctctcctctcttctcctctctccgccctctcttctactctcttcccaatcatcctggatgccgatcggccgaccgacgccatgaggaagctgttgctgccggccccacgccaacatgaggaagttgctgctgatgcatgattggacacggcctgtgtgaactggaagttgaggggccaagcgcggctttggccgatggactccaacaatgacgacggtggctccgatgggggcacacgacggtggtggcacgggtccgcattccagcggccacactccataagcacccgatattggctctgtttaaaaaggaaagattatgaatttctgacatcaatggtcacatggcttaaattacaactgactaattcctgagaggggcgacaacgacaactgacaggtgggccccacacggcgcgcccagaggtagccagtatggtgcaatcagtgggaggaggcgcctatgcctgatgatcactgccagcaaccatcggtgcggcaagacaaggagagggggcaggtcaggaagaaatgggtgaggcctcgcaactcactgagacgtggcgggggcagaaacgagatgaggcagggatgggcgacaagggggacagtggcattccattgatctccaggctcaacaaaggggtggatgaggacagcgaggatgaaggtggtgaaaccggcgacgacctgtaagtggctgcggcggtgccggccgcacgcacatgctaggccggcccaaggccaagcggcgaggaagagagggagggaggtgtgtggggtcaccttgctgttgttggggaggaggaggaagaggggcagaggctgtccctcgagatctggcacgtggatgtggtggggccagcagggactgacgacttgttgacggtccataagtaaaaaatatatgaccatcaattattgcataaaaccaattggaataaaacatcaaacttagtgatagtggtcattactaatcatttccgcacgagttggtgaatatttgtttgtaggtgaattatggacgaaaactactagccatgcgatgaaagacacccccggacaattggaaacgagtacatggattggaggccccacatgttaatcaaaatcacctaaaattaaacccatgtaaggtacaacatgcagatggcccaccatgcaacctctcagccgaaggattaagtttgttttagttgcatttaatttaactttccttcacaaaattgcgagagcatcgccaccggttggacagagcaccactgtcggggtgtgcagccatagtcgctagcatcactagagcatgcattgcttatcacctgatgcatacccagagggcattggttaacacctgatgcatacctagaggttagacaaaggagccgacaaatgcattccaattggacctccatgtagccgaataatagattctcactgcatctagtgtgttgttactgaaaaaaaacagatatacggttttgtttggaatctatagagctggacaaatagaacattttctaactagtgtagctttatagcaactagattgtctagtgtagctttatagcaactagattgtccagtgacgttaggggatttcaatataataagaaaggaaagtgagaaaagtaaaaagggttatagtagatagagtttcttaatgcaataattgagcaaaataatttaatacagtttatgagaaattagatagtattttggtctcaaatgaatcattttcccatggtcatggtgaaggttagaagtttagaaaggttaatagagcaacgctccgctgatttctacttgcagtattctactacaagaagaattaatctcgaccctttattttaaagggtagattagtaatctcttaataaagattaggggtaattttggcatgggatatttctctgtcttgatcgctcgcatcaggtccgatcgctactcccctaaaaaaagattattgctactcctggccggtggcggagcgactggcggcgctgccagcgttgatggaaaatcgcttcaatctgcttgcacacatcgggcgtccctcgacgcgaaggaagccaacgcggtgatcctgcaatcaaatcaacaagaaataacgacaaagaaaccatggttaatcctataaacgatagccgatcggctaagtgccgatgacatatcatttatctttgagaagacgtcatatgtgtatcgatcggcggtcataaatagataagaaagaactaaatctactcgatcggctgtagatattaacgatatatactcctcatatcgatatatatacttaaatcaagtgattgggatagatcggtcgtcatgccgagacagtataaatcacttagaccgaaatatatattaataataggactatatatgttcatagcatagccgatcagatagacctggcatatatcggctaatactccgatactgatctatactaagatattaaagcaagtagaatatatcaaacaaaggcctaacatacttaaatgcaacaagatcttaatataaagggcaga

SEQ ID NO: 28896 - DNA, 3837 bp, Oryza sativa
tcaacgaagcatatagagtaaatatagttaaatcagataagatcggctgaaaccccgatactacctgttggcgatatagcatgaggcccttcgaccaaacctgccgaaaccatgcgaccagtgggcccatgaacctcaattatattgtgtacccatgtaaatgtctctttcataagggcaactatgtaaattcccctgtataaccaaaaccctagtagtaagaacctataatggggctataaacatgtaatagggggatcccccaagaaaaattctcaagttaatacacttcttttccaactactgttgagtaaccacgtctttcgacgtatgcagttgtcgtttcgacaacactaccctaatcggcaaccagtaggcaggctagagattgatattctaagcacgacttaatagatcaaactcaactgatgcaacattaagtatgaaaagaagaacaatatctagacaatcaagccgctggaagtttcatagagtggtagatatcttatataatctaaatcaacgttgatgtctaacctaatcggctgctctctaccgacagatgttagccgattgtaggttagatagcgatattgccaaagattatgtgagatatatgataactcgacaaattacataaacaagattagagtgtcataaagatggaagcactaatcccaagaacgcaagccgtcataacaagttttacctcttgttgaagatcgaaacagatgcagctcaacccgaaagcaagaactcgtcaaaataaaactaaagcaaaagggtggcgatgcgccgaaattgtattgaacgtgtgtgttaattgattacatggggttcggggtctatttatacgcgagaattacaaactatgtccatatcggacacgacttcttatctctgacaaagtctaaaataccataagtctttacggcagacttttgcccaaacatatctctaagaaaattacataaaatatcctaattaatagatacaattgccttctcaggactctatccatgcgtggcaatcatcttgaagcatatcaactcaacccgatgtcgtacaccaagtcgtattgtcggaatcggccgtatcaccaaaccaagtctgtctcgaatttagccgatccaatcgtagctatcacgcccagaaatttagcccaaatttccagactattttgtgtattaaatccctgtccaggactagccagggtacacaaaacgacaagtaataaacagttccaaacgtaaataaagcgtaaaatacttacaggagaggcacttagtcctcacaccgaaacaaaagcagcggcagcggaaaagacgatcctagcggggcttcagcaccactccacaggcaaaactcaactgaggtctaagccttggtcctctaacttcgtcctcagctcagaagcactacacttctgaaaagggggaataatagcaaggctgagtacaaccaccgtactcaacaagccacaccaatgatgcaggcgtgcaaggggaatacaaggacggtttgaggctatttgcataaaggcggttgtaaaacattttattgagcaaaaccgtaaaactattgagtaattaaagtagcattaaatctccactgatcaacgctataccacgttgaacaggcccaaccaacccacctgaactacagtgcattgagtcgatttattaaggtgggactaatcacggtgaatctggtcgaccgctcataaccgcgggcacggctattcgaatagttttactctgatcagagatgtacaactgtacccacaagacacagccccacgacacgtttccgtgcgctgacatgccaccacgacataccggaaagaggccgtgacaggacccttcgcataaccccctctaaccaagcacaccacacctcaggtttcacccccaatcctcgcaaggcagcgggcagtcccctctcgtgcctaggtgaatccggaagccgcataggctgtcgcagggcccatccaaactccatcacgcccacccttgtctggatgcgtcagctagaggaaagctacactacaagcccagccgttgcccacgctggcttgtggtaagcacgataaattcttccagggtttccgcgaaccggtccttaatcgccatgggcacgactagcaaaaccatgcagccacagcctaccatgtagtcacattttagttggataattacgaccatgaagcatggccagatgtctcgagcacgcagctcattctgatactaaaaaggtctaatactgtaatcagctcatcaactgagctagtggtaattaagcatggctaagcatatagttctagctaggtcacataagtaagatgagctagtcgatttattacccaaggttgacaaaggacagatatcaagtaaatatggcacaagcaaacagataggtaatacccggatcccatgtaattagcaacacatgcaattttatttgcaaacgataaaacatttataaattaggatcaaaatgctcaaggggaatgtgtgacttgccttgcttcttcacttggatcttctgaactcttttcctcgcgaccgcgatcttccgaaacgacggattctacacgctggcaattctacacgctggcacgcaaaacgaagaaaaactctaataaaaaccaaggaaacagtacataaaaagtaaaaaaacatgtagatctcaattttagatgaattttgcaagttgaatggcccaatttggagttcgaatgaattagatatgaattttagaagttctgagccatttaaatgaatttctataattaataccaatttattgcgcaattattaaatatttttccaaaggaaatgataagtgctgacgtcagcaaaggggaagggtgccgacaggtgggccccacacgtcagcgggtcaaagggggtggctcatggtggactcggtccaccgcagcacaggcgcgcgggcacaccacgtggaagaccacgtggcggccacgacggcacggcggggcgaggtggcaaaggcatggcgccgaggtggcgccacgtgggacaccagcgcggggcggcgccagagccacgtggacgacccggatcgccccgaaggggatcgggcggccacagctagcgggaacggcaaaactcgccggccgaccggccggggagcgacggcgagcagcccagaggtcgccggcgacgaccaccggcgcgacggcacgcgcgagaggcagcggagggaggcagaggagggagatggggagctcaccaagcgcacaaggcacgaaggcggtgcgggagagcggccgacaacgaggaaaggcgacggcgtttcctcggggaggcacggctacggcggtccgatggcagtccgcgagcgaggagtggcggatgacaactggaagagcctgaggaggacgaaggggggattagaagagggagaggacgggcatggcgaagggcaatagtggccgaaggccgaccgtgagtagaggagctcaccttgcgcggggaagatggggttcgagcgacgattgatggaggcggagggatggccgggctgcgggcgacggccgcggtgccggggaggacaacagcgcagcacggtgtggaccggagaggcggcgcgacgcggccggaggcagcaaaagcggcgccggcctcgggcttgcggtggaggtggtgattcggcggtggatcgaaggagcggtgtggtggccaggcttgcccgcgcaacggcgaagctagcggtggcggcgacgcggcgcggcgacggctagagcggcgacaggcggcggctggaggcggtataggcggcgggggctcctctagagtcgccctacaggcatgc

SEQ ID NO: 28897 - DNA, 4077 bp, Oryza sativa
tgcccctctctatttccggtcaaattgattgagggcaaatgatccttgagatctcctcttccttttctcttttggaaacattggctaattttctttggaaaccagtggatttgagttggattcggattcatctctctcctctaaccctagagtttccttctcgccgccggtcaccgtgggcctccgtcgccgcctcctagccactataaaagcatccccgggacctcctctatccgccgccacctttgccttagcccgccatcgcgtctagcgccgcctccgcgtagccctagccgtcgccgtcgttgccgtcggtccagccgtgcgccgccgtcgctccagtcgtcgccgtcgctcggggaggtcgccatcgtggtcgccgttgcgtcgccgtccccatccaccgcttcgccgccgctgtagcacgccggagcaccgccgtcaccgtcgacccgaagaccgccgccgcttcaacctcgtcgccgtcgtcatccgtcgtcgtttgtcgtcgtccaagagctcggtgagttcgccgcgtcgctctctacccgttggtgtcctccttttgcgtcgtcgcgccgtcgttcgccggcgagcatgtgttgccgagccgccgccggtgatgacgtcatcgtcgctgtccccgtagacccgctgtggaccattttgaactcggccgcccgttttggatagaatcgatctcggccgttcgtttccttagactgtcccgtgcacccggtttaccgtggaccgccttggatgacgcaataatcctccttttccttttcaaaaataattcattattgcgtcataattcaattaaaatccatataaatgctttaatccggtttaatctttaaaaattcatatctaattcattgtaactcggtttaatgtggttcaagttgcaaaagttgtgtaaaataaagatctacatattaaaattatccataaattgaattaaatttatttaattctttttaaatgggctttaattagatttaatctagtaaaattcataataaattcatatgaagtcagaatgaggccgttcaagtctcataattcatctaaaattatgatctacatgtttgtttactttttatgtactgtttatttggtttttactagtctttttcttcgttttgcgtgttagcttgtcgtttccgtcgttttgaaggttcgcgagtgcgccggaagtattatttaatgatggcttaataatagttcacgatggtcaatcgtgattggttaattaattacttgccaactaaaacttgataatggtgggttgtgagcacatggttttgagagtcgtgctcatgacaattaaggaccgcttcgcgagctactattgtgaaacattaaccgtgccaaccacaagccagcgtgggcaacggctttaccttttgtatagcatggttcattgcagagcaccagactgagaagtggcggagataagcccacgggggtcgctggggagtccatgcttgtttataagggggtgattatgatccaggaacggtgcactgctttgagttgtgttgtgcgaggggtactgtcacagctcctttccgaggtaccgtggtggtattgaggcgcatggtgacatgtcgtggggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttggagttagatctgtacagccgggtatggttgttcaggatggttgggcctgtgcagcatgggtgtgctgttcagtgttgattaaaatttctgattaattactctactgttttactactcttaactctttgctaaatgctgctttcgcaaatgagactatattatgccatcctttggtatccttgtgcacttgcatatttgctgtgtggcttgttgagtatgtcatatgctcattcttgcaataatcaatcaacctcagttgaagaaaaaggatccagaaggggaagacgtttggtttataccccagttgagctgcttgtgggagtggagccggagcttcgctagaccgttattccgctgcagttttcttttcttttgtaagtatgtaacgttattattgatgattctgtatattaaattgtcagtttgtgtacctcggttgattcctggacgagggttttatgcacaaattagttcggaaattactagtgaatttctgggcgtgacaggtggcgacgtggagcttgagagaggtcaaaccggcgtgatttttggggaaaagtgggggaaaatgaggaggagtgggtggcgaccacgtccgcacggtcggacgtgcgcgcgggaggcggcggttttagcggcggggtggggcggcaatggcggcagttgccagtccatggcgatggggtggctggaggtaggggaaggggatgacatgtggggtcgcaggtcccacctgtcaaccaatggaagagagaggggaagccgggtgggggttttctagactttgggggggagaggggagccgagctgggccgagcggcccaaagaggagaggggagggaggcgggccagaggggaagggggaaggaatttgggccgagcccgaaagggaggaaggggaagattattttcttttctttttatttaaattgattaaatgaactttgtattattataattatttcttgagctttgaaaattcgcagaaaaatcctgagagtattttagggcacaaagaatattacaaaatattctcggccaatgatttttaaaggaaaatttcaaattctcccattatttcacttgattgaattgacttaacttttatttaatttctagaaaatgcattatttaatgatttttaatcctgaatgaaaatcgggtcgttacagtagccgatccgaactccagccgattcttactctgttctcgcgataatctttatctctgattccgccttcctttccaatgccgatgttaccaaatttggttgttaacaccgcggccggcgtgccagtgcctcgcagcgtgcgcgcaactgtacatgtccgtcatctcctagctccaggagaaagatgtacctataaattacaatagtacccctacgcaaattattatccctggacgaatatacccctccatatttctactaccactaactttggtggaagtagaactaaatcgcaaccctacaattaaatatgatcaacgtctcagattactttctactctaagtagaaagcaccggagcaggactctattttctgatcatgtgccaattctggtagatacagtacatatgtttgtccctcagatatacataggtttatttgagcaaactttattttaacttaggttaggttagtttttttaagtgtcctaatttacgctctttccattttaattagcacatattcattttaaaatagattcacttttatcctcttatctacccttcggtaataaatccatgagttttatttccccaataccccttatctacttattcactaacactgttttcttgttaattagaaatactttggtcttttccctattaatttgaacttaattggcaagaaatgaagttagtttcacgtacggaggtggtaaaactttaaaaggagtggggtcctggataatggcatggatgaatcgggatagtttagactgtttttcctcacccaaataactataacttgaccaatatagcatccgtaggaaatacgtagtccatcttgacgatctagctagatacgtaccatgtcgcataaattgtcacttggggtactattttttgtcttgaaaaaatgaaagaaaagacggtacatacaggactttttcatcagtttgcaaacttttcatctcaggcttgtaatcattaacgcctggcacacgtggcgtagagtggccgacgcgttaacagccaacgaaagagtcatcagtcacggaccgcatccacgactgtttcacatgtacgttttgctagctacaacaacaatttcacc

SEQ ID NO: 28898 - DNA, 7073 bp, Oryza sativa
ttaacagccaacgaaagagtcatcagtcacggaccgcatccacgactgttttcacatgtacgttttgctagctacaacaacaatttcaccgtctcctagctcagatacgcctgctacaacaacagagttgaaagcatttgcctcatactcctccgtggtgttggaaacgcccatgagtcaattgggagcccaagggacaggaaactccgagtcaaccaaggcggctgttggtgaggtggtgtactccgacgaggtttcgacacagctagtgaagttggcaacgactaaggtactttctactgaggttgctgtgcagctagcaggaacagatgaggtggttacgaatggcaaagagcaacaacaagaacctgtcagcattgcacaagaattacagcatgtttcagctagcttgttgtctcccgtggagcatgtattggattgcaacgtgcagtctgaattgttccccgagaatagccggcttgcaggcgatggaagagtagcatcgactaagaacttgatggcagtactagcaaccaatgaagaccaacttagtgcctccagggctgccacatctaaagcccaggattcagcacaggcagttggagctcgatccccgacaagaaggcgacctcgtcgcccagtggaccctattccaactaggcaaagtgaaagatagaaggcgatagcaaatgcagatgcgccggtggcaaaccgggcagagctgctaaaaaaggttcataaccttgagacgctaacaggtaacaagtttaataccacaaattctgttgtttcaattccagataagactcttgctacaaatttttctaaattaggggtttctctaggaaagaatgatttacaaataaaggaatccattaaccagattaaaatttcagaagtggatagatttgctactctttatagtagtgctgtagcgtctactagtaatgtagataaaaacaacgatgaattgttaaaattgtcttctctccagcacttatgtagtgactggctagaagaggctgagagtaatgacgatgagtctatggattctcaggccatacctcgaatgaggaagatttcgaccaaagtcaaacataaagtggtatgtcctcttttgactggtccaaaaaagaaagctaataagtttaagaaatgaaaggaatattttggaatagttgtggctttggtgatgcatctaaatttagatttatatctgaatgtgttaaggagcaaaatttggattttattgccattcttgagactagaaaaccatgattcaccccttcaaatcttaaaaacctttgtggtggaaaagattttctttggcatgagaaacctcctatcgggcgatcaggaggaatacttttaggagtaaatttaaatgtttttgatataggtgaaatttcagaaggggacttctatgtgaagtttcttctaagaaataaagaggatggtttcaaatgggtttttaatggcagtagcaccaataggattacaacggttgctcacaaagtcattcgcccgacccaaacggcgtttttgccagatagaaatatcatggaaggggtggtgattttgcatgagactgtccatgagttacacacaaagaaaatggatggtatcatattcaaaattgactttgaaaaggcttatgacaaagttaaatggcagttccttcagcagacattacgaatgaaagggttttcacaatcatgatgcaattggatttctaactgagttgaaggaggaactgtaagtgtcaaagtcaatgataatgtatgaaaaaatttccggacatgcaaaggcttgagacaaggggatccaatgtccccaattctttttaacatagtggctgacatgttagccattcttattgaaagagccaaagccgatggccaaattagaggggtaattccatacttagtggatgatggtttgtccattctccaatatgccgacgatacaataatatttcttgaacatgattttgaacaagcaaaaaacatgaaggccattgtttgtgtgtttgaacatctctcggggctgaaaataaacttttataaaagtgaatttttctgctttgggggagccaaggaaatggaggaccaatatagacaactgtttggttgtaattctggttcctttccattcaaatacttaggaatccccatacactatcgaaaactcagaaattctgattggaaatgtgtggaggataggtttcaaagaaaacttagcacatggaaaggcaaaaacagctcctatggtgggagattggttcttcttaacttggttctttcgagtcttcccatgttcatgttatccttttttgaaatacctcgaggtgtacttcaaagactgaattactatcgatcgagctttttctggagcagtgatagccagaaaaagaaatataggttaagaaaatgggattatatatgccggccaaaagatcaagatggactgagtgtcctaaatcttgatatcatgaatagatgtttgttgagcaaatggctattcaagcttcttaatggtgatggtctatggcaaaaccttttgcgcaacaagtacttaaagggtaaacccctctcccacatgtcatccacagagagagagccatctctctggactgcactcttatagtcgacagctctatgtggcttgtcaaccaccggaccgtagctcctcacaccaagaaacccagtcttcccccagaagactgtcttcctcgactatacattctcctaccccaaacactctaacccagacagcattcgttaaacggtagcttccgcgcccttcctgcctgctgaaattgatgtgaatgatcgtgtcttcgacatcaatttcagtctgattagatatgtcattgaaacaaatccgttttgtctctgttttcttttcggatgagccagaaccaggaacatcccaattttgggctggcctaataaaagtaaaagatcaattttttcagtatggatcttttaaacctggtaatgggatggaaataagattttgggaagacatggttgggcttgcaacctctcaaatatcaatatccttctctgtacaatgtggtccgaaaaagacattctactttggcagaggttatgagcacaacaccgttgaatgtttcattccgacgatcaattgtaggaccaaagttagttgagtggaatgatttgatctctcgactagctaacataaccctgtcaaatgaaaaggattgctttatttggtcgctacataaaaatggccatttttcggtcaaatccatgtataatgcgatcatcaattccaatgtaagaatccacaagaggatcttatgggaggtaaaggtaccactaaaaatcaaagtatttatgtggtttcttcacaaaaaaaaaagtaatcttgacgaaagataatctcataaagagaaattggagaggaaacaagcaatgttgtttttgtaatatacaagagaccatccaacatcttttctttgactgtcatgttgcacgttttgcttggcaatgtgtcttctttgccttcaacatcccccctccccacaatgcaaaagatatttttggtgactggctaaggggagtgcctagacgcacaaaaaaaataattttgtttggagctagtgatttatgttggtcaatttggcgttgtcgtaatgatatagtttttaaccataaaaaatgcctaacatcatgcaggttatcttcatgtattccaattggctccactcttggtgtatgatgctttcacaggaacaacaggatactatgcgcaatggtgctacacgcttggaattagtagccaaggaacttttattccagtttggatggcgtagtacctacagaatttcgtgatagaatctacgtgattttgaaaaaaaaaattattttagtagatcatatcatcggcagaagttgggggtttgtcccagctcgccttttttaacttttctgttcacgtctgaattttttggctgtgtgcctacgagcagaggctggagatgtaacccatttccattatctaaaaaaacgtttttcgagctacaaatcgttgtgtttttaaaaggaaattctaccttagagattgttgttatggagaattaattactccattttttttaatttaaaataattaatacttaattaatcgtacgctaatgactcttctcattctgcatatcttcatagttctctcacttttcattcactccgatggtcacacatctcatcctgacaagtatcaattacagcaattgagcaacgaaataagtgttaaattgtcttttttttccgtcaaacacacaccctaagttgtcgtgttccaaacataaggggcttgtcttactttctaggatcatcatcgtcacaattcgatggacttgactgatgctagagctaccgagtcattggtgactgctgaaatgagatgtttaaattaaggttgaatttaatgtagtaaggcccggcggctatgggcatcagtacaagcaaacgataaagaccttgtacatgtctaattatttaaaaaataaagccaaatcaaagctctactctataatactcctccgtgacaatgtctagaaatatagctacctaacactacgtatctggatagggttatgtttagattcgtagtgttaactagctactccctcgatctattttaggatttttaatttttagtaaatattaaggttaattcctctttagtaaaaagatttctttctaactaattgattggcttttaaatcattgaaatgatgaaaataattgaaatattagttcaagaacctataaagcatttatatttttgaacagatgacgggggattatcagtcaaagaaaaaccaaagagactgcaactagtgcaatgcaaacacttggagacgatggaaaatggcggttacattctgtcgtcagtcgacctatacaaggttgcagttattaattaaataccaaggtttccggtcaatccttccagatcatctactcactctactacgtcagatacgtctccatcaatctgtgattctaatgtaaaatagtactcacttatactatttttggtcaaataatccctctaggcggctgctaacaggttccaaatatgtccaaattagcctttcgtcatttattctttgaatgcgatgtaactaaattcacacagatctgttcacattggacatcacttcgcctatagaatatcacacatgtattgggtcatggtttgatggtattaaaagaactatttcgactattttaacaggtactagtgctagtcaagatgccaccttgtaaaccatgtcaatttaaatgttatacatttataatagggtggatagtcaaactagtcctccaaatttcacctacatctcagtttgatccttaacttttcaattctaccttccatattagtccttaaaatttttattttagttcagactcatccttagagctatttaggaagccacatgactaaatctaatcaacatcataaataaccctaatacctctctcacacatatataagaaaagaaaaaaagtatatatagaaactatatggcaggcatcacccttttatttttactggcggaataacaaaacaaatgcttggaaaatttattggaggattctaagtcacgagacgacagcaaaaaccaacttcccatgacgtgcacttaggaggtccgccataaaaaataactctatttttttaggtggacctcttaagtgtccgccaccaaaaaagggtagataaagagcaccgttgtgaaaaagattcatggttttaaaagttgcacatccactgcccaacacccaccaaaccctccctctcctctccgccctatctccgctccctcgcctctcctccttcctctcccttaccctcctttcttcagcttctcctcggtgctctcggagatggtgatggcagccgtggtgatgacgacgacaatgatggaaacgagaggtttgttcacggcggatccgacagtggggcgggacgtgggcaatggatgtggcagtgaggaggcatccaggcggtggatccggcggtgggaggtgcgcaggcggcggatccgggagcaggaaggcacgcggctatggatccggcggtgggaggcatgcgggcatccgatccagcagtagggaggtacttgggtggcggatccagcggcggagaggctcgtgggtgggccggtggagcatggctgcgcgtgtgggcgggcaatgaagctcagacggcggcggatccagtggcagggaggctcgcggtggcgagcgggctggtagagctcgggcacgactatgtctacggacgaggcttgcgtgtgcgggtcctgcggcatgtcggccacagcaaggacaactaatcagcgacatcgacatcgcccctccgcaccggcaagaggagctcgacgccggcgtcaaagagtgcgttgaggtggtcgatttttttatcttagtgtgatacattttatggtttgttatttgtgatttcttgaatttgtggttgtgggattggaggatgtgatgtttaatttgtggatttgttattgtgggattagatgcaaattcatagaatctgtgattgtgggatgtggtgttcgatttggatttatgattgtgggactagagacaaactgatctggactgtgaatctggtttggttggttctaaaaatatatatatattttaccaaaaaaatattttttctggtggtcggttctgaaaatgaaaaacaaaattgccaaaaatatttttgctagtcgtccgtataacctagccaccagtgaaactgattttggtaagcgggtgaggtctccctgcgatgatcatcatctattgtcactgacccatgatcgcaagcagctaggtggtcccctggtgaaaatgtgtagttatatactacctccgttttttaatagatgacgccgttgactttttctcacatgtttgaccattcgtcttatttaaaaaatttacgtaattataatttattttgttatgagttgttttatcactcatagtactttaagtgtggtttatgatatatacatttgc

SEQ ID NO: 28899 - DNA, 21872 bp, Oryza sativa
tgccttattgtcttaataaagaaaaagtctaaatacccttaaaactttaataaaagtccatcttacctaaattgtaatcattcatatgaccttaagatgattttacaaagtggtttttatttaattcttttcagaaataaagtacaaatgcattcactaataagagatgcgcactttccctgtaagtacacacgtacactgtaccctacccttatgagcaactccaaaagactaggttaatatatcttgatattgataaagtaaccacgcagttgtttgtgtcagcggccacgtcacaaaccattgaatgaataaatcgcataaatactagcacgcatgccaaatctagtacttcaacccacataagtatgttgcgccacaagaaacccaattatgttggatcaatttgactatttgacatatgcattagatatatgttaaaatctctacctaaatatttctgtttaggcatatgttcgctctctcttaatatcaatataatactagaataacatcactgtaagcataaattgagaatcgaggattgactatgtgtaaataaatatgttatattcattatttaaaaccgtccgtttaagtgtcaaatccacaaaaccgccgttcaaaaccaacttaaggtgtaatataaacaatactataaagtttagagattggatgtccagttctaacgtacgttcagtgtactaggtagattttcatccaaaatttatggagtatatggacttattcctctcaataattaatgcaacgttcttgctgtaattcccattatttatagaaaataatttggactacaaaaagaaataattgagggtaattaatataatcgtccggacatcgtgcgtacgcctacaaaagaagactctagctaattaagagctgtccacaccatgcatccgtccgcatataccctgtcaacaatgtcagacttaatttttgactttattttttcagaacactctatatatatatgacaccgatgatcgatggctttgggtgcctccctttgcctgccttcattcgtgaattaaaagctttgggtgcacattgccttcaaagttcaaacggtgcaagggcagggcaggtacgtagctctctggcctgtgggctgctggtttcttcctccacacctctaaaaagtactactttttttctactgtattgcttaggccatttcttgtaagcacttaggttgtgttattccccttctttcccaactcaactatctttttcttccatgtaagcttttcaaactgctaatggtacgttcttggtaaaagttttctgaagttgctttaaaaaatcatattaatttattttttattttttttgctaatacttaattaattacgtgttaatctcagccttagtatttgttaacaggttgtagcatgtaggatttaattctttcataattaaataaataatctatcagtttccatttagaatgctggctaattctttaattcttatgtttctcttgatccatgcttcattactactagctattgttatttgggttcatctgttgctcggtcgaggctactctcactggtcagaaatctaagcttcattgaggaagcaccggtggtaagtgtacaactaacccaacacaagtcggttactaattattatattaaccgcctaaatttctcctaaaaaataagcaccattttaaaactctaataaataaacaccttaatttggctatttgcaggaccaaagagaggcatgtcgacgatggtggtgagcgcatacaagggggtgattgactctgttcttgcaaagctcagagagctgatgggaggggacatgtgtgccaacctcataggcgtgtccagcagggacattttgttcctcagggatgagctgcctgccatgagtgctctcctggagaagctggatgatgccgaagaactcgattcggaggcgaaaaattggaggaaccaagtgagggagatgacctacgacatcgaggactgcatcgatgatttcagtaacaacatcacaagcgtagacgctaagacggggttcctctacaaggcttcccaatttctcaagacttgcagggctcatcttgaggctgcctggcaaatcaaagagctcaagactcgtctacaggagataaacgagcggcgtaagaggtacaaggttggacattacatctctaatactacctcagtgacagttgaccctcgcatctcggcattctataaggagacagccggccttgtaggcattgacagcccaaagagagagctcactaaattggtgatggacgaagagacgcaattgaaggttatgtcaatagttggatttggaggcctaggcaagaccaccctagctagtcaggtgtatcgtgaagttggagtgcagttcaactgtaaggcatttgtatctgtttctcaaaaaccagacatggtaaggctactcacaagtttgctgttacaactcaagcaacatccctctcatgcttgtggggtgcaagaactcatcgacaatctcagggaatatctaatggataaaaggtagatattcacattatttattcagtttctaggaataaattaacgtcttatcatactagttctttctttaactaaataataaaacttctaggaaattaatttcttttcctcctaagtattaggtcaaaatatgcgtgcacacctttagatttccacaaaagcttggatttcttgtttcaaaaaatttaagacccgttaacacatacttaatttgactagttttaggaacagaggacacaaatgaaattaaattttacttactaaggatcatctataaatggtgcacattcatgctactacctccatccaaaaaaactagcaaatttcagatagattagtactcaacacaaattaccgttgtacccctgtttaatgttgtttctaatgactcaacatcactctcaattcaccatgcatgcaaataaaaagaaaaggttcagccaattagtccacctaattagcattctcaaattaactagttgggtcctaccttgctagaaacacaaatttttggtgcacattttgaatggtagaaatacatttaaagatattaattgatgattttagtgtctatgtatttatatggtcacatttgactttgatggtttttctgtccatcaataaggtaaagctcgaattaattaattgctcaattatttcctacatactgtacatttgtatatttgaaaaatagttgcatatttaatacaagtattcgcttcaaatataaagatgaatataatgtactcctctccatccaaaaaaaataaggatttctaggttgtttagcaaatattaaagtaaaggataatagagtttagtattcctcttaaatgagggatggattggagtgggagggtgtttgaggttaaagatggtgaaaattgattgagatgattgatgggatacatagtagaatgcttatatttgtagataaatttcaaaatctgggaatttttatatttatggacagaggaaatagaatctagtttccaattgcacgagctttgattttgctaaatctatttaaaagcgagtgtttaattattccttgcaatttaatatgtaccgcacgtgaaatgtttttgtaggtacttcattgtagttgatgatttgtgggatgttccttcatggaatattattacatgtgcttttccacaaaataatcaacatagcagagttataataactacaagacacggggatgtggctaggacatgttccagtgaccatggaagcattaacaatatgaagcccctaagtgcccaaaactcaagagaactattcttcaacagaatatttgggtctaaagattattgtccctcttacttggaagaagtctcatgtaaaatactgaagaagtgtggtggcctaccgcttgcaattgttactgtagctagtattttagcttgccaacccacaagactgaaggaggaatgggagtacattcaaagttctctagccactaacaaatttgcaaggaagtccaccttggaagacatgatgcaaatcttggagctcagctacaagagtctgccacatcatctcaaagcatgctttctttatcttggtgcttacccagaggattgtgtgattagcaaggttgatcttattaaaaggtgggtagcagaaggttttgtgagtcactctcctgggcaagatgcatgggttgttgcagagagctatttcaatgagctggtgaatagaagcatgattcaacttccatatcagggctactacaatgaagtatctcattgcaaggttcatgatatgatgctagacatgattctaatgaggtgcaaggaagataatttcatcagtgtgatacaagatccacgagcggcgatagaagttcaagacaagattcgtcggctcaccattgacttgaatggtgccatgggtgacacaatggatatgaacattactaggaaagtgtcacaagttcgttctcttggtgtatttggaggatcaaagtggatacctcctttgttggagtttaagtttctgcgggtgttattccttgaattctttctacgagagatgataattgacctcactggtatcaaccaactgtcccagctgagatatttaaaggttgaatgcaaggaatgcctaatggatggtgacataccatcacaagtttccatagtgttaccaagtcaaatccgaaggctacaacatttggaaaccttggagttaccctgggtatcaaaatgcagcatcccatcaatatcaggcatcattgatttgccgcgcttgacccatctagtgttgcgacagcataaggggggattaccggatgggattagaaaattgaagtcattgcgcactttgcatggctttaatctaccagtaagctcattggaaaatattgatgccctgggtgagctcactagtctagcagatatgtcactccattgtggcaaacaagacacaaaatctactactccaggatggatgactgctctgagttgttccatcgagaaactcggtaatctcaaaggtctttatgtgaggtctaatagtcctagctgttgcgccgatgcgatgagcagctggttttcacctccatttctcaaccttgagaagcttgatctgctagattggacattctccaaagttcctagatggattggccaactccatagcctccgtgagttggcacttgggggcaagaagatactccaggaagatgttagtatgatcggcacaatgctacccttcctcacccatctaagcctacgtattgttacatgcaatatcgcggtgaaggaaagcaggatcatgatagaaggctccataggattcgctgctctccggtttttctgttttgactctaataggatgtcacacctagagtttggggtaggtgctatgccccagctcaagaggctgctattagcacttgatccatgggaatgggatgaggccacacctgttggacttaaacacctcttgtacctcgaggaaatacgagtattgacagcatcaacagctgttgcttctgcaggatctgaatcaatgaatggcaagtctgcactagtcaagggtgtgttccatgatgccgctaatgctctccagagtcgcccagcatttaccgtgctcccaaggatccgttctctctctgatcacgtaaattgttgtaaaattaatatggaaacagttgcatgtaagtaggatttttagggaatgtatatgtaattgttgtagcaagatttgttcttgttccaactgaacatggttgttaatgttcttacttgtaattgtaagttctaatcttacatcaaaaggatgcttagcctaacacatgatcaccaagataatctaatgtggaatttggtgcactggccggtgtcaattggagccacaagggtatcgtcttcctctgttcttctggctcatgagatgttgatgttcttagctacctgtgtacttgaggtacctcgaacatgatatcgtctgcttgaagcaaagatgttgcaggtgattgtcctccgtggggccgaaggggttgcggttgattgatgtccttcgctactacagatcaatgatgccgaaggcattctagtgatcggtgttcctcccaatgtcactacctacatgggacaagagtctgatcaccatggaatcttcttccacggtttcgtaggattgaatgtttcagggtttatgggagagaacgtgcaagagtgaccactatccatgggaactcacttaaatatcatagtggataactacgggaaactccatttagaaagattttaacacgtttctaatcattccgtgtttgcgaatgtcattgatcatgttcatgttttccagccagttaggcccaattgatgagcatatgtcactaattgcctagcctaccactataccatagtgtcggccatgctcccacccaatcccttccctaagctcactccaaccagtagcgttgtctcgtcctttcctctcctctcctctcctctcctctcctctcctggctgaattcaagtcagtggcaagcgattggcttcccaaaccctctttagcccaccacaaccaacaacctacatatgggccaaagtaccaaagctcaactacacgaagcattaaggcctattatggcctgaagttaccgggacaacgaaccaagacctactccgcaaagacttcaagcccacgataaggtaggctcaaccgctacctccatctttccccatgcactagggctagggcaccacattttcttgttggaaataagtctattttgcatcccttaaatatttcccttggtccaatcacatctctcaaccgcaaaaccacaacctccctcattgccccttcatctgtgtcgctggccctccatgtcacatgtcgccgtcggcccttcacgccctgtgacgtgaaacataagcatgcatagtgccactgccgccgtggagcagtgaggagagccactgccgccatggaagagtgagaagagggattcggccccgacgaagtcagagacgagaagcttctcgagacacgcccgctcctctcggtcgacggctaacgcaagcgcctccgatccaaccgctgcgacatccgcacggggaggaggacgcccacagcaaccactgttgtgttcaccgtaaggtcctgcatcgcaccaccaccaccgagcacacagcacggggatctggtcatgtgtaatgggaatggtgctcgtcgggtagagcgggtgaccggtgcaaccgcgtgacagcgacgaggcacgaccgctcctctcagtcagccgctagcgccaacgcctctgccgcctccacctcctccaccgctggccatgccgacatcgatcggcgtcacggcatcacctccttgaccaacccatctaccatgtcaaacgttgctacttccaccatggacgccgtgccatccacatggggagtatgacgtccccgccacccacaacagccgcggtcccaccgcatctcggactacgagcagtgccgccatgtccaccatgaggttcaccatcaccgatcatgccagatgggaagttggttgttgatatttcttaatgatattactagaatataatttccagtaatggcgcagaaatactcctggtatattatggttacagagttcatccgcaaacatgcagatatatcattgtagcatttcacccaagagtattccaagggtatcgtatttatgtaatcccgtgggaagatcatagtagagagaaccgtactaataatttatatgttacttgtaataatcatagtctaagcaggggttaagataaatcaaagggtacagtgacacacaagcagggagctactcattcacatactaaaacatctaagctaagtggaaagaaaatagaaagagaatctattcctatacttctaatatacatagtatacatacacttatatgattaactagctaataccctctttccgatgccctcctagtacttcgagaagccacccctgactgtcgagtttcttacgacagcccgccatgaccatacaaccagggctaaatacggaggagtaccctcccaggaaactaacttaggactatatacacgtgcggaggaatacccgtactgagctgtcaccatcagcggcccacctctcatccgcagcatataaccccaaataatgatatctcgtaatctagacaccatgcctaaactaccagatactactctaatatcatcgtcatgacatagagtaattgcataagcaaacattatacccgtacctatgcttctcccagataagctaccagtataatcagtataacatgaacataatgtaaagttggcattcatatactcgaaaagtatttcaataccagaaatgtataaagaagagtattctaaacaaagtacaaagcttacaaaagaagaaaggaaagctactagagccatacccgatctcttccgaaggcttccggactccgatttctattctattcctactccactagcataagactactaaactaaacttgagagaatatgagagagctttgcttggagtgtgtggaggaagtgagagtgagagctacttttatagcttgagaatgacagttgtggcggttggaatggtcggaaataccctccaaccgccatagggagtcgatctcagccgtccagaagaaccctggatcgagtggtgccgtggtgggttagaccgaaccatgggttgggccggcctagcccaaaatcggcaggtggccttctctgctgctctcatacgcagacttgtgaattttgccacagttcattgtgtcaattctgagttcttggcccattcatgcataagtctaatcctcgacatcgtccgattgatttatcgtctggtttgatgccgattctcctccactttatggttattctctacaacaggttagtaaacctaatactagtggagtattattatttctaacacaaatatgcattgcaagcataactagttctcctctattttggtaatattgacagtcgaaactgatcgctaacgaccataaacattggtcagcgatgtcatggacagggagctcgttgggcacggtggttgaccgacacagtcgcacgacaacgtcgaggcacgctagctctctcagtcagccaccggcgcatccgtcgcctccacctcctccagcgtcggtcgtgccggcttcggccggcattggcgcatcgcaaacaacgtgccatctgcacgaggaggacgcccacaccgtcctcggcaaccttggtcccgcacaaggccgaggagctgccatcgagggtggccaagtgtgactatgcggcgctcgctgagggcgtcagcgcatgcgggaaaagagggaagacgagagagagggcgtggagaggtgaggatgaaatgtggtgagagtcgttgacacgtgggttgcacctgctaactcagcaagtcaaccacaatcaacctgcctatatcaacagaaaccgcttcctaaaccactaaggagatagtttgcaccagttttcaaaaataggggtggtgttataccgggttttgtagtggaataacttcacccgaggtctctcaactttacgtcgagtctgtttaagatccctaatcctcaataccagaaatgtctacctctcaaatatttaaaaccatgcaaaataggttctatggcagtatataggggtggcaatctaagcccacatatttttcttttttctctattctattatctttcttctcttctctttcagcgagcctggctgcctagggagagcagtgggcggagagcatggcggcggctggggcgcatcgggcacctcgtaacgccgcggttgttcttctcatggcctccgttggtgaagcggggctcatcgccgtcgccaccatcggagttaataccgagggagaaggagggcgcgttgggagcctcgtaacttcatcgttgctcctcccggcggcgctcctcatcgtcgtcattgtccgagtcgatgccgagagagaaggatggtgcatcaggagcctcataacgcttatgttcctcccctccattgccgccgtcggtgaggtgggattcgtcaccgtcgccctcgaaatcgatttcaagagagaaggatgaagtccatccgccagtgacgacgagggaggcatttggtggagaactgagtaggccggcaaaggggggatcagtggtcgacggagcagagcagcggaggccggagtaggccgagagaggggagacgaaggcaggcgacgtcggcaaagggggcggagcggagtggctgcggccgaagtaggccctggccctcccctccttcttcctcgtctcaagctccagctttgcttctcaagcggtagccgccgcacgcttctcaagctccacctccacgagctccggccctcgatctcctccaccaacggtggtgcctccgccacactccgcgactgaccctgctctgcccaccgctaaccccgcaccgagtcgagcgtgcagcatgcgaacggcggcagcggcgcctgatgcaacctccccctccctcccctgccggccgcttcctccctctcccggccgcttctcccaccggccatctgccccactcccaagcttgggaagaaaaaagaaaggaagaagatgatgctgacacgtgggcccacatttttccttctcacttacagatgggcctcacatatttattattttattttttgataactaggatgttacatcaacaaaaccaaatatctatactgtctcgggacttttttttggacagttttacatagtttaggggtacacatttctagtattacgattaggggagcctagacagattctacgtacaattgagggacgtcaggtgaacttattcattttgcagttgagggagactattcagtaaggagcaaaagaggacgggaagtaaagtagacttattcctttcttgtagctatgaattttcatgttttcaactaaccagtccaaagttctaagcattcagagggctaatccatttagtggacctgcagataatatttttttctactgaaaaatttacatgcgtaaatatttgtataaaatttaagctttgcatgacaccagactgaattctagccattcaaagtatagagtagtagactcactcgagagccaactgttatctacctggtgaaagacctgcagcaagcaacactaaggttgccccatgtagttccaatttgcaaagggcttgcaaaatgatattttgaatcaaatccacaaagaggcctggaatgtcaaataatattgaacaggaataaattaaaatttctaaatttaaatactacagcttcaacagcccaagtattctgctgccttttggaagctagcttctgggctgaaattgtaagctggcgatagcagtcacaagaagcagctttctttacggtaataatcacaaagaatacggtaatgaacaagattcacagtttcacataatgattgttacagctaacctgaggtgtattcctcatatatctacctatcgaaaacttttcaggagatgggacgaaggaataggggagctcaaagatcttcccagactgctgccagcttttttatctgatgatcttataggtgtggcacattcgttgaaatccaggattttcccctcggtctgcaaaatatgcattcatattatgatcattgctaataatacagttaaacactggcagtctggaatgggtaatgatgttaatttatgctcaacgtggatgcaaatctatcaaaaccatttacagttgatggattacagaaaaacaactgccaccgttttggactcacaaaccaagatttgccagacagcatgagctacatagctaaataatattaacgcaagaggaactactaaaatgacaaacaataaaaccagggtcctccttttgttacaacgcaagaccttttgtttcaacaacacgggaatatgaaaataagcagttcaatacgcaccttgatttttgcttgcaatttggttgttgctcctggttccttcttggcatctggattctccaggttttccttatcagaatttatgttctcagattggccaccacttgccagcacctcacgggcttctgccaaagcagcagcagtctgcacatttatctgcttcaccaatcctagcgcatcgtaacttccattagctgggctgacgaagtatgaaccctgggaggaacatatggccacaagaagttcagcagagtaaacagcaagcaatatccccagtgcgtgacaacatcagtaattaatgaaaaaaaatactctcaggcacgactcaataatatttatttccatccgcttagatttagccatagtccaccaagttatattcttgttccaaacacttgagctctgcatttcaaatatataaattttacaaagtgctaaatgtacctgaaattgcatatctacaaaccaaggggacttccatgctgaaggagattctagtcctcttttgatgcctggggtatcagccaatctaacaatagcaaggctttagaattcagaattacatattaaaaggaacaaggatcaagtaatctcttcacacttcagtagttggagacaagcggagtttaattccctattgtagtatcttaaatgtattcgtcagtaggattcaagtgttcttcaacattctggatgaaatagcatgtgctaatcccagtaagatggtggctaaaaggcttatgataatacattagataataaaatgtttttcagtttctgactaatgatggaagctcttgaatggatatttcagttacatagataagaatgggtagtaacttaattttgtactggattaagtatctaaatagagacatgaggttgaacatgaaaaccagctaatcacagtttaggtcttcagaagcatgccggactacaaattcaataggttgatgcttgcaatagcaagaaaaggaggaaatgatcattcactagagatcagtttccataaaacttaacgacttaatattcatgtaacctgagaagattactatacaaaagaatctgctgtaaaacaacaaaggaacatgtgaaattagtggtcttacatgttcacatattcataatccacatttatgcatgctgaagatttctccacaataagttccgcaggctttttagcagacactccctccttacagactgacaaagattccatatttgtgttttgcttctgtttcatggtgtttttaccataatctggggaaacaagatcatcaccgttgtgctcaataagaatacctgcaggttgctgcatcaaacaacatataggtaagaacaagatcattggaaaaattcattttccattttgatccagtctcccagcccccatatttcatagatgctaacatgttaaagactaaagagcacctgctacactcagggcattaacttggttatttgaagatgcataaggccactcccagtgggagtttcatttaaatagggctccatgtcaacaatttagatgatgtgggcatgtggcaaagaattaataaagtgagagatgaaatgagtgtcatctagatgaaactgtctacatcgtttccaatacagcttatctcttgcatgtattgcctatgaaacagcaaaaatgaaacaatgcattgtaagagatatttcaatcatccattaaataccttgttgcttatgtggcacccactgggactggcctaatgctaaatttaattgtgttactggacccactctgattggttcacctcacaaactatacaggtgctaccttttatcctcaacgaaatatgatacacatactaactggctaaatatcatcaaaaactggaagtacttactaaattgcctggcagatcatcataagtagtagttatatttgttgcagtacgccgttccccccttgcctgctcgtcaatgtgtttgtaatttcctgcactctgtccatcttttgcctgttcaattgtgttgtccaaattttccttgttctcatcagagaactcaagtttcttttccagaggtttagaagaagcagatcgctcaatacgcaaaactgatttagttataacagcatcatctttagtggcattaataaaacatgtttgaatgccgatggaggatgtgtctgataccccacaatccttttcagtcccagatttcttctcgattcttttatccggaataggagacacgaggtctctgtgacgtttctttagtattgatggtgtgcatatgaagcttttggcagcactcttcagcaaaatgtcagggctttcatcatgtgtaggggagccccacaatctcattggagtgcagacattcatggtcgaccgcattaactgccgaataccaaggggactatactcttggagatcaccagaagttacaaggtcgcaactgacaaatggaacatccatgcttggaaaacgaggaggttcatagaatagggctccctcatcctgcttttcatctgctgtagcactcggtgtaaccgatggttctttctctatactggcttcaggttcttccgcattagtaacatgttggtccgcacattcaggtatcctttccatcattgaaggaatatcactgccattactactaccagggttagcagacatttcagcgtcacctgaagaactggaagattgtgtgaccatttctgcctgagaaactgtcatttcttttggttctgatctattatcagaaggtacatcagtcataacatttgaacagataagagatggtggtactgacatctgtggactctgtccataagtagcctccatcacactggaagaatttgatgtctgtaataggtagggtggtgctaaaaattcattatctgcttgagaggaatatacatccgattgatgatttgatcttgaaaaagaatcagtttcaactgcatcaggtccagaaagaaggctttgcaaggaaatatcctgccaaagttcagatttcagacaattaggactattgaagtcagcctccgacataaaatgtagtttttgctcagctccagaatcacttggtaacatagagagaggcatctccattgctacatcatatggttccaatgacctttcatgattttctatactacagatagttgggttgtctgcaaaactagaattacttggcacttcatccatactcatatgcaaattcaatccttgagcaaactcctcttgcaagtgttgatctggatcgaagttagaggaagaaacgtggtagtgcacctcaggtatagcagttgcaacagcccccacagaagtatagcatgcttcgtgacccacagaagattgagaatcatgcgcttcattattgtcaacattcgcatttacttgcaaatcacagcccaatgccacattagcattgtgcacttgggagcaagaaaccttggcaagtgatgattgactacacactgatgaattttcaacctctcgaacagcatagctaccactgtcttcgctgttttgttgggtcaacgcaggtgaggaattacagtgtgcagagtattcatttagagggagacacgagacttgggtaagtaaacctgatgacatgtatgagtcgactttcttctttactgaactgttccagtgatttttaattgcattgtccgtcctgataagggaaatagaatgttacaggttcaatcatttcagtagtccaaaaagggcatatttttataataacaagcgttaattgagcagaagtacatatagatcattgtgcattaggtcataaacatttagagaagacaagaatgttaaacatcaatagatgtgtcaaaatggcagtaaaacataaatttcgcatctattttcacttcatagaaaataacagattgattttaaatttcgcttgctgaaaataaaggaacgatattgcagttaagcagtggcatctctatttcacattcggtggaagtatggacccgcgtcctcattctattctcccaaagcaaaaacgatttaagtttcttttttaggttaccatcttccctaaatttatacaacaccatagattccaaatgatgtctgaaaggaaggtggaaagaatgctgagctaaacagtttgggaacttaccacagaaaaaaaaatagaatttggaacaaaaattagaggaaagatttcccccataatagcagtcatcatgacaatatcagatcaaaactagaggtctgcaaacagctcttaggttaaaaataaaaatcattaccttcctggtaaaaattttgtcagctcagcccatttatttccatacattcgatgagcatgtatgagggtaatttcctcttcttgtgtccatgcctccttgtttatgccagggttaagatggttgtgccacctaaatgcagattagatagtccatctttaagacgtagaatccacagtaatgatactcgattaaaaataatggcatgcacattaagaaataaattagcatagtttacaaaatactgcattgtgaaaataaatcttattaacaatctaacacatgttttgccagacatcattgtacaacatatatggtctatgcgaaaactatgtccaaagaaaacctgcattcaccagcagaacaacgggctagaagaaatcagttgttgctagcacaaagaagttgctctgttgagccccacaaaacttcttgttatatcatttttcttcagtgcaagctagatgaaataaaataaaatgaataagtaattttcatagcattaccgttcccgacattgctttcctatacgtccaggcaaagcttgagcaatggttgaccatttctttggtccaagtttgtttaccatctgaacaatgatgtcatcttcctgaaaaagggaacaagtcattgtgagcgtattatgactaatcaatactatctaagaaatgaaaataaatggaatagcatcctacttctttggaccatggccctttgaccaattcagggtttagaaccttttgccacctgtgcaagcattgtacatcggttctatccggaaaacattccgctggaaaattagaaggatctctgtcaaagcttggatttttaacgatatacaagaatctcatcaacaaagtaggaaaaacaatgccagaagagcatgacttgagtgtaagttaatgaaacagcacaatgctttcctgcacacgagttcccataacatcgaagaaaaaatataaaatatgctgcatggtttatgatatcctactgcactaaacaattgtaggacaaaagaggcttgagaacaatatggtaaaaatgaattgtaaaccctggatagtggataatattgtgaaataatatattgttcctgttacaacctgacatgcattgccgtacaacagtatgtaatcaaagagcaaatgtgaccaaaagaaaaaccaaagggaagcagacatgcataatacaccctctatttcaggttataagactttttgactttggtcaaagtcaaactaatctaaatttgactaactctatagaaaaatgtagtaatatttacaatgccagcatagtttcattaaatctataattgaataaattttcataatacattggtcttgggttaaaaatattactacttttttctataaaattagtcaaacttaaaatagtttgactttgaccaaagtcaaaatgtcttataacctgaaacggagggagtaggctataaaatgtagagtaatgtagataccaaaggacacacttttgaaggtgcttccctatgttatttcctctctcaaaaaaatagtgcaatgggtggggattggattttagaaggctctttcgtttatatgttccatcataaaaaaaataactatattgaagataaagaaaaagaaaagtatgacagctaaaggatattgtagaaatgcaatgataaagagtaaggactcgccgggcaagagtaaggactaaggtaaagagtaggactaagcaaatagaaaaatagaatcattgcatgactttccacatataagcatcaatccaaagaacgtacctatttttttccaattcttccctttatatgtctgaacagctctggacaatatggaatcctacatttgaatagcacataagtgcaacgttaaacagtgtaagtagataataagcacaaaaaaaaatatgcatctaagaaatttgaaattttgcattgtgtggatgataatatggatcttggctcacatttcattgagacatacaaaatagaaccaaaatgctgctgttacaattttgtacaaagcatggaactagaacagaattgcacatgactatatgacagaaacagaacaaagaaggtaatcccaaggtagaaaagtgaagtttatgattcgcctcagaatacatgcatttgttgacttttaaagagttaaagttgcccatggctcccttggatgctagagaaattagtaaattatcagattcaactttgtttgtaggaggaataaaacaccaaatgaagtgaaatatttttttcatattaaacaagtccagtctttaccagtaaacacattagatgtttcacagttacataaaacaagatttttcaatcatcatttaattatgtgtacatgaaaggactcttcatcaacagaaacacaagctgacattcacatgttatacctcttcaggggtccaatttcctttcgtggaacgccgtgttggaccagtggtcctcctaaagttacaaggacaaagaagcataataaaatttagtagaatatacattagcatggttagaagagcttagaattttacccactgagcggccggcgcctttgtggttcattgctgatttcaccttcttggggagctgatgaaggtccagaagcttctccacccttctctggagcctttccgttgtcgcttgtcatcatgactgaagacattcaatcctcactttgcaatagaaacctctaagggatataaaaatcattatacggtcaagcctgagtaaggccttcagggagttgcttcaaggaataagcgatcataggctgcaatagaaatggaggaatgaagttcttgtcacaagatgtaacaatagaagtgttcaggaatgcatagagggcattgactacactcataaggacattaatttactcatttaaaaggaatggggagtagaactcatgtcactttggctttcttaaaaagatggattttacaatcttctatcaaaaagaaggagccgaggtgatagtgtatctacaccagtacaccatcccttcactgtacatctttcgtaaaaactaaaaattgcatcattcacacagatgtatcatgtatatggaggcaatcgattgatatccagccaagcgtacaacttatagattgggaaaaaaaatagtccatctttgcttttctaaaactattctgcaggatcaattaaccagcaaaactatttgttggctcattctaccctccgagctaccaaagaagctaatttcacaccctaatggtttgtgtgtgggtgggtgtgggtgatatgcactgccatatggacctctaatgcttgcattgtctgaatttcagctttatttagtaccaaagagagtttgatttttgccatggaatttaccgaacaaaaatgtataatatacagatctcactgagacaaattcatcacacatacaaaagcacctcctcctcctcctcctcctccagctccaaattcgaagcggacatcccaaacaacaatcaagcaagcaagcagatatacataccaatcgccctggcgacggcgaccctggccgccctggtcccgcggagcgccgtccccagccgcacgattcctggatgctggatctgcgggtgggagcccgacggccacggcagcggcgcgatttgcggcgcaccgaccaccggcccacggcggcggcggcggcggctccaactgagagattcggcgcggcagaggtggaggcggcggggggtgcgagatcgggggcgagacgaggtgggggatccgatctgcgggcggagcaaatcgcctcctcctaaccctagctcttgctcttcctcttcgtcttcgtctcgcctcgtctgcgatttcaaatttcagagcgtgggagaaatgaagcggatgggatatttgacaactttgttttttcttctcttttttaagttttgggttttgggttcggggtggtttctgcaaaatggacgggaaggaggcgcggagagggattccggtacgaaatggacggtggggagatggcttcgcgtgagatcgggcggatctgggccgtcgcttcattcgcagagctcgtggagtcgttgacattcgaatattgccgtaccgggagtatccaaagcaagggatgcttggctgtgttcgttaagagaagggaacaaatatccagtgcatgaaaaacagagcgatttattactacgtgattaattaagtattagctatttaaaaaaaatgatcaatatgattgtttaaagaaactttcgtatagaaattttttataaaatacgtaccgtttagcaatttaaaaaacatgcgcgtggaacacgaaggataggagttgagaacacaggccgccgaacacagccagttgcttacctccaatggccatcgtcgacaatgaaaatttgctctcacaaaacatgagaggctattccctcgataaaaacaagaggggtaagttgaaaaaattattaagcggattattgttacggtcatttggttcattataaagataaattaaatattttaaaaaatactagctaaatacccgtagtttgctactggaaagttgaattatacatgtggtaaacttatgtttggaacaagttaattataaggtttttaagaacaatttcattcccagttctctatagaggtctttacatgataaacttaaatcatagagatgaaataagatattaaaaatttgtaaaaggatatttttttacaacattaaagtacgtacagtagttggtaagaaaatagagttggtgattggcagatttattgccaccatcatttttttataaaaaaaaaaagagtatagaaacttaataattagcttaaaacaagtctaagcagtataactaaagaaagtcttgagaaaatacctttttaatcatggagcaaataatttgttagacataaaaagataacataatcaactggaacgattacactgaaaacaacagaactttggagcatttgtgaggaaaaaaaaatctaagccaggatggaatgcttgtcatatttttatatccttttggtgccgggatcagttgactcatgaagtgatgcaagctttgaagatgctatcaagctggaatgaagctacaattgttcataccaaaagtaaaagatttttccatcaataaagcacatgaacagggcttataatagggtggattcgattattttcttaagcaatgttacccggactagtcctctttccacgttgggttgatctcatccagggttttcaatttcgatttgcacagaaattttggaatttcggtgcaactaacacttttgggaatttttgaacttttttacccaaaatcatttgaaaatttaataaattttgaccaatattcaaaaaagtttgcagaaaaccaaaaatcttgtgcaacatttttagttgctagaggggagcgaaatttccaactgaaattgaaaaccctgattttatcatgtagcatgtcattcaaatttttagattaaatgcactaggcccaatttaatcctaataaattcttaatcctaataaattccaaaagccaacaattaatgttaaaggaatctcaacataaagtgttagggtaccgagctcgaattcgccctatag

SEQ ID NO: 28900 - DNA, 768 bp, Oryza sativa
  unsure (1)..(768): unsure at all n locations
accatgttgatgtaattgatctaatagactgaattttatggatgtgcagaaaagtaaagcatgcagcgagcattaattcttgcaacatgggtgtcacttctaatggtgttctcattaatgatcacatccagttgaagtgcattagaaggtaataaatctgataaattgttactcctttaaaatacattcaagtagtaggatttaaaccagtactaatattgctctggtattataatttttttattgttagaagtttagaacctactgaaagtgtgtaactgaaagataaaataccaaataaaacttatgattcaactattccattgttacttggggtacattctcccaacccttgccgtgcttttttttttcttgttgtgcgcgaacaaaaaatttaggaattgtctatgaatctctgaatattttttttctatttctgaactttcttaattttaaaatttaaaaatagacccttctaaaacttatttccaaaatctgaaccttttaggcacgcgaaccagggtggcgtcgcaaaacaacactgaccccacccacagcgggcgtgatagttttattctaccacgccaactatggtggtgtggcaagacaatgctaaataatgctaccatgccagccaaactggcgtggcagtattgtttttcctactgaaagtattgtttggcgtgaccaaaaggttcaaatcttgaaaatnnnnnnnnnnnnnnnnnnnnnnnnnnnnnnnnnnnnnnnnnnnnnnnnnnnnnnnnn

SEQ ID NO: 28901 - DNA, 844 bp, Oryza sativa
gatatcaacttctattttgttctcctattccttcccagaagatttggatctacttttgatatgctaacatatcttgtcaacacgaggtttatccgaagacatttgacttccttgtaaaatctgggacttgtgctcacgagatccttgggttgaactggctacaccagctacttcttcttggaatttacatttgggatgtccggttgcaacatattcttcaatactgtaaagctaacgctgcatctccagatagtactatccagataaaaacaccagagaacaagccaaagaattctgaaataacttctgttcatggggacacactatctcttaccaacgttggaatggaaaggcaggaagcacgtatcgatacttgtcattcttttgatagttcatttggcggtatgattttggagaatgagcagctaactgagaaatcagtaatccaagagcctgggtcacatgttagtccagatcatcgtgaagatggtggatcatatgaagtcgacaaatatgcacatatctctgacagtttttgtttagaaaagttaattgacttaccagttaagaataatgaattgccagaactagccagaggtaatgaaatgtatcctgttgccaagccaagcaagtgttttgatatattccttaacctatttgatttcttaagtaatgatgccagaaaatgggtctggggtagttttagtcacctggaaaaggagtacaagaaagagcttcagggtggttctttggacaagtttcatctcatcaacaaatacatccccaccttttcatcactggttcagcttaaatcccaaatggacatggtacagtttattgttgg

SEQ ID NO: 28902 - DNA, 1284 bp, Oryza sativa
ggaagggaaacggatgccggggtgaagcgtggggcggcgatgccgatggtggcgacgacgcagtgcggcgatggcgagaacggcggctagaggcggccggagctcgccggagagcggcgacggctcgattttgcgtggggagggcgggggagagtgcggggagtacgggaaaattggggaaatggacgagggtcacatgggaaatcgtggccgagaggggcggaatcgggcggcaaccggccggcgacgtggggtggtgtcacagcctgaattttcgttttaggatttataaattatctaataaattattaatagaatttttattaaatgttctttaatttacaagtgaagttaaatgtgggatataaaatttcctaaatataaagcatggatggatttaatttttattaaattctccatgattaattacactctctgaaattttctcggatttttcagagctcaattcctaaatgatacaaagaacagttcagtaattagttaatcaattaatgatctaattataattatgttaagtgcttttcttgtttaaaaatccttaatttataaattgttgtctaaaaggaattattagaaatgatcttaaaagcctagaagagaagatctattttttttaaaatttgttaaatctcaatataaaagtgggctagaaaaaaattcattaaatactttacttgattctatagttcctagatttttctgggatttatttgagccaaggaagtatttttaatcaatggaatatcatttcatgaataatttaaatagaaaaaggttttaaaatctttcttttggttttgggccgaaagtcagcccaagtctctctttctccctctcctcggactgcttgcatctggcccagccggcccagtccgccgcgcccctccctcctctctctcagccgctgacaggcgggacccacctgtcggggtcgtcgccctcctctcgtcgcccggccgcgcccgagccgccaccgctgcccttccaaattccgttgcccctctctatttccggtcaaattgattgagggcaaatgatccttgagatctcctcttccttttctcttttggaaacattggctagattttctttggaaaccagaggatttgagttggattcggattcatctctctcctctaaccctagagttgacttctcgccgccgtcaccgagggccttccgcggcccctcctaaccactataaaagcatccccgggaccttctttatccggcggcacctttgccttaacccgccttcgcgtc

SEQ ID NO: 28903 - DNA, 998 bp, Oryza sativa
caattaaaatccatataatgcttttaatcgggtttatctttaaaaattcatatctaattcattgtaactcggtttaatgtggttcaagttgcaaaagttgtgtaaaataaagatctacatattaaaattatccataaattgaattaaatttatttaattctttttaaatgggctttaattagatttaatctagtaaaattcataataaattcatatgaagtcagaatgaggccgttcaagtctcataattcatctaaaattatgatctacatgtttgtttactttttatgtactgtttatttggtttttactagtctttttcttcgttttgcgtgttagcttgtcgtttccgtcgttttgaaggttcgcgagtgcgccggaagtattatttaatgatggcttaataatagttcacgatggtcaatcgtgattggttaattaattacttgccaactaaaacttgataatggtgggttgtgagcacatggttttgagagtcgtgctcatgacaattaaggaccgcttcgcgagctactattgtgaaacattaaccgtgccaaccacaagccagcgtgggcaacggctttaccttttgtatagcatggttcattgcagagcaccagactgagaagtggcggagataagcccacgggggtcgctggggagtccatgccttgtttataagggggtgattatgatccaggaacggtgcactgctttgagttgtgttgtgcgaggggtactgtcacagctcctttccgaggtaccgtggtggtattgaggcgcatggtgacatgtcgtggggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttggagttagatctgtacagccgggtat

SEQ ID NO: 28904 - DNA, 761 bp, Oryza sativa
  unsure (1)..(761): unsure at all n locations
nnnnnnnnnnnnnnnnnnnnnnnnnnnnnnnnnnnntcatcttcaaataaccaagttaatgccctgagtgtagcaggtgctctttagtctttaacatgttagcatctatgaaatatgggggctgggagactggatcaaaatggaaaatgaatttttccaatgatcttgttcttacctatatgttgtttgatgcagcaacctgcaggtattcttattgagcacaacggtgatgatcttgtttccccagattatggtaaaaacaccatgaaacagaagcaaaacacaaatatggaatctttgtcagtctgtaaggagggagtgtctgctaaaaagcctgcggaacttattgtggagaaatcttcagcatgcataaatgtggattatgaatatgtgaacatgtaagaccactaatttcacatgttcctttgttgttttacagcagattcttttgtatagtaatcttctcaggttacatgaatattaagtcgtaagttttatggaaactgatctctagtgaatgatcatttcctccttttcttgctattgcaagcatcaacctattgaatttgtagtccggcatgcttctggagacctaaactgtgattagcctgttttcatgttcaacctcatgtctctatttagatacttaatccagtacaaaattaaagtactacccattcttatctatgtaactgaaatatccattcaagagctttcatcattagtcagaaactggaaaacatttattatctaatgtatta

SEQ ID NO: 28905 - DNA, 753 bp, Oryza sativa
  unsure (1)..(753): unsure at all n locations
gccccagctagctcggtagctctgcttcctgcacgaacgcagcggtcgcaggcaaagcaccggaagacacggagagagacagggacgactccctccacaaaaccaaccgcgagtgcgtccaaaacacgcacgacgacgacgacgacggcgaacagtgtggagagaggcaatcaaacgtgcgcgcgccgtcccagtaaaggctgtgcctgcccgcgccccctggaccctgcgccgcgcgcggcagctgaggcgaccagggcgtcaccggcggcatcagggcgcgtgcatgcatggcgcggcatggcatgcatgctgcgttcgcgcgtgagacggcgtgcgcgatcagatcagggggagcgccagagcccgcgcacagtgcaggcgggtcgtcgcagccgcgcagcgcgaggaggccgatgcgcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28906 - DNA, 104132 bp, Oryza sativa
  unsure (1)..(104132): unsure at all n locations
ctagtggatcccccnnnnnnnnnnnnnnnnnnnnnnnnnnnnnnnnnnnnnnnnnnnnnnnnnnnnnnnnnnnnnnnnnnnnnnnncctggttcccatccagtgctacatagctcttggatgatttgatcttcttgtatggattctccttcttgcgtagatcctctaggcatctcacctcagacatacatgcaaaagattgagactttccgtcgtagtatttggataatcctttcctgcaaagaacaacaaagcacttgccctgtgagaaaattttccttttgctagtacatctattgatactaatatgcaactcttcttccccaggaacttacttgacagggagttgtgccttcatagatgacagatcgtagaggctatctgaattcatccttctcgctggctgctgcgcaaactggtcttcttgagcttcagcttcctcgctgtctgaaaattgagcctcatcatcggagtcgcctgagatggacgatgatgtctcgaacaagtcttcatcttcttcttcacggtatactggaaggaccgcagctccaccgaatttgcccatgctcgcagtttttctggcttctggaacaaagacaccgaaagaacaggtacgctttgtgtatagaactatggatatattcttcttcctctcttgcttcctctctttcacaatctttacaacgtccggtggggagggtgggtgtatatatagctccagctgaaatgggataacgctaagctgccttctttcaaacactgcacagtgccctttgactaatataatcttacgcaatttgcatccatgacatcacctatttgttgtgtttacatggactagttaggtcttttccagaacactgacatggacccatgagcatggctgcttgtgtgcctttgtcccagtttttgccgaaataaaagaaagtaatgaaaaaagagcgtgaaagttggttggccacttccacatgctttcccggattctgctgctggtacccctgatctgatcttatcttcttagtttgttgaatgggacccagatttgttcttatatccctttggcaagttggttttctgagactgacttgtaggccatggcatgttatggtgaggatgatgcctcatcatgttaattcttttttgtggggagctgagcgaggacacgaggcgcgctactgttggcttatgattctcgttgcaggctgagtcggtggccgaggtagaacgcaactagatctttcaggataaaccttttcattacttaacccggagtattttggggaaatcacgctaatagtagaactttggtgccttcaattttttactataacaacctgttgtttttctactttctgaacagttcgaaatggtgagatttctaagtagtattaattccgttacgtcgacgagggaattacggctcttttagtccttgataactgccagaaaatactcttgtgcctcctaattcgggacaaatttcagcatacgaacagtgtgagtggagcactagctgcacaaggggtcctgtaagttaactgttaatttacgtaatctcgaacagtcttagctttcaaaacagagacctttttcctcatttccttcaggatcactgctcactggttccccacatactcatgtttctcgtttcagcaatgggtaaattgagattccatggacccccaatcagagttcggtgagtaacacgtgtatggttttccgcatgacaactgtgattgcacttcgctgtgttacttagcctccattacacgcaattttgcgagagaaaacgagaggcaactaacatacgtccagcgctcgaaataaagttgtattgcatcgcatcattggtaacagtgctaatgcctgtccattagaactcactagatgctgctcaacttgagctgtgtttagttcagtgtaaagtttagattttggttgaaattggagatgatgtgactgaaaaattatgtgtatataacaggttgatgtgatggaaaatgactgaaatttagatctaaactttggatccaaactttagatctaaacacagccttagagaagccgatacacgttcctgcggtaggatactgtcgatcttagccacattgtcatgtatctggggtttctttaagacttgagaacttaatcaagtattttgatgtagatagtataatctacaaacgcatatataattcgacacgactaggacctaacccaacgcgacgtggtgagctgttcaaaaccggacacctgtcgcgcgatccgtgtacgcgccaaggtgcatgttcggtgggcgaaaccaacaacagcacctcgcacgtctgccattaacacgaactcctgataataatctaaaaaatgcttttataaaccgacgagacagaatgccctgggtacacatggcacggacagcatttccggggacatggccacaggtttgattagtggaccaacaaaaccggcgacatgctaatctcttactcgtcatctcgtgtccgcgtgttgctctgcacgaaggctgtctgtccacgttctagagatgcaaattgtgttgcagatcaaagcccagaaatgcgctcctgctgtctttgcacttttgatcgcttttttcattttgttctcgagccaattgcatgtcctaatccgtgccattaacctcagatttgtagtcaagggatggctgcttagaatctgtactatggatattgatgcccccttatccttaatcctccttatccaggcgtggactgcttcaagcttcgcgtggtgggcaagatgaaaatatcatcccaagtagtgttccatgacgtctcactcccgtagcgaatttttgacttgtttacatagggtgagtttgaggaggaggagattgagaagattaggaagatatgcaaaatgagatgaaccattagcgcatgattaattgagtattaactattttaaattttaaaaaataaattaatatgattttttaaagtaactttcctatagaaaatttttataaaaaatataccgtttagtagtttgggaagcgtgcgcgtgaaaatcgaaacaaactcactcactttcttccgctgccgaacgcagccatattgtgctcgtggttggggaacggagcttctcttccggaaacattcaaacacgagcttgctacaagtattattgagctcgacgtacacgtacgagccttcctcccggctgcatctatctcctgtcaggtctgaatttttcctcatctagctaacctttttgttgcgacttaagactattcccaggtagaaataggatttttcctctagaaccttttcgtgcgttcaaaacgcgtcgaccctggatagagcgcaagccaaccaaccgcgctctgaccggcttggctcgcgcgcgcggaagattatcattggatttggaacaacacatgtttattccgctcactaaacatgaccggtggcctgggcgagagccatccatcatcgatcacccaaaagacgcgtttggctcgtagtcgtcttataatcccaagcgataagggttcgcggatcgtgccgggatccggcgaaagcgaccgagcgcagtagcatcgcgcggcgcgctgaaatcatgtggcacgaggccggagggagcctgcgatttttgcgtggaccacggctgtactacctgtccaggccgcgcgccagccgccgggaacgtggtctgcgcgcgctcggacgaaacgcgcgcatgtggatagctcgcggggatgggatcggctcggcgccgcgtcgctgttcgcccgatttttattttcgatctcttcggcggatctctcgcctgttccgtgcgaatccggacgggcgggctgaaccgcctgtgcacaagccaggcttgcaaattgcaaaccccgagacgcgtccgcgtctccgcctctcacgcgcgcacgtccggacgcgccgcgcggaacctgacgattttttttttgtttccttttccgtatccgaggggcgagggcggccaagccaagccggcggccgcgcgcgcgcgcaggcgacggcgtctccactcgtcgtgggcggtcgactcgcctactataatcggtgagcgatccatccagcacaggaaaagccggaaacccgggtcgtctctcctacagcgcgcgtggagagatgtaccgcggctcgtgtagggctcgtgcttggtcggagtctgcatgcgggatgttcctcttgggttgggtgccgtggccgtcatgggagcggactccggtgctccactgtagtggatgggcgaaccggaataaccaaaaagacgagaaggacgtgaaggctttgatgggcgcgagcccagtaagagcaacgtcaatagccaactattgactcaaaacatctaaagccaatctaataactcattcatacaataattaattataaaaatatgctacaccattaatatctggtctcacctctcatacacacgtaacatcttggagtccgtgttgcagctggctacaaatctgtagcccgctttcttctctcttctcttttcttctcgatatatggttatagccggcttatagcctgctattgtacatgctctaacagtggatgccttagggcacccacaatggttatctataagctctctacaacagatccatgtcagcatattttcctacttagaagagattaaatgaagagatagagcaaagctatctactaacatggaaatagtttatagagaaaaacaaggcaatggattagagagctatagatacccatgtagacataccattgaagtggtttattattaatttagtctattgctgagatgtacatattttatagatagcacattactttaccattgcgggtgctcttatgtattccgttgagacattgcaacggattcattcatgccgcgtgcgaatcctgcacactgtataactgcatgcgaatcatgtgtgctaggcatgtaacatactccgtatttctttgtttcagatagttgcgtacagggttcgctaaaccgttcaagatgagcttatcatatcacacggtttaacggatattacggtaaacacggttaccacaaaaccgtacggttattacgagatatacagtggtttaaaaaactttaaacgttattacacgtgataatcgcacaattttataaaccctaccatccctagggaaaaagtacatttgataaaacaacctagagtaagtgatataccagatgtggctatcaccttcaattttatccatatcattcaaacaaaaaataagaggcaacatatacaatatgtcacctctaatacacaaataccaatatctctaatactctcataatttttttaaatttgtgtggaggttgactcttgatttaggctcaaagtaggtttatagtagactataagtcaactgtaaacttacgtggaggagaaagaatttttaaaaaataaagaggattgtctccaatgcaatagctagttattcacatatttcaaatatattaaaggcatagggagagataaagagagagaagaaaaatagagataaaattatagctttttctactataatatgagctcatagttggctttagtattgaacttgctctcatcatctctctccccacttctctcctccaactcatcgctcaattatatgtgatatttttaggggcaatacatgaatcattataacacttgctcttagagcaggtacaatagcaggctataagccagctacaaacatattttaaggagataaatcagaagagagaagagcagcgggctacagatttataaccagcggtagcacgtactctaagatgcaatgtgtgtatgacaggtgggaccagatattaatagtgtagtatgtaactattgtatgaatgggctattagattgaccatatatgagttgaagctactatttggctatactattaaacttgctcatatgagattctatctttttaaggaaaaaagagctaaaggatgtgttcgttactccagttttttatcttttactttctcattttatttaaatgtgcttccgaacaaataaacaatgtgtttttcaaaaaaaaaagaaagttatagagttgcttaaaaaccatattaatctttttttctaagtttttatgaataatacttaattaatcgtgcagagcaatattattttccgtgtgaaaggaaagattcgatgctgtgtaatgccgaacgcacccaagcctctcgtcgaagcttatctaccgtagttaaattttaaaatttaaatgttaatctgagaatagaatttggtgttattttcaccgtggtccatttcttagcatttattttaagccgctaataatatactctctttgtttcacattgtaataagttaatctaggtttgtcatacgtcaaaaaaaaaattaaactcaaccaatttaacagaaaattacaaaaacatttctgacataaaataaatatactataaaatatattgattgatggattcaataaaaatactttagtgttatggatgctaatatattttttctataaacacccaaagtaacttataatatgaaacgaacagaacagagtagatgtgtgaaagtttttgctataaattattttggttatctttttgcatggcttatcagtcgtacctcaaaagatcaaactatatgcctttcaagatgaaccttaaggcactgttgcacacccgttaacgatggatttactgtaaaaaaaacagagaaaaaccacaacatataacccgcacaattaaaaaaaatcaagatccgttacaaatagatcgaataacatgtggatactttttttatatcatgacaaaatattggcaatgttgaagtctagatggaattggcatcaccaatattttagcaaactatttgtttgatggcatatttttttaagcaaaccaaacatttgcaaagtactactacgtccctcatataagttgttttagttttgttcttagttaaaattctctaactttgattggttttagattattttttaaaataatatttttaaaagaaaacttcaaatgttatagatattggtatattttatttttataaatttggtcaaagtccaacttataacataacttaagcaccttacatcggagataataggtgctactcctattttaaacgtatcctcagctcggcgctggccgaccagcggtccagcagtactatactattgcaaattgtaatgccgaacttatcaggcgagctactagttcaaagcttcccgtctagaacatacgtttacgtagggcagcaacttgcgaagtccatcctcgcgcgttttggctctcctcaagggcgtttcagtggggagtacggctgacccgattgttgagacgagtggcggtttcaactctcaactgacggaaggggagacgcacgcatcgtcatctgaccggccgctcacccgatgaggcgagcgattcgatcggatgggcggatcgattgggttgggttgcattggattggattaggcgcgggaatcaggtggcgacggacgggtggaagttaggacggcagcgcagctgcaagttggccggtttctttttgtatttctctggcgtggtcggctggttcagctagccggtcagatgcatggagcggatagagtcgatttctcttgtacgagtagatcacggaaggaatgatgatatttttcgtacataggcctagagaatttttagggcgtttcgtagtggatgggtcaatgtatggagcactgtgttttaataagacgggaaagctggaatccaagtagaaactcctggagacaccgccgcgccggggggacaagcatcgtgatcggtaggaaggcgatgagcgggagaacaacgatacttgcttaggtcgagtacgttagatcttccgcgttcttttcggcaattcggcccactgaacacggctggtcttgcggcccacagtagcggttggcaatgtcagtttattgacttcctgagctcaagctacgcctctctgaccatggaatcgtttttttttttctttctcgaaacaaaaatacaaacataaagctcgtgtacatacttcccattcgaaacttgagacaggtgaaaattaagcaagggcacgtaaaataaaaaaaatattaacgcatgattaattaagttttaattattataaatttaaaaatagatttatttgatattttagagcaactttttatataaggttttcacacaaaacatatcgtttttcagattaggaaaacatactaacgaaaataaagtacaatctgcatcttaaaaaaaagacctcacttttataagggcccctttgatttggaggaagatcatataaattttggataatttcaatcctatagtaaaatttcatatgaaaacctttgaaacaaaagattgaattatatgttatcttttgaaattcctatggaatgaacaatcctataaagattttggaggaaatttagtaagagctacaacctcttggaaatatccctttgagtctatcttgctcgtccgattcctatgtatttcctggagtccaatcaaatgatcatttttgtatttttcctatattttgcaattctctgttttgcacttatatttctattagaatcctatatttttcctattgctctatttttgtgtacctatgatataattataaaggggtcccgaaggaacacacgcacgctacctctacgtgcatttatgagatattgtactagcacatcttttgattaacaaaatcattataaacatctagctatcgaaggatacatcacctgtgatagaaataaatgaacgtatcgtgtaggatatgtttggttcgatacgatttaaaaaatgtagttttgaattttataaaattttgatagttaccaatccaaacatacgttaaggctcgattctgtttatctgattagatgatagacgatatatcattaggttttgtgatatttacaaacgaatgaactaattattataactattataaagttgaagtgtttttaaatactatcaaacttgtacataaaaaagttctgcaaaaatcgtacgttttactagtaattttgtagcttaacaagcttattcatcatgataatttatcctgtgaaaggaaaataccctacgttacctatcccaacttcccaagtcgtgtaattctgtaaattctctcacctaacaccacacaaaagtgacgaggctttaaacttaaaacactttcgcatgcttgaacgtgccagcttcaaagcaaacagaccctgtgttttgaagggagaaattgcaacatatggtgaaatgaacgacggacgacggactgtgcaatggcccattatctcactgggcccggtcgtgtgctgtttaaccgcagatagaggatgatgaatcttgttaggaagaagattattttacctccctcaagtaagagctgagatataatcgaaaccctcatccacaaaaccgggtcaacttatcgtctactgtaagacacggtttggacattggtttcgtcatacataacggaaaacacaagaataataaaaaataatggacctcgcgtgttagtgttagtaggttagaaaaattaaaacaagttatgtgacacccacatgtcaggagtactttctcctagcttgactcatccactcagtctctatgcatcctatcttggtggagaggagaagtgtaggaagagctcgccggtggtgcatgtagagaaggcggcgatactcaatggagaaagaggagatagagctcgtggccgaggtagtgcttggcattggaaataactagaggctcaacacctttccgaggacttcctcctgttgttccaagactgcctttatcttgggtatgctgtagcccctatgccatcatcgggcctagccgcgcacttgttagatcgatagtacggaagctactcacatcgtgcccgtcagttgccgctgctcgatggactagcacgattgggggcggcgaagggtggcaaggcctagatcgtgagaccatcgttgctgtgcttcccgatagctaccgcctgcgtctaccatcccaaaagatctcccgacgacgacgagtttattttccacctcttctttcctctatctccatctgccaccatggtcgatcttgtgcccgtggcccactcatcgagtactcgattttgccactgttagcgccttgctctttggcggcggcggcctgctcgctttcctccgtcgtagattgacgagtaactatgaactaggacaatgtgccatgtaggagtggataacgagccagctcgcctcggctcattaaccttaacaggctaaaagcctagctcagcttggctcgagagttggctcgttaaactcattaatatatatttaccaacttcacaatttcaattttacaagtttaccatgtataaatataataataaacactactatctccatcacagtattagtgcatccagaatataatgtgatatatcttagaactacgagtcttggatgcacttaagttaggacggagagactatctaataatgaattcactaaatacaaatagtctggatataattaaatgactaaacactacttaagaagcactaagtatacatgaagatatgacgatctcttatattaaaaatgcgtttgaacaaaacaagatagctataagcgcatgattaattaagttttaattattacaaacttgaaaaaaagatatatttgatattttcaaacaactttcatatagaaagttttcgcataaaacacgttgtttattagttttgaaaccaaggtaaaatcttcatttttttttgagaaaagaacatgacctaagtctctccataaaaaattcttaagcatatgttattttctagctttttaaaagagaatgatatatttgtagtcttcatatatccaagacttaaatgaagatgttgttttttggttttgtaattctaggttaaattgataatcagaaccgaaacaaccattttaatattcatttttttacatgtatacgtataattgccttttttacgtagtacttacatatatctacctataatagatcttgttatgactatacaatggattttggctatatatttatatatttagtataataaaattaaatagacttatattcagatttattgtattaagatatattatactctattcgtccaaaaaaattaacctaggactgggacgtgacataattttagtatagttttttatttttttaatggaaggagtagtgttcataagaccatcagtgacgagcacccaccaccagtccgatctgatcatttgtgaaccgtctgatatgtggagaaacagtacaacctgaggtgggctttaaataacgcctccgcttcccaaaacgccaaaaagcgcgccaaaccaagggacgctgcctttgccgctgcgggacgggcccacgccgtgtgtgtttttgcgggcggactgagcttaccgatgcgacctgtccctgtcactcccgcctcggtaaccggcgcgctaccctcgctttcgcttgctgcaagagcgcatggccgtggactccatggaccccctcctcctactactactgggagaatgggcccaagctcctgaaccagaaagggttttctcaagcatttaagcgactgttttctcaagcaaagcatctacccaaatgaaaaccaggagcccaggatagaatatgtcgctaatgagcctgtctaaacatggtaaagtacactccacacgagtgaagaagcatcaaaacgcgtaaacgacccggttctaaagtcattttttaccgcggctcctcagctcgaccgacatgtggtggtccatgtaaaagaatctccccagccgcaaacattctcgcattctccacgactccactaggcacacttttttttctctctctcttggtccgattaccactgatacggacgtgggccgcttttgtttgaacactctcaacccaattttataacgcccacctcgcgtccgcctcggcacggtcacgcacgcactccactgcactgcactgcccgctttgttgctctgtgcctgtgggctgtggcgtctgtgaccgtcaggcgtcagctcgtgtcctcgcctgctcgtcctccttcctctccgctggtgctctctctctcttccctccacgactccacggacggtcagggcaagggcacggtctcgcaccgagccacgggcgcacgcatcgcgaaagcgcggccaccggcttgtgttgggtaggaggactggcaggggcaccaggcggcggagcggagctcgggggctcggacgccaatggcgcatgtggcttttgttgcgctcctcttcttgctgctcgtcggtgagtcgttcaaccacaccgcgttccttcttccgttgctctcgctgtttgcgtagtagtgatacttttgtggggagagtgttcagtgagtgagtgctactgctagatgccttgcttgccggtgagtgtagcaacctgcagatgtgggacaagaatacgattcttcttgtttcatggtccagttgttacgatgcacattgaacttgttcgttcttttggggtgaaatcactcattttatcgatgtgtatttcaagattgtttctttttttttgggagatgaagaaatggaagagaaatgatcactaaaactatgaaaaatgcatgattgcaaatgtggcttttgcagggcattgcctcggaggcaaggttggcatctgctacggccgcaacgccgatgacctgccggcgccggacaaggtggtgcagctcatccagcagcagtcgctcaagtacgtgcgcatctacgacaccaacatcgacgtcatcaaggccttcgccaacaccggcgtcgagctcatggtcggcgtccccaactccgacctcctccccttcgcgcagtaccagtccaacgtcgatacctggctcaagaacagcatcctcccctactacccggccaccatgatcacctacatcaccgtcggcgccgaggtcaccgagagccccgtcaacgtgtccgccctcgtcgtgcctgccatgcgcaatgtgcatactgccctcaagaaggccggcctgcacaagaagatcaccatctcgagcacgcactcgctcgggatactgtcccggtcgtttccgccgtccgcgggggcgttcaacagcagctacgcctacttcctgaagccgatgctggagttcctcgtggagaaccaggcaccgttcatggtggatttgtacccctactatgcgtaccagaactcaccaagcaatgtctcgctgaactacgcgctgttctcgccgcagtctcaggatgtgattgaccccaacaccggactggtttacacaaacatgttcgatgcgcagatcgattccattttctttgcactgatggctctgaactttaagactctgaagatcatggtcaccgagacagggtggccaaacaaaggggcagctaaggagaccggagcaacacctgacaatgctcagacctacaacactaatctcattcgtcatgttgttaatgacagcggcacacctgcaaaacctggggaagaaattgatgtgtacattttttcattgttcaatgagaacaggaaaccaggaattgagtctgagaggaactgggggctgttcttccctgaccaaagctctatatacagtctagattggactggcagaggcaatgtggacatcatgactggaggaaacattacaaatgcaaatggtacttggtgtgttgcttctgctaatgcgtctgagacagatctacagaatggtttaaattgggcatgtggaccaggcaatgttgattgctctgctattcaaccgagtcagccctgctaccagcctgatacattggcatcacatgcttcatatgccttcaacagctattatcagcaaaatggagctaacgatgtagcttgtgactttggcggtactggagtgcggacaactaaagatccaagtaagttgccaccattcgtatgaaatctatatcggttatagtaccattttacaattcctatgtactacctactagtggatgttttggtgaggtctgcatcatagtgttgtagctcaatgaaagcatataactggaactagcatgtgctgattatgacctgtttatgatggtaagtggtaacataggtccttgaccgaaattgtagtgatagctgatagataagctggtaatagatgctgcaatactggctaaatttctgacttgaactaatattcaaatgtttatggtttttggtgacatggataatacatatgtaagtatgtaactgtaataacatgcttgttgtcaatttgagttgtccgttatatttttctggttcgctgttctcttgtgcattgctttgtcttgcattatctcttgggagtttgctaagtgttgataagtattgttgatttggcatgtatggtattcatgctctgctctatttcactagttaatagtattctcaatgttccaactctgttgatcttgtggtgagaacactaataatgttcgtaggaaattcctagcccttgtgcatggatcagcacatgcttttgtaaatcatggatatcaaaatttgatgatggatattgtgtattaatatgggttaccgatgggtaggttgctggtccttagaccttagtccttcaaaatgctatgtggaagtggaacaaccttcaagaccaaactaaaattataaagatattgatggttacatccatgccaattattgttacaatggagattttgcatacgctcgattgtttagtactactagaatataagatgaaggtatattgaaatgtgatgatgaattgttttgcttgcgtgcaggttatgacacttgtgtttatatggctgccgggtatggaaaagctttctcatatctttgttcaatttttttgaagcattttttcaccaactcctttgagaaatagttctgctgactattgttttttcctcccttgaaggagtaagatgagcacaacaaattcatccaaccttccagttcaaagtgggttcagcccatcgcgattcgacaaaaacttctacctgttgttctccatgctacccattatgattgctgcatgcattgtgtgatatgttcggagagagatcttgcagaagccttttgccatggaggatggaacggtaatcgcctgatactggaaaccagtactggtttgtttgtcatagttagcggagtgttgtagtatgactatgtagtaggaaactaggaattctcttgccttgcgcggacagcatatatgagttagcattatgaactaggaacattgcagatgatgtctcttggtagttataatcctattatgctcgctggatttttcagtgccactaattctttgctgctacctttttttggggacatgtttgctgctattcttcacatgatctgatcatcacatataataggggggctaatgggcgattgaccgatcggtttgccccccccccctccccctatactcctccctcttctcccccttcctcctccccttcttctctttctactacagtacaccacacaattttttttaaaaaacaaaagttagaaaaatttatgtatagaaatactatatataaaaaaattgaatttaaattcaaatttaaatcgggtatgtaaacttttgacttataaactttgggtctataaattttagttgtataaactttagatgtatagaaatgctatatatagaaaatatttgaattcaaattcaaatttgaatcagatataatttaaatttaaatttgaatcgggtatgtaaacttttgacttataaactttggatctaaactttagatgtatagaaatactatatatagaaaatatttgaattcaaatttgaattagatataatttaaattcaaatttgaagcgggtatataaacttttgacttataaactttaggtgtataaactttagatgtatagaaatactatatataaaaaaaaatatttgaattcaaattcaaatttgaatcggatatataaacctttgacttataaacttttggtctctaaactttaaatgtgtaaacttgaggtgtataaactttaggtgtataaatttactaaaatagaaaagtaatgcggtgacaaaaaaagaaaaccaggtggagggtggggggaggggatcgatcgctgtcctaacccgaacagcatttccgcatataatatcgtcttgcacctgtggctctgaactcaattgctcttgggctgcaccgaaaactattcagcccaagatttgttttcttctcattttgttatgtttagcccaggggaaaaggtacacccaaggtccctcaaccttgtcatcgagttacaaaatcgtcccctaaccacaaaaccagatatctagcgtcccttgactagttaaaaccggtcacaatagatccttcggtgattttgaccccggttttgtcctacgtggcaactgagacagcgtgggacccacatggtgcctaaatgtcaggctgagtcatttctctccccctcctctctagtctctagtctcttcctcggttcctcctctctctctctatgtgggtctgtaggccggtcggaggtgcgaggcgggagaggagggcggtgccgcgacggcggccggcggcggccgcggtggggaagcacggcggcagcccggtggagaggaggaggaggctggtctgccggcgccggagctgtgcggtttggtttggttggttggtgaggggattcagggattggtttggtgtttagtactgtacgtgcacgatggcgacgtggaggagcttgccgcggaggccgacggcgatggagatggcggccatgacggccgggccggtcaggaacctcaccgtcatggcgaacgtcgccaccttgttccggcacgcgatgatccgcggttgcagcgccatgaacagccctgagagtgaagaaacgtgtttgtgttggtaagttgcaagaactgtgttgtgaggtaaggtgaggaggagaatgaaccgaggctgaacatggccatgccatggccggcgtcggagaggatggagatggatttcaggagattgatttcccattgtgattatcgatggcctgcattgctccatcgattctacagtgaggacggagccgagcatcggggaggcggccgtggggagggtcgcgcaggggaccaaagtcctggccgagggcggtcacgatagaatattccggtatgtgttcagcgcgccgcccgacgagcagctccgcaggtcctacgcatgctacctctccacctccgctggcccacgactgttcctcatccgccgggctgccgccgtgcttccccactgcggcggccgcggccgccggccgccgtcgcggcgccgccatcctcctctcctgcctcgccccgtcgacgcccgcgccgtccgcgcacgtccgtgcctccccgtcgacgcccgcgccgttctcgcctcgctaccgcctgccacttccccgagcccatctttggccgtcgcggaactccgctgggctgccgccgccgccggccgccgtcgcggcgccgccctcctcctctcccgccttgcctcgccgagtcgccgactggcctagagagagagagagaggaggaaccgaggaagagaagagagggagagagatgattcagcctgacaatgtggggcctatatggtcccatgctgactcagccgccacgtaggacaaaaccagggtcaaaaccaccgaacgacatgttgtgaccggttttgactggttaagcgatgctatggttttgcggttagaggacgattttgtaactcgatgacaagttgagggacctttggtgtactttttcctagcccaggatgtgtgtcggacaggctacgtttaagcccacagtcctatatatggactggcccaagccttgaaatgttagacccacgtggtccctttttacagggccgagacatataaagcccaaaggagcttctagtcggacattggcccttcgagatagagttggagttaatgcacgtaatacgagagagacagtaacacataataataaattaagttttaattatgtacaaacttagaatataaattttatattttaaagaaattctcatatataattttttcgtacgatacacaatgtttagcagtttaaaaaagtgcgaacaaaaactatggcaaaatctacattttaatgaaaactaaggtactctctccatccacaaaagttacacatattacatattactttttgacataaagaccaagaaaaaattaaatcaccttggatgttacaaaatcaagaagtgaatataagcatgcaaccaataaacatttagatgactccttgggttctaataaaatatttaatttctctttttatttaagttttgaatgtataaagactacaaataggaacaacttatttggaaaaactcaaatgtgtaatatgtgtaatttttgtggatggaggaagtaaaatttactggttgcaagtttcaacatggtgtagtataatcaaggtaaccagtttaacatactggttgcaacttgaaagcccgaaacacaggagagtacttatctatttcactgttactgtttgccaagtgtatattattatgactttttttttactcaaagtgtgctgatcattttttggaggggaagggatgacactgcgttgaagacttctagtagtaccaagttgttccttgtttagtgccacaaaacgaaggttgttccttgtttaaactgtgccacggcgtgcaagtggcttggtgatactttttacagtgattttcggattgattagtacaaatggtagtcgagttgcagagctttgtgcacatgcatggtttgcagcagaagatcacaggaaggcaagtggcatccaagctttgatccgctgccggtggttgccgcaagactgcattgtacgccagcaacctcggcggatccggcgcgcatcctctgatgctctgatcaccagaacatgtatggcggttgcagtggcagttaaggaggcctcagctcagctgctccatcattcattagcaagttctcgaaccatcttctataaacaaatagtattgctaaatgaaatggtctggaagctttttgcttagtctggacaataggtactcgagcaagattgtttttttttttggaaaaaaaaacaatattcagaggaaaggatgtccttccgaatatttttgtaagaagaaaatgcaaatgtattgaggtttgaacactgaactttaaggttgaaattatatatcccttaatactgcactatcaagtgcatctcaagattgcaagtttgcaaccgttccagctaagggcacccgtaatggttatctatatgctctctacaagagatccatgtcagcatatttttctatttgaaagagattaaatggagagagagagagcaaagctatctactaacctggagatagtttatagagaaaaacgagacaatgtattagatagctatagatacccatgtaaacatactattgaggtggtttactattatctagtctattgctgagatgtacatgttttacagagaacaccttagagcacccacaatggtaaagtaaggtgctctctataaaacatgtacatctcaacaatagactagattaatagtaaaccacctcaatagtatgtctatatgggtatctatagctctctaatccattgcctcgtttttctctatagactatctctaggttagtagatagctttgctctctctctccatttaatctcttccatgtaagaaaacatgttgacatggatctcttgtagatagcctataaataaccattgcgggtgtccttactggtgctctaacaaagacacattatatgataacagcactaacaaatatgttcatgaatgcaacttagaactggctgattagatcggttccagaactacaaagcggcagccgcatccacagccaatctgcgaccggtcagccacgacaatcgccggatcgggctggagggttgcacgtacgcacgctctctcaagtctcacacaaccttccaccattgatcgagcgaagcatttgttgggaaacgcagccgtccaccgagcatcacgatccgaccggcccagaacgtttcggatcacgcaaatcgatcgtacatccggcgcccgatcgcgaacgaccaccacccatgcatgcatggccctccgcatgcacctcggtctcgaaccgatgtaaccaccaccacaggtccaagcgcgcggcggatggggcgccccaatccagtggcgctaccaacctcggtcaaaccggcggccaaccgaccggaggcgggccagccatcgccgggcacatgcgctgcgtgtaccgctgtgcgcgaggcgttgcacgcacctaacgcgcgcacccacatgcgccgatgcgccgttcgctcggtcgagaggcgagcgaacccggcctatctcgtccgagcgagcgatcgatctagcggaggggccccggacccggcggatcggagtagcagatcgacatgcgtatctcgctgcggattacggtgcctcggctgccgtcgcgcacgagctgcaagcacgccattggatgcttatataaaactttccgatcgaggcgcgcgcatcgtgatgccgcgcgccgctgcgtcggattggtagtgtcactcaccaccacgcaccggtggcgtgcgtgcggtgtgtcggccggcatgcagggccgttaaaaccgttgcaagttgcacgcagaatactgtgggatcagtgtttacccaggctctgattttgttttaggattccggagctccccgatcggtttcaccgtgttctaggattctgtccaagtcgctggcacgttggttggtttactgctggtgggttgacattgatctacaccgccaccccgctccaatatatacatggatgtggagtactagactggagtatttcagagactatttacctctattctctgccttagccaatcaaattactcctcttggcttgctcatgccttaacaaatgaatgaataagaagaattgggaatactcctactagtaggatgtgtttagttcacactaaaattaaaagtttggttaaaatttaaacgatgtgacggaaaaattgaaagtttatatgtgtagaaaagttttgatgtaatgaaaaagttagaagcttaaagaaaaattttagaactaaactcgaccgtagcatactgatctcttaacttacctactcctagaggggttttttttttaagaggtactcctagagtatatagagaggatttgattggtcagagcaattcatgcattttcatttagaggttcatgtcagtccaagggctgccagatagcacctgtccgcatccaaggaggactgttttatgtccagacaaaagacagagatcggattgggttccaatagcgatattcccatgtgccggccatctcgcactgtcacctcatcacattgctcatgactgtgcatgcggatatgttgctcgctagtacagagtagcacagtcaattactatccctccgtcttaacaaaactcacttttaagggcctgttttagtttaaaaattttttttcataaaaaacatcacatcgaatctttaacacatgtatgaagcattaaatataaataaaaatactaattacacagtttgcatgtaaatcgcgagacgaatctttagagcctaattagtctatgattagcaataagtgctacagtagcccacatgtgctaatgacggattaattaggctcaaaaaatcgtctcgtggtttccagacgaattataaaattagttttttcattcgtgtccaaaaaccccttccgacatccggtcaaacgttcgacgtgacactcaaaaattttcatttcaccaactaaacagaccctaaatttaaatcaaactcacttttaaatttaaatctagacataggctacgtacatgtctaaaaaaactcaacctagaaggaggtctgaaccatcccagtataacgaatctgaatagagagttattcagatttattgtattaagagagggtcacgttcttttctagatttttttttggacggaataagcatgagtgattttgttttggagggatggtatactagtatctcctagtgtggcgtatatgctaccgtatcaagggggcatacaattaatactaataagtaatctaaacgatatttctctatacatgccatgcatggatatattcccctagaaattgagcacatataatatatcgggatcgatttgagtgggtaaaataaacaatgtgttgtctccatttttcgtctcatactccattactacccccatgtttcgacatgaactaattgactcgtacgtactagtacaaaatgacgaagcttgggagactgtttaagcacgtacagtactacatgcacattatacggtgaggcccagttaagcataaattaacgccgaccggccaatataggtgaaacgttggcgtcatggcccgatcgatgcatgcatcttcgtacaacgtatggggggcagctgggacagcaaatggtgaaactatcggcgtactcgtcggtccgcgcgcccccttttgcccacacagccacacgccacgccacaccgatcggtagatcggcgggtccgcgcgcgcgaaaacacgaaatgcatgtggtgttcctatgcgtgccggataaagtccaagaatatattttagataatttctggtatcaatacaataataagagggaagaaaaaggctatatgctatcaatattaaacagtcttgctgaatatttccatctaatgaatgatataatgccaacatcagaaaataatgaagtaataccacaaaaacccatatatgttgtttttgacggaaagcttcctggagtgtacatatcttttgaagagatagtagcccaaaaaatagatgcaaaattaatgggtggattgtcatggaaaaaatatatagattttgatgaagctttaactcaggccagaaaaatattaggaataaactactacttggaaccagcagcaaaagaatatatacaaaaatgcaaaaaagccaaaaataagaaagctccagagaacccatattgttcaaatattaagaatgaaggatcatcccaaaaacctacgtataaggaatgcttgactaagggagtagatcctttggatggcgaatatatcgattggaaaataattgaaaaatttgaagaagcatcccccaaattaaaaaagaattgaaagaagaaatacttaaagaattaaagaaagaaatgaatgacaaatttgaagaaatgaaaaaagcatatgatgaaaaatttgaagtctccttttctgatgtagatactatggatttaggtggtcatgggcagcctgaccaataaagcaatataatataaattgataataaatatccattctttgggcgaatgaccaaagtatgaattgaatttgaatcaatccaaaatgcaaggacagtgaatgacatttgactgttaaaaatactgtggagaatattgctttcggcggaaaagaaaggcgcaggtacagaggtgtctccaccttggccaattcaaggacaaagtaaagccaaaaagaagataagcatctccatggtgcgagccagctcgtgaaaatacagtatctagaagataagcttgaagcatagtcgagcctcccgagctcctataaaaggaggggtttgctcagctgagaagaacaacgaagacaccattcagagcaaagctttcaagcgcgctctcaccctccattccaccattcttagtagtagtgactttagcctaccttgcatagtatattgaagcaaggagttgtgttataacgctgtgtaaggtaagaacagcttgcttgtacctaccttcgggtttcccgaaagggaaaaccgtatgtaagcttatctgtttaatatgaagtaattttccttaagtattcctgcacgtttattctagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatctttttaagttgcttctaaaaagatagataggtgaggcatacggtgagtaccgagtaggactttacatcatctgaaacaagcttctgaggctgtctaaataggattcgccaccctgcaaagatcctaaagttaaaatatctctcgaagtgaacagtattgaacagtaatttaaacagtaaactaaatagtgtttttgaacagtgttttttgtccgaagcatatatatatatatatatatatatatatatatagagagagagagagagagagagagagagagacttacttttttttgttaattgaccatttagttgaccgtaaaaaatttagttttaccctcggatttcgatcgtccagcgcgcggtcgcggcggaggcatggagatcggagaggccacggcccagcgcaacacagcggcgaacgcgacgtggagcaacgcctcatgattattcgttatgtgcatacgcatgacactattctggtttctgtagcagccgtcgagcacgtaagcaaccaagctatcacacattcgtaccggtctactacaactctacaatagcgaaagcaattggtccaaaccttttttgtggttgacatgcatatgcatgattcaatatctatctattatattatcaacaccacgttcgctgtggcggctagaaattctcacattaatcggagaaaaagagaaaactttacaccattagatcttagttgtctaaattttaagggctgagatttaatagcatagaagttttaatatggtaatcagatccagatacgtgtattatagaaattggccagcagcagttagacttttcttaccaaactagcactaggaaacaaaaattgtaataggaatctagggaaaaaagctatgtccgtgtatgattttgtgtccgattgctatggtggctagctaccaaaaaaaaaaagatactacaaagcaatcacagcacgtacagtttcccatctgccgtctccaacaaaataacgaagaaataggagccagagaaagagaaggtacgaccagtacacgagagaaatagatgtatttgatggctggtccatttattcaattacctcggctaactctttgtactctactcctgttatgagggatagaaattcccacattaacccaaaaaataattttcaagtaaaaatacaatttaaaagtaactaaaattcggaattaaaaataaacaatattgaaaggagagtctatatatataagaatccaatatgagattaattaaaatttaaaatataaataaaataaaatccgaatttttttttaacaaaaagaagatttcaagtagtaaaataactaaaattcgaaattaaaaaaataagcaatgttgaaagaagagtccaaataaaaacccaacacaagagtaattgaaattcaaaataaaaaaatgagaatacaaaaataaaaatgagagtggaatacattatataaataactaaaatttgcaataaaaaagaactattgaaagaagagaccgtatatagagagattaattaaaattcggaataacaaataaaataaattctgaaaatagaaaaatatttataagagttcatataggaatataatttatctccaaataagaacccgacatgagagtaattgaaattcaaaataaaaaaacacaaaaatacaaaaataaaaatgagaatggaatacattatacaaataactaaaattcgtaataaaaaagaattattgaaagaagagaccatatagagagattaattaaaattcggtataacaaataaaataaattatgaaaatagaaaaataattataagagttgaattaggaatataatttataaataaaaaatatcggaatgaaaaatatggaattttcaaaacaaaaaggtccatttagaacactacgatgacaaatacaataaagaggggagaaacaatgagcccgtaaagaaatagagtggtggtggttgatgggacatctaaaaactataaacaaaacccgaaatagaatcaaatgacaattaagaggagggacgacaggcataccattaagcaacacggttatgacagttggcgagacttataaaaagtaaaaccccgatgataattatgttcgattttaaatatctctatgggcgggccatagaggagtacagtggcgaagccgttaatgttttggtgggacttctagaaagtaaaaaagaacacaaacaataattatgttcaattttttaaatcctaatgataaaaaagagaggatgcggtggatgggccgtagtggagtacattgacgacgtttgacgggacttctaaaaattataaaaacgaaacccaacgagacaatcaaatctgaaaactataagttctaatttttgaagttctaaagaggatgaatagaagtaatgatagatcaagcaatcaaataaaggtgtagcagaggagcaagggtagcgactaacgtgacttttaaaaactttaaattagaaacatgggaatgataaattttaaataaaatcatatgtaaaaacaataattttatacgggtactagccgcgcaattgcgcgggctacccaattataagagttaaagtaggaatatattttataaataaaaaaatatcggaatgaaaaatatacgggttctaaagaggatgaatagaaatagtgatagaatcgagcaatcaaataaaggggtgacagaggagtaagggtagctattgacgtgacttttaaaaactttaaaattagaaacgctagaatggtaaattttaaataaaatcatatgtaaaaggcaaataattttatacaggtgctagctgtgcaattgcgcgggccacccataagagttaaagtaggaatatattttctaaataaaaaaaatatcggaatgaaagttatggaattttcaaacaaaaaattcatctagaaaacagatgacaaatgataataaagatgggagaagcaacatgcctgtaaaggagtagagtggtaacggttgatgggacatctcaaaactattgataaagcctcaaatagaatcccattgatgattgaaagtaggaacaacggaaaggtcgttaagcaacacggtcacgacatttggcaggacatccaaaaaataaaaaataaagagggaaggcagcggcgagccgtagaggagcacagtggcaaagccaatgatgattggcgggacttctagaaagtaaaaaaaagaacacaaacgataattatgttcgatttaaatctcaatgacaataaagagatgagacagcggacgggtcgtaaaggagtatagtggcagtgtttgatgagacttccaaaaataatagaattgaaacccaatgaagataataaactctaaaaactataaggtccaatttttaaatgttccaaagagaatgaatagaagcagttgtaacgattgatgagacatctaaaaactattaacaaaaccccaaatataatccaatgacgattaaaagcaaggacgatggataggctattaagcaacacggtcatgaaaaaaaataaaaaataaaccccaatgataatcatgattgattttaaaatctcaaggacaataaagagggcaggtagcgggcgaaccgtagagaagtacagtggcaaagccagtgatggtttggtgggacttctagaaagtaaaaaatgaatctaaacgataatcatgtttgatttttaaaatcccaggcaacggatgggtcgtagaggagtacagtgacaacatttgatgggacttcaaaaaaaatataaaaatgaaactcaacgatgataataaactatatctaaataatgtctactacatccgtcctaaaatatagcaacttttagctatgaatctagacatatagttgtctagattcaaagctaaaaatgcttatattttgggacggagggagtaatttttaaagattcaaagagagagaatagaagtagtggttgatcgagcaagcaaataaggaaggaggtgacgaagaagtaaggagtaacaactggtatggctttaaactataaaattagaatcacggggataataaggtttggtcctttaaagttttaaaacaacgagatagctatttaataaattttaagtaaaatcattttagaaaatatataattttaaatgggtgctagccgcgcaatcgcgcgggccatccagctagttccttcgtatggtagcagtgctagtctgctagacaggctcttaattttgctcaggataagaaagtagaaacacgcctagatcattacgcgcccccacctcgcaggtgttatctcgatccagtactgccgcgattaatatggaaataaaagcgaaccgacgccagcccatgctcggtcgcaggccgcggtgtctttccaactcggtcgatcagcactccagtatctggtcggcacagcatttgcgtaggcaaccacatctccacacatacaagcagcacgtacagcggtacactatacgtagtcacgtagcaattttcgtaccgctagctgcagctagcgttgctcagtgctgttcccacgtatatctaatgacacccattctccgtttctcctgctgtcctgcatatacgagtccaagcttaataattctgccaccttcagaacaacattatgtggactcacaaaatctgcgaatcgatatattagcatgatttttttttacaactgtaacccgctgacacagatcatggagcattacaggggagaggaattgaagagcacaagagattaactagcaaagataaccagagtctaaaaaacaagaaggaaaaaaaggagagagtttgtgactaagcgccaagaaaaactcctaaggaactaggcaacaccgcaacccgaatcttctcttatgcggttaaccatcatctctaccgtgaaaagtgtcccctcaaagcacaagcatttctttccaaccataggtgtcatgtaataaggatgacgaggagagtcaaacctatttttgttgtgatcccacaaccactggcgagaagactcccactaaaccggaagcaaagattgttggcagggtgatagggaggccaatgtaacctaatcctggacaataacttgtgccaaacttgtcgcgtgaagacacactgcaccaagatatggtgatcattttcagctcttactcacacttgatcaacagctcaacaccacagtcgaagcgcaagccaaaggaaaagtttgcccttcacaggaccagtgttgcgtcaaagaaacacgacataggggaaggagattgatcccttatagaatgcgtttgttggtcgaggcggcgttatactcactgcccatccagtgctagatgaactcatcttggacgaagtcttgcagtgggcagttttgtattctatcccaaagcgcaaggaattgggagaggacgcgcatagtcagggcacccgtgatgttagagatccaagttttgccaaccaggccaggaaccatcgaagtggagttctggcgacgggtggggacgacaaggaacatatatggggcaatcaattgaactgattgcccgttgatccagctgtccaactagaatagcgagcatcatccgtctcctatgacgaccacgacagccgctcggaacatctctgacacacactgctcttgcggtagtttgaaaccaacccaatgctagagctagggtcaccacatctgcagggcctagcccatggtttggagggaagcggttcctctgacgtgaactgtcacatgacgtagtcactgacaggtgggcctgcgagcggtagggcccacatgttagccaccacgtctctctaacttcacgtcagatgatcccaatccggttcgaaggtccgtgatttctagaccctcacatttccttgggtcggtacaccttgggccaagcgacaaggcaattccggctgtagaccaagtttgaccacttccaaaggaaagctttcaaggtccaatccggcaagcccgatggcaagggagaggtgcaccgaggtggaggagaggacgagttgcaccaaggtcatcatgtccatcatagtcaagagcctctcctttcaagtagacatccagtcttggacaaaatccacaagcggttgtaggatgctcttcagaagattcgtgacggagaggggactacctaggtatttacatgggaactccacaatcgcgcaaggcaggatacgagagactactaccatatcatcttccgagcacctgattggagtggtggagcactcatcgaagttggtaataaacagcctcgaagctggagtggtggagtggtgaagcgtggcctaggtacgccattgaactggacacacgaggaagataatcgaaggataacattgtggagaggggctgggatcgccattgacgtacgccattcagggcagtcccaacccataacactaaacatggtttccataaactccacatcatcaagaaactagtactagacattactcttccaatgcaaacaccactattccatactttaatttaatgctacttatctcacatgatgtcttggatattgtgtagaaaccatgtctcatgcaagacatggttttcttctctttcctcatttattcacttgccacatcattttttgtcctacgtggcaacttatttaatgatatgaacaccatcctaatcattgggttgggaatgccctcagaacaactaatcttgcaagatttcaatatacgaatcagttaaattcccgtataaaacggcactaaacaaaaccaaagctggtaattggattgtctatttgtcttcgtcctggcggccggtcgatcgattgatcgtcgcctctcgtcgacggggactgcccatgcgtctgcgtgccacactacatttattcgagctgttaacatccagcatactcgcatgtgaggcacagctgggcaccagctgctacctgggccccgctgcgcgacaggccacgccggctgcatatatcatacaacgccccatcttatggatgcaacagcaacctagcttgatcgaattaattcgtagcgaatgccatgcatcatcatattaaaccgattgttgttagggctcataaagtcataatctcgtccacctgtcgtgtcgatccatgtcgttactggttactggttaccaacccgtgatcgatgattctgattcattctcctcgtcttttagtttctttaattttgggtgattagttgtatggcctacccatcataggccatttgtacatcttatatccacagacagtgtcagtgtaatgttggcaaacattggacaggggactcacacagcggtccttttctctgagagtctgaattagcatctggttgtttcaggctcaagtcaaaatacagtaacatggctatcttcgtgctagagatcaagactccattataaaaacttcctagggcaagtacacaagattaaggggttgtttggttgatgtctaagcttgtcataactaagcttaggcaagttgtggcatgtggcaaaagtatggctaagaaatagttagccacaagtgtggcaatattagctctaattatctgagtatgatatgtagtacctaagggtaggaaagtgtggcatgacataactgtggcattgaaacaaacacacgactaaaaactgtggcatgactgaagtgtgacgtggtaaagtgaagcaatcaaccaaacacctcctaatttcaaaaagaagaagaagaagaagatgaattcagcctacttactttgagtgggtgttgatatgaactgagcttattaaatgatgaaaatgaaacgagcagagagttgatcaatccgtgtcgagtcaatatcggccatgctgtgatacagtggtagcatctgcagccagctacgagatgattgcaccgattgtttcctctggcctcgagccaaggatgtaattacagtacgtaattggtgctattcaggccagtttttttaagcttagattaagttgcgcggcgggccagggagcggccgtagagtatttgttttagtaatttagggtttagctaggcatgcacgagccaacgtggagaagatatcgttcatgtgcaaaacggcaaatctcttcccttcctacgtactactactactagcgtcgtccaaaatttgccgaccgaatccaaactcccatctgcgcaggcgcagcgacccaaaccgggccgcacgcggctacaccaccactacatataacacgcgcgaggggagcagcagcagcaacggccgcgataacacctgcgacaaaccgggccggggtgatcgagcgcagctagcgcgcggcgccatggacccctgcgcgttcgtccgcctcaccgtggaccagctcctcctcaagctgccctccgtgccgcgcccgagctccggcgccgccggcgtccacccttccacctccccatgcttctgcacgctccacctccaggaccacccctccgccggctcccactcccgcaccgcgcagctgccgctcgcgtcatccgagtccccgggccccgtcgccgccggggagcccgtggtgataagcctcgacgccgccgcggtgcagaggctctcggcgcgccccgccgccgagctcgtcgtgtccgtgcacgccgggcagaaggggaacgccggctgcggcatgagcgccggccgcgcgctgggcagggtgcgggtgcccgtcgacgtggcgcgcgccgcggccggggagaccgtcgtcgcgcgcgacgggtgggtggacgtgggcaagccggccgcggcggcggcgtcccacggccacgcgcgcgcgcagatccacatggtcgtgcgggccgagcccgacccacggtacgtcttccagttcggcggcgagccggagtgcgggccggtcgtctaccaggtgcccgggggcgccgccggcggtggccagcggcagccggtgttcacctgccggttcagcgctgggcggagggcaaccaggaccaggttggtgacttggtgtgcggtacacgtattacaatgtgcatgcatcattccatcttcttcgtttgctcgctaagttaagcttgcggtgttaataatttgctttacagtgaccctgtgctgacaaacgtgtattttctcttcaactaagtgcttctcgtacgttgcttatatgctagttatatgtacgacggtaattgtgaagttcactgctagataagatagctagagctcatacttgggggcgaaaaaaaattcttacgttttatacagtatttagataatgaaacacagtcagtgttagttttcatggttgataaaagtgttgatgaattcattatacaagtagagttttgcttatttttcttgaaggtgcaaaaaagaaaaacaaaatcggtatgtaatcatgttaggatttaagttttcgaattatagtattcagcatgtacgtatagctagcagttggacagtatagtacgtgcccggccttggcctctgcggactgcggctctgcccatacacgcttatcaatgcaattatgcaaatgtccccatcagtccaggacatatatgatatatggacatatgaattaaaaacaaacaactcaatttatttatcttgtcatacggcaatcgatttgctaatcaataccgacttgtgattcggcaatgctcgattatttgagaaaaagaaagtagcacagctcaatgaagaatatgatgcgattctatttcatcccaactatcttcataaagaagttgaaaatcatttcgtctccttttcaatttcgcttttctttcatacggaattccttttcattattggatgccagctcttagataccttgtggtttatatcatgcaccggcactggcagtcatctgataaaatattccaactcccatacgtaacgacattttaaattaatttgccatggaagggaaactttttaaggttagaataaaatggttggaagacttgataattaaacaggcagtaccaatattccaagccacgtactactaaatacaaatcctattaagaaagttaagcacctccaatcctgcatgaatatatttgtgccattgctatttgaccagtcaggttgggttatgacatatgagaaccttcactgtcagtgcagctcagatctccatacatatacatgctttgtttatgctagctctacggaactttagtcactggactttgaaagtgaaacatacgccatggatggacagcatggtcagatatagacgacaccaaccgttcatgtgacggtcttagcattctgtctagttaccttactaatttgctctgcaaaatttaaatctttaacctcattagctgtcttcagaatcttccttgtatcatgtccaccattgccatcacctactggctactgatcttgtaccagtcacacttggcaccaacttgttatgcgctactcaaactaagcggttctttaattactagctcaaagatagtatgttgctatcttaaaccttttggtactagccatgcacgcatgcacttgcatgttactactacagagctagttaaactaatcctgcatgtgctgtttgttttgtccagatcgttgacgtcggagtcgtccatgactcggagcaccagcaggaagctgcggtcttggctgagcacgctgcacggcgaccgcgacgcgcaggcgcggcgcgagcagcgcaaggggtggacggtgacgatccacgacctgtcgggctccccggtggccatggcgtccatggtgaccccgttcgtgccgtcgccggcgggctcggggcgcgtctcgcgcgccaaccctggcgcctggctcatcctgcagcccaccggcgccgggccggcgagctggaagccgtgggcgcggctggaggcgtggcgggagcgcggccccgtcgacgcgctcggctaccggctcgagctggtgttcgactcgggccccaccgagtgcgccgtccccatcgccgagtcgtccatcagcaccaagcgcggcggccagttcgtcatcgacccggccacgttccccgtgggcgccgccggcgccgcgtggccgttcgccggcggcttcgtgatgggctccacggcggagggcgaggggagggccagccggcccaccgtgcaggtcggcgtgcagcacgccacgtgcatgggcgacgtggcgctgttcgtcgcgctcgccgccgccgtcgacctctgcatggacgcctgcaagctcttctcgcagaggctcaggaaggagctgtgccatgatcaagaggactagcagggagacgaaacggaatcaagtgcatgtacttgggggtttggcttgtgaagttgtgatgcatgcgatcactttcatgattgtgattaaattagttaactatagatattcaattgtttcttgtgaaagtgatggcctgtggctgtttttagtttaggctgggtcggatcacaagaagagaaacgtatgctctatattctttcctcgcgatattcttttgattctttttaatttatatacgtttctgttcctcttttttccttctgaaagtctggaaataaactcggctgcccgatgcaaatctgccctttggtgtctctgtagactgtagcctgtaggtgcctctgatgagttgatgtacactacacaaattgtcttttcagtcaacaggttaattatactatcttatttttcaccatcccgcacataccaatacccaaaaaaaaaagaataccctcgttttatcaaatcccaatacaattatttatcactttatcatctcccaatatattaattcttcactttcacatatttcgatgcaatgatttactcaaaaactaaacttatttgggataaatgggatgtcctaaaaataaacttatttccgaacggaggggtagctatttttggtgtggaaacgttcggccaggacagtgcccattggctgatgggcttaaacctgacgtgtagcccattttcggttggccacggggctgctactgacatgcgggcccatgtattacgacggaacggggctgtggcagacctacggcctgttaaggtacacatgggccgttttgggcaggttgaggtgtatttacgacccaactcgtacaactgccttccgattctggtgggcttgtgggacgtagggttgggtcagacgctttccattgtactccctccacatcaatggctagatttgtggtggcgcagcggcgccggagccatcagccatgggctcatcatcgtcgtgaagtatacgtttcagtaagtttcttcagtgcagcgtttggtgattatttaagtaggaatagccttgttgttcctttgtgaaaaaagagatagtctgttcctgtttctagagaaaaagtgtgttagttttgccgttgcgatattttcattaattctatctcttttcttgtttgctgttagcctattagtgttgtacctgatatggatgactataaacgatatggtattaaatttgcattgttcataacttcagtgtgttcaccaaaaaagtacatcctctttgttttccgatgcgagaatttagaggatttaccatcaaattcgcctgctttagggcctattaggattgttaccctaccaaaattttttgtagtgccaaaatagggcaagttttggcactaccaaatatttggtaagataagattatgtttgatcatatttggtttgctaccaacatatagtcaaaatgtgaaattgtagtaaagtatgttctagatgatgccaaatctagattaggtattaccaatgaatgggcttcaatccaaatcaaacacaactactattcaaattaccaaaatattggtagggcatgtttttggtaacaatccaaataggcccttaatttttttaccacctaatccgcaatgccctcaataatatattattagaactgttaattagtatatttgataccactttctatgtttttcatgtatttcttatttcttaattccattgacgttcaagcgttttctcagagaacgcaatacaaaatcaaagcagtattgtatatctataagctatacacataatagaactacaaaagtagtacacaagcatgtgtacaaaaaaatctacacaagcatctgtacaagtaacattccaacttcgtgcttgaatcgatcgccatgaattgtgtatatcttcattcttttccttgtacttaaggaatcaaattgtaaagaggatcaatagccagcataacatgactatccatgcaggtcaaacgttctttggcctgttggattgtttgattgctgaaacaatgtccagcctattgagttcaatgatgttatgtcaggctgccggcaagtacaacagaagcctgtgttattgccctcgcgactctgtgaatctcgtgctgtacaaacttccacgattctgtagtgttttccttccttgcactagctatagcattttctacaccaggataagatgcactttcccagtcattctgttctgatggtccatagacctgcgagaagcaacagctgccaattagcacaaaatacaaactgcaatctgaaaaccgtgatatcatggtgtaattcaaaacaagaaacaatgtaaactgaatccacacaccagatgtttgaaccattctcgcttgaacaggccttccctgttagtgaatgcccgttctgcctgcatgagccggtcattgagcgaccgtattttcattgaatcctttttcagctggttgctcgacagttgcctttgaagctcctaagaacagtcattcctcttagtcatgatgaaaacctgacctagaaggctgtctgaaatagtagaaattcttcatgtacatttacctttctctcgccatttactttggtagctgccgttttcagagctctaattgcattgtgcagtggagagcaactgatagccgttccccttacttcattctctactaccttcgtatatgcctgtgataaaaaaaacattaaaatcacgtaataattccagtcacagaaaagggaaatcaacagagttcctctctacaaaatactactggaagcatagtgatgatacctcaagttcaacagggtaggacatgtaattgaagggcaggatctcttcgtcagcaagcctcaaagccatcattccccagatgctagcagctgtaatacgaaaatgccgctcatcatgttgcagagaaagtactaacagccttcaaaaaatacagagcaatacctgcagcgtgcctactgaaccctggatctccgaatttctccatccacacgaagtcatcgtataacgaatgatatatgggatagcctggtcctgcaaaggacaaggcgaaacaagcaaaatccattaaaaagatagaagtgaaaaatccatttaaaagatggctcgatagattctggaacatgaaaacccttgccttctccaaaacccatgctggttgaaggaataccaacatgctggacgaaagctgaaaaatctgatccaccatggcctagccgtccaatcttttatgtgggggcaggtgatcagcaatgacgttaaaattattttttttcgaaatgaaaattttacagctaaatatatcaagtaacttggaaataggaattgctactataactattctgtttctaatataaaccatcttacaactcaccaagggggaaatgttggatttgacccatgaatcatacacggcttgagatgaattgtcaggatcttgaaccttcatgattggagaaagtgcatttatagttattagaaatcacaaccaaggatacgttataaacataaaatgtctcactagtgtttgaaaaaaaaagttgaaacacccattattgactatttctacagtaaaaccaaaagaaaaggcaataaagctctgccattttttttcgtcttttcccccaaaaaatgtcaacgtgactcgttttcaggaatgatgtgctcaccaatttcattgtttcctgaaatagttcgtcaagttgcggagttgcagagggatgaaataccgggccaactactgaaacgtcaacgttaagataagcaacagctcttgaggaaagcatctccctattttcttcaacccattcagttgatcctgtctgcataaatgtaagttgtgaatgatcaccattctagttgctcttactctgcataactctgtacatatatagtgcagagagagagagagagagagagagtcagagatatttaccagcccatactcttctgcatcccagctgcagaagattatagttcttctaggtctccatccttgcttttgcagcaccgaaagcctttgagctagctaaacgacaagtaaacaacacgccaagatgcagacatggccatgttctgagtgatcagtcgcagtattataaaacggtgttttggctcagcaaagttacgataaagtacagcctactgaacttcggagaaagaactttgtgccccaaaaattacctcaatcatagctgccgttccgctattgggatctgatgctccaaacgtccaggcatcacgatggttaccaaggataacatatctgcatcacaaaagggtcaaatttcagttaagtcacatcctaagttcatctctgatttcattttgtgtggttgtgcctagactttctgcagactgatacgtctctaatcagtcagctacatgatttttttaaaacgaaaaatgtgtagctgtattactttctgatctctatattctgcaggatatggatatgatagcaacaggagacggtggacatctacatccgaaatataaagtgagccatgtatagcttgccaagataatatttttgttatctacaaatctgttgaaatattgaaactacagagggagaaaaaaaatgtcaagggctcccactatccaaatgtcaagggatagaaattatacaataaatattggactagaaaatcatctgttgataatggtgggtgattgggtgaatatgtcaggcctagattgataatgtagaataaaattgttgtaattatacattcccggcaatgataagatgaaattttgtggcaaatataggcatgtaaaagtaccacggtagtgcagagtattaggtcaatggtagagcacatgaaatttttttatcggtagttatgaatcttcataattttagtgaggctagagatatattacagatctctatcaacatatggttagcaattccgaaaaaaatattgtcaacgaatggtccaaaagcagtgcatggcaatgcccaagtgggatgcatgtgttaacaaccagcacaggttgtgattgaaaatctgaagcagcagttagttagagaaataccccatgaagaagtgtatactggaggagtagagtaatttaatctgatgcaatgtcaaaaagagttacctgtccggctcctctgcaccttcgatcaccgcgaagacattctcgatggtggccatcgtatcattcccctgcaaactccacaagaaaccattggctcgttggttgcaagttgcgacccatgaggccatgactactaaaaaaacaacatgcggatttcagtgatcgagacagaaaggctcgtcgaatgttgcttacggtatacgtcaggttcaggatcgccgggccagggccgaggcggtacactgggctgccctcccggccctgccagtccgccggcgcagcgtcgccgcccagagcggcgtggatctccgccgcgtcacgcgcggacaccggcagcgcggggatccccggcatgtcgtcggtgtccatcgcctcctccacactcacgcgctcgcacccttcggacgacgcccacatcggcgtcgtcgggtcgcccacgccccggaacaggctgcccacctgcacgccggtcggcggcagccaccgggagtcggggaaccacgcctcccccggggcgccgccgtactgcagaggatcggtgtacaccaccgcggccgcggcacccgccacgcgcgcgttgtgcacgatgtcctcgcagtggatcctcccgtaccgcgcgaccgccaccttgcccgcgacgtcgacgccgcgggaggcgaggtaggcgaagtcctcctcgcggccgtagttggcgtacacggcctcggcggacaccgaaccggaggcggcgtaggcgtagaacgtcggcatgacctccgccgtggccgacgcgtaggggtcgttcgggtacgtctcctgcgacagggcgaagctcgtggtggtggcgcggccggggacggcgagggagagcgagcgctcgaccgggtaggagaggaggacggagtagggcgtgatgtgcgccgggatggagagggacgagaaggcgtcgcagacgtaggcggcggtgagcgagttggccctggtgcccgcgacgtgggggtgaagcgtgagcgcccggaggtggagcgccgcggtatcgttggaggcgagggagaggaacaggctgccatagttcggcgctggtgcggagtggacgacgaggaggagcagcgagagggaggctccgagggcggcgagggtggaggagacgacgcagatgagccggcgcggggtggtaggtttgtgcggcggcgtcagcgagggagagaggaggagggaggtggcgtcgaggcgcgacatggcgcgcggcgcggggtggtgcgcgcggggatcgcgcggcggaaggaagaggagcagagtgcggggtgctctgttctggctcgtttgcttccgtgccgcgggcgcgctgtatctggctcgcgcgctgtttaatccgcggagacaactgacaagcggaccagtggcaagctggatactgctgctgctactgccacaccggcagtttgatcgtgcggcggcgatgcgaccacagcgcacgccacaacaatggcagtgtttatagtttccgcctattcctaactttccatcacatcatattatatcaaaattgtcctacgcatataagctttcaactttgagtaaattacacccacggtacaacaatttagtaggtgggtgtaatttagtataataacttgaaaaataagcgttctagtacaacaacttagcaggaaagtacaatttagtataaggactttataagtggtcgtataaatgcaataacttttaaggtaggtaagattttaatacaagagtaaagtttatcaccggtccctaaacttgtcgctgtgtcattccggtccctaaactcgcaaatcgatcattcagatcctcaaacttgttcgactgtgtcatcccggtccctaaacttgcttatcactcgtttaggtcctccaacttgttcagttgtgtcaccccggtccctaaacttggatttgaatatcatctgggtcaaataggaccgtctaaagactttatatttaaaaataattcatagtttttccatgtgaactctaatgaaaacaaactttatatcaaacttgtagccctcgacgcgatctacaattttatagttgaatttttttattttaagtcattttttgtcccaaaatgtaattttaaaattaaaatttcaaaatctataaacatgcaacaacattttgggaccctaaatagttttaattcaaaaccttttcaactacaaagttgtaggtcgcgtcgagggctacaattttgatataaagtttgtcttcattagagttcacatgaaaaaatatgaattattttttgatataaagtttttagaccgtcctgtttagggaccggggtgacacaactgaacaagttggaggacctaaacgagtgatctgcaagtttagggaccgggatgacacagtcgaacaagtttgaggacctgaaaggtcgatttgcgagtttagggaccgggatgacacaacggtacaagtttagggaccggtgatggactttactcaaaagagtaaaataaattataattttgacaacttaatttcaagcattttttatataaattcaaatttttaagtacttattttgacaatatactagcgtggatttgtataaacatatttatattttttcctaataactaataactgaaagtcaattaaactgaatatagaaattattatatttcggttgatatttgagaaggtgaagaaaacaaaaaattcttaaaggtaattggatataaattgtatgtgcaatataattcttaaagattaaattcaatattataaggtaatatttgtatcaactaaaaaaaggtaatatttgtaggattattgtgttttggcatattgacatagtgaaaaaactcacctagcatatgcttatccaaattgatttaccaaaatactaaattattaagttcttgtactagaatgcacccacttgtcaaattgttacacttggacgttcaattctaaagttcttgcactatatcgcacccatctgccaagttgttataccgtgggcgcaatttactcttcaaccttttttttttcaaacttccaactttcttcaaacttcacttttttaggaactgaacacacccaggccgtatttagttccccaaattccaactttccatcgcatcaaatcacatcgaaaactttcctacacacataaactaccaactttttctttaacctaccaactttctctcaacttctcaacttttccaccatctaaacacagccccaatttctcggatgaaaatcgtgtgaggctggacgctggagaggatcttgccggcttgccgctttggggaaggagcgattattatagatcaggttctcgctgatggttcgctgtttcagccactccgtcacaacgtgcgctacagttgagtaccccaacttcgccgctcgtgtgacgtcgccggtggccatctccagctcagacatgtttgtttcctaataagataagctcccgtgtgtagtgcatggtctcccgcaaggcgctaggcgctaggagcctaggatgatggtgatgtagtacttactcctacaagggatcaactacatcaccatcaagtttaatagttattgattggcggcaggcaatgccaacagcgttaggatgttgatgagcgagtgattgggtggtgtcccaatgctacgctacaattagcggaccaatctgttaatgttccattagggacacgcaggggtactccaactagagtccctttcttcctgtcaattcatcctattacaaatccaaaagttgaacaaagtatggaggcttaattatcttgggcacgcactatttgtggatgcctcgaactatttggcttccaggtttaaaatttgccatctttttttttctatgtcgacactatgtcctcatcttttatttgagtgtcagattaaacttgctgcttactacccctccgtgttagaaaaagtgcagttttacacggttcatgttcaaccattgatcatctgttttatttttaaaaaatatgattggtattttaattgttattagatgataaaacataaatagtactttacgtgtgactatttttttttatgttttccataaatttttcaaacaaaacggacggtcaaacgttagacacgaaaactcgtatctacgcttaaattgggatgaaggtagtattacttgttggatgaacaactgaaactctcggatgtgacgtcaaaagaaaattgggggtgggggattggaataaaggccctggttagttccttttcatcctgtcacatagaatgtgtcggagaatgaactcctccaccagggaactgtgaggcccccctttgtgagttcggccgggggcagcgggtgagattcgaggatttggtgagcgaagctgtgtgatcttgagggggttagcccccccctcaagacgatgagacaaaagaggtttatacaggttcgggccactgagaagcgtaatactctactcctgtgcatggttgattgaatgtaaaacaagtgcttggggttgcgagacccaagccccagttcaccccgaagtccccctctccaccactaggcctggacctccttttatacctcaaggggttaccacatgggcccaacaacctaacctagctccggtggagaagtattataatctttgtattaaatgcatgtcttgtctcttgacttgggaagccaagcacacgtcatcttgatgatggggcctgtcaaatcttgccgcctgacacgggggtgcccctgtcaatcaccatttaatgggtgaagacttctgggctcctattacaccgagaaacgggagccttactttgaccagagcgggaggaccgactccggctgggataagacaatgagaaactctcaccatcattatttgatgggacatgttaggctgcacgccgcctgcagcgcacaggcgcactagccagtcccatcggtcattcgaccagtcacagaccggttgagtgcactgcacgctgcgcgaccgctcgggacgccataaatgtgggtaggtggacacctggaggcggacacctaacccaccgtacgtggtgacctagagagggggtcgggggagcccgacccctagtcacgggagggggcggccgccgcccgacctcggggggggggagccacgtggcgcctggggcagccttctctctctagtctcggccagggagtggccgccgccctacctcgggcccgacccccctcgggggagggccatgtggaatcgggaggtagcctcctccatccagtctctgggaaggagtggccgccgtcctacctcgggcctaactcccctcgggggagggccacgtggcatcggggggggggggggcagcctcctccgactattctttggggaaggagtggccgccaccccacctcgggcctgactcccctcgggggagggccacgtggcatcgggggcagcctcctccctctaaacccgatactcccgggcccatatcaccgacagaatgtttagacacatgcatggagtattaaatatagataaaaaaactaattacatagattgcgtgtaaattgcgagatgaatcttttaagtctaattgcaccataatttgacaatatggtgctacaataaacatttgctaatgatgaattaattaggcttagtaaattcgtctcgcagtgtacaggcggaatctataatttgttttgttattagactatgtttaatactttaattttgtgtccatatatctgacgtgacacgccaaaacttttcataaaacacaagttttcagcgtcataaaacacacactaaagttttcagtgcttgaatttactattccgacccagatcgataggtgtgaccaacgaaccaactgctgcgaccgacgctacctacagcagatctatcggccaagcagattcacgaggaatcaatcaataaaaactgcttgatccgtgtccttgtgtggccatggaggtgacgcaggatatactcgtctggcaccattccaataagctgcaagattccaagccttatcgagataattaaaaaaaagagatactatcgtactggtcaatttgttgtggtacactacgacagcgaaatggagacggtcactcaactcttaaacaattatgcttccggttttattcaacagaatttgggttaacccatctgaaaaaaaaactctcaaacaaattattcgtagtaccctagagaatcacgcagggtaatccacaagagagtttcttgtgtgcttggaattaattagaacccttgatcacctataatccaacgcactaagataaaaggtacaggagcaaagtagtaaaaggatgggccaggtatgagaggtggaaggttaaaatggtaattaacttctatagttgatttgtgtggttaaagataaatgcgttatcttttcaatattcatctctttacgatccgctcaaaactcccgatccgttccaaatgccgtgcacgtcctgatgccaccgctggctgctcctcccgccggttcctcgccgggacgccggctacataagttgatgttcggacttctcggataggttggccttcagagtgtgccgtccatgacctcgaggtaaaagcggctgccgctgatgtcgagtgaacctgccggctttgcataaacgtgcttgatctgcttaattaaatgatcagcgattaaccacagaatatcttgttcgatcaggatagcaattagatgcatcaatttcgcaagaaatcaatgaccaaacttttcaattccattcaacagctttcgagccaatcaatgcttaacaaaaatgaaataatgcttcagcatttaggaaccatcagcagcagccagcatccagccgtcggtcgcaaccatcgtacatgcccgccggtcgtcgctgccgaacgcaaccgtacgtgcctgccgatcgcagccaccttgcgtgctgcccctgctcctggtccgttctttcacttgggatttaaagttagggttagacatagagagattgaggtcacgctaatatcgtgaaaaaaaacaatctcattgaaacgacaacgtcagccagcggatggggattggacaattactaagctacccttgttaatattatttcataatcctaaattaccctttaggaatcaatggtggatattaattagtttaggaggtccctgggatacctctcaagcaccgtaaaagatctccacaattcattaacatcaataattatgatactaactgaggatagttcttcagtatcttcacaggtacttgtgtaactatatcatatcatcgtaactacgtgtagagctggtatctggtactttaaactgcacaaaactacgtgtagagctggtatctggtactttaaactgcacaaaatggaatcgtgtagtgatcttaatttatgtactctcatgttagtctaccatcaaggacagctgaagccttggacacagcccttgcagccctgtaaatttcatgctgcaggagctgccaagattcggttgtgttgagcttatttgccttgtcgatggccgacacgataccagggaatgccttggtgccccagtcgtcttggtcagacgatgcgtatatctgtcaaaagaaaaaaaatgattggacataggttatcactttgtcagcatcaaatttggatcagaacggcataccaaactgcagaactgatgatactcaccatatgtttgtaccacggcctaccgtcgagcccttcccggttgatgaagcctcgctccgccatcattaaccggtcgttgatatctctgacttttactgtgtacgctctcgtttttaggctccagttttctgcttgtagcatctgcaaggcagaaatgagatgttttcattggaatgttggagcaattttgcgcgccatacacttctgtttcactgaaaacggaaggcgttaccatcttttctttgtgaattttgttggctgcttttctaagctggtcaattgacttgtgtaaaggagcgaaactgacaggacatcctgtacacccaccttccacaagttttgtgcatttctgcgataaaaaatgtggcaggtaattcatatgttaagcatttgctgcagattgttccaccaactctggtaatttcataacctaacatttacccatcagcgaaaagtgtatcacaattatgttctgtttttatttataaaatgaatcgaggctttgtcttgtgtcctaaattggtcatctcaattgaagaaaagaaggaaagttacctccagttctgatgcgtaagagacataattgaggggtaagatctcatcatctgcaagcctcaaagcaatcagaccccatacacttgccactgcatgattatgcaagcaaaacaaatgaatctgtcagtgtttgcaatgagatgaaaaacctttgaacaacaactagttcagtacatgcaacatgtctgtgaaacaacggatctccgaatctctccatccaaacataatcatcgtacagtgagtggtaaacagggtaatcttccactgcaagagcaataatattagtagatgctaaaggagtgacagcagcagagactgcaaacaatggtgaagtaataaaaaaaattaggagttatcaagatcaacatctccaatatataatcattacttgttccgtaagacatgtcaagtgaaggtactccaatatattgtagaaaagctgcaaaatctgttcctgctccagccactctatcaatctgaaaagaaaactttatcactttcagcacaaagataattttattccagatctaagattgcacataacaggattataaagccatttcaccactgtacaatgtacgcaccggaggatggtggcgaatcatagtgtcatacaatgtctgcgatggatcatcaggatcttgcaccttcaaaagagagggtggaaaatgaaatgatttttgtgcctttgtaagactgctatatactttgatattggccctgttcaaagaaaatttccctccctccctctcttttcaaaatgacggtcttagttatacttcttaatcaaaaacaaaatctggctgtccaatttgtaaaaaaggaaagacggagtaaagcttaaataccattttacttgcttctttgatcaactgatcaagttgaggggttgcccggggcctaaaacctccagggccaaacactgttatatccacattcaaataagcaatagctcttgaagccagcatatccatgttgtcctcgacccattcagtagaccctatctgagacattgagtgtgccgcatcaatacacaaccttctgataaagaagcaattcagaacaagtgatcaaggacataccagagcaaactcttctgcatcccaactacacacaatgattgttcgtctaggcctccatcccttcttctcaagcttggacagcctttctgcgatctatatatatacgtgtgatgctaacattatatcatcaactcttggcattcagaaattatagatgccttttatcatcaacaaaaagaatatgcacttaaatttgttgtttggaaaatgagacaaaggctaactagaaagggaaaggatgaaatattcatgtctccaaatgtctgatgaaagatgacatatctgtataatttgctcctctaaactgaattgattacctcgagcatagctgctgttccactgttgggatcaactgctccgaatgtccaggcatcacgatggttccctatgatcacatatctgttcacaaacgggcaaatttatccttattagctttgccttggctttacaaaatttctagaaatctaatcatctcctgtgggatgaaaaatgaggactttgatctaaactcagaacaatatgcagggcagggcactaagtcaaagcctgataaacagtgataccacgtgtccacgtgcaactgaattctatacgtatgcagaaaaagacaatcaggaatgccattcacttgttcgagcgagagattacctatcaggctcttcttttccctcgatcacggcaaagacattttcgatggttgctaaggtgtcatttccctgcagttcaccacagaaacaacgatgagtcgatgagttttcttggataatgactcaactagaacactaagatccactcacaatgtacgtgagattcagcacagcaggaccgggtccgaggcggtacatgggcgcgccctcgccgccctgccactccgtcggcgccgcgtcgccgcccatcgccttgaggatcgtctccccgtccctcgccgacaccggcagcgctgggatgctgggcatcgcggcgctcccgtcgagctccccctggctcagccgctcgcagtcctccccggctgcgcaggacggccacagcggcgtggtcgggtcgccgttcccgtagtacagggtccccacctgcacgccggtcggcggcagccagcgcgcgtcggggaaccacttccgcttccccttcgctcctgcgccgccaaagtccttggcgtcggtgtagacgatcgcggcggcggcgcccgcggcacgggcgttccgcaccatgtcctcgcagtgcaggtttccgtagcgcacgagcgcgaccttcccggcgacgtccacgccgcgggaggcgaggtactcgtagtccttggtgttgccgtagttggcgtacacgacctcggcggcgacggagccggaggcggagtaggcgaagtacgtggggatgacctccgccgccgcctcggagtaggggtccccggggtaggtctcctggaccagagcgaaattgaaggcggccgcgcggccaggcacggagagggagagggagcggtggatggggtaggagagcagcacggagtagggcgtgacgcgggtggggaatgagaaggaggagagcgcggcgcggacgtactcggcggcgacggcgttggcctccgtcccggcgacgtggggccggagggtgagcgcgcggaggtgcgcggcggcggtgtcgttgttgccgagtgagaggaagagcgcgtggtagcgcgacgcgggggccggcgcgaggtggtggtaggaggcgaccagggccacggagatggccaggaaggcgacgaacctgcgcctcctcgtggccgcatcaccgcgcccgccgtcgccgcctcccatgggcgcagcatcggggaggatcagcggctgccgctgctgtggcttgccgtggcgagacatgggtgatgggcgcagtggcttgggtggagtttggagaggcgtcgtagtttgcggttgcaagcaacgtcactttgtcagcgccaagagcccaagaggttgtatcgtctcgatttaattgggtcgttcgcatcgcaccgcagcgcgcggtgctcgcacacgttgcaacttgcaagttgccgcgcaatgcttcgttcggcttcaataattaaacgcttataataagtgtggaaaaatatcaaggctgattatgagcgtcagccatcagctcacttttgttgatgcccacgagtttttcctctaaaaaatattagctcgtgagcaacgttccaactccgcgagcgaaaagtagtacttgtctctctaataaacgaagttacggattgtctctctaataaacgaagttacggattatgacacgttgaaatgcaaaccatgtttttaatatactccctctgttttttaatagatggcgccgttgacttttgaatatatgtttgaccatttgttttattaaaaaaatttatgtaaacgtatagatataaattatgcttaaagtactttgagtgataaaacaactcataataaaataaattataattaagtaaattttttgaataagacgaatggtcaaacgtgtgataaaaagtcaacggcgccatctataaaaaaaatagagaaaaatagaggtagtagtatcttaaagcataatctgtagtgctgtagtgcgggttagtttctagaacgtttggtggttggtcttgcgctcttgttaggaagaggcttctggacgtggcttctctgatatagagcactactcgtactttggataatacaaaattttgatacagtaattaaattgaaaatgtgtattttgttcagacttcagaggatttgaaattgtgtttggttcgtcgcatgaaccaaacataagatgcgctttgctgagttttttctgcacccaaaggcatcatggagcacatcgttgtcgaaagggtgaaccaattcggatactgggaatcgacaacaagattcattcaggtccttgtcaaagattggtcgtaggtggaaccggacaacggcacggaaccaccacgaattagcagatgccccacatcaataatgcgccacggcccagttcagagcgtagcaattcatgaggatttttttggcaggaaattcgtaccctttgcttttcggagttgaaacgagaaaacgcaacatcatcaccaattacaccgcatcacctgctcctttggaaaatactcaccggccggaatggcaccgcgacgacaacggcgtcgacttcaatcgacgtgatttgggcaatcagtgcacccagaaatcaacgagacagccaaagctttggactttcgggtccggttgatatcttccaacggtccaaggcctatccaaaattccaaatatcccaactcgaataaaacgaggagaacatgcatgcatcaaaatgttgctgggctcaaaggccttaaaatgttttcgttgcatggcctaccttgggctaaatcagatttacggcttgtttggtttctagcccaaatcaaaggaataagttcactttgggtccctctatttgtcgtccagtccgattttcgtcccttggttgcaaaaccgggtacgacaggtcccccaacttacaaaaccgtttagattaggtccctcggcagtattgtgtctgatttttgctgaggtggcgcctacgtggctccttttaattagtttttgtctaacgtgtcattgatgtggcgtttacgtggctactagattaagggtgtgtttggttcatagtaagactggataggatatggccatccatattttgagggatatggtggtccagttttttgtttggttgggtggatgagaatggattgaatgaaaacaacaacatattaattaataatgaaatatgttaattatcattaatatagccataatttatactaattaacaataaaatagagtaattatatctaattttgacaagctaattactgattaacaataatataatttaattattgctaatcaagaactaatgatcaaaattagcaaaggtgaatatcctcatccggccaatttggtcgcatacactcatccagcatcttcgtggaatattccctctccaggccgtcctatccaccttcgcccaccaatcaaacacactcaaaaactggatcgccatctcccatctagggatatccctccaaccaaacacaccctaaaaaaaacccgtgggacccacatgtcagtcacagacacaaataataaaaaatggtgggcccatgaagacccacacatcattctctcttttctctatccctctctatcctctccctccttcttatctcgctctccaagccggtggagcggcatgggcggcggccgaagcgggcgacggcgaggtggagcggcagccggagcgggcaacggcggggcggatccgaggggcgaagtgggtcgggcggcggctgatcctcgctgacacctcggtcagcatggcaggagagtggaggcggccgttccgcgatccgccggaaccagcctggcggcggtgacggcgccaccacgaagccgagagcggagggcgatgccaagggggaggacgatgccggagggaacgacgatgaggaggacatcgccggcgccgcgcggtccccctgacccgcgctggcccccgccgcacggaggatgggggcgtcggcggcggcggtgatggaggacggaggcaactggatcgagtgggcggaggaggacaaggagaaggtgtgggcgcgggagtcggcgcccgtcacagagatgcgccccaccggcgacgagcgaagccggcaggcgagaggagaaggaggtgggacggtgacggttgcaaggtcgacggtttggtcgccgttgacgaagacgacgggcagcatggccttgggccgcggtggcagtgggggggaggcacgtggacgcgcccgtgcaaaccttcgcctccgaggacgcaaggacgcaagcggccgtgactagcagcgccgacgcgggagcagggcggcggcggcgctcgggtctacacggcgctagctctagcggcggcggcatcgaggagggtgtcggcggcgcgcggggccccagggcgcaagcggaggatgccgtcgcccccgtctctgtcttctccgctggcacccccaactcgccaccggggcagcctcgccccctcgaactcgtcggcagtgtccgcatctgaccctaccccgtcctggtgggagacggcgaggtcccacatcctcgcgctctccaacatcctcccgccgccggccgattccgacgtcgcggcgctcgccgactccgactgcccggcgcacgcgcttcttcggtcacccgcgcgcctacgccgcgctgtccacggcgctccggtcggggggtagcaccgaccacgctcgccgcagccgccggagctcgcctgctccgccgcccacacacaccgtccgctgcccagaaggagagagagaggggaaagggaagagaagagagaatggagagggaaggaaagagaagtgaggctgacatgtggggcccacatgggccccaccattttaaaattattttttgtgtgcagctgacatgtggggccacgttttttattattttgctgggatataattgccacgtaagcgccacgtcaatgccacgtggggtgaagacctagtcaaaaaagccacataggcgccacatcagccaaaaccgccgaaggacctcgtttgcccggttttcgtaagttgagggatgtgtcgtacccggttttgcagtcaagggacgaaaatcggactggacgactgtggggacacccaatttaggcttgatgccccaaaaatccactcgtgatcgtccaggatttcaatcacgcacagattgatgtacagaacagctttcgattatttacacaggtttattcatacaagctaattatactactgttaaaaggtgaaaagatccaaactaaagaaaggatatttaaagatatttaaagaaaggatatttaaaggaaataaagaaaaggtaattaaataaagaaagaaaggatatataaagatatttaaagataatttaatttaaaaatggttttaaataaaataagaaattttaaaattaaagggatttaagataaatcaaataggtttaaattaaaagggtatttaaacaaaattttaaataggaaatttggtatcaaaagggagggtttgaaattagatgaacttagatcaaaggttcactggaattggatttgtggttggagagatatgggtgcctaaagtttggaatttgaaataactcaaataaaagaaaagggattactgtacagtggggcccgcttgtcatatgtctcttctacctcttcttcttctctgcttctttgatccgagaggagggagagaagagggcgagcggggcgccggctctccggtggccgggaggtgggaacgccggtaggagatggtgttcccgagcaacgcgcacccggagagggtggtggaaggcggaggaagagagagggatggccggaacggcggcaacaagagctcagttccggcgataagagaaggtggtggtggcggcttatcccaaggtggagggagaggggaaagggggaaaatggaatcatctgggcaaggcggagttggtggcgcaagggtttggcttgcgaagcttcggtgagggagatcggccgacggtagtgatggccggacatgggagtagagagagaaaaagggaaagctccgttgtggagagggagaggggcgacctcgttttctatttataggtcgcggaggtcggtttggagagaaggagagcgactaaggcatggcgacggcagcgaagagaagaggagcacggcgccgatttcttagcaactacggaaaagagtttgcggcggcgtgcgccgtgcgcaacacgtgcactgggaggaggagagaggcggctgggctgtgggccggctcggctgggcttcggctcagttgggtcggcagcccaagaaggagggaggaaaagaaaaggggaatgggccaaaagaaagggaaattggcccaaaataaataggaagttttgataattttgtatagaggattttgaatggaatttaaaggagatggaaactaaaggatagatggatgtggatttttttaatcttagtcaaagaattgaatctaaggaattttgaatggagggttaaataaattttaaaggagataaaatttaaaagagaaacgcttgagggtcttttgaactttataagaggaatataaagtttttttaaaagcaaaaatgagtttaaaatatttttaaaataaaatcaaatatatttattttgagatataaattttgaaaaggataaaaataaagatgctccaatttaaatagaattcaaataagaaccaaatgtaaaacttgtcacgaaagatttaaaaatcaaacggaaagaaaaggcaataatttaacttctaactttggataaatttgggatggtggcaaaaatagatggaggtaaaaactaagattttagcctccaaaatatgtggtatggattctcagtgaattatttgtggctaaaggaagttggactttgaatagaagggattgcaaataagtttcttagcacaagagcaatcattcaaatatttgtgataatattattcttgtgccaagaatgtgatcaagtcataggaatcaaattggtggatggatcaaaataggaacttgaccacagaatattttggatggattaaaaggagacaaaggttttcggagataggtttagataggggttgatccaaaataaattccaatggaaagggaattatactggtttaaccctaaagataaaaatggttaatggtatataatagagagttgggtcaatcggggaaatattggcccaagctaaatggtagactttgtaatcttgaatggataatttaaatgaacgagatttcaaagtggtaatatttgtgagagtatagaactggatttggaagtatatgtggatgggaatttttctaggaacggaattggtggtatattgataaactctaaatgatgggtatgttgactcaaaggggggattgaagaggatatttttagggactctaggaatatttaggtggagatccaaaggaaatgtatcaacatttcatgtattctggagatagttgagtggagatcaaaaagaaagtattgcttcaggggaaaataataattggtatttgtggatgttggagatgttcaggaatggaatcaaaggaactataatctagagccaaagttagagattaaagaaaataaatagagaggttttgtaaaatttaaaagagagcgattaactttgcaaataaagttttaaatccaagttaaaagaaattaacagaaggtaagatcacttcaatagaagaatcgagaagagtgcaactaaaatatttcgcaaaaaaaatttctctgaaaatttgagtccgttacaacgacaaatagagggacccatagtgaacttattcccaaatcaaacgcacctaccttgggctcaaaggccttaaaatgtgagacgatgattcatttggtttgttgccaaaagagttggtagcaaaacgtaacccaagtctatatgctcccaaaaatttggaaagaaagctaacaggcaaacgacgtcaaatagacaaagaaataagttcactttaggcccctctatttgtcgcccagtctaattttcgtcctgaaccacaaaactaggaacgacccatcccccaacttacgaaaactgggcaaacgaggtccctcggcggttttgataacgattttggctgacgtggcgcctacgtggctaatttggctcggtcttcatccgatgtggcactgatgtggcgcttacgtggcaattcgatccggaaaaataataaaacccgtgggacccacatgtcagtttcacacacaaaataataaaaaatggtgggccccacatgtcatcctcactcctccctcttctctctatcctctgctcgccgccgggggagcctacctcctcttcctgctcctcttcaagctcccctccatctccatctccgtctccactgcctcgccggcggtggccaccacgcaccgcccgcgccaccgcgagctcgaggccgcctcctccatgctcggctactactcctcctcctcgcctctccgcccgctcaagaccgccttcccttcctgccgtccccactcttcgtctcgtccatccgcttgcgccgctgcaactcgtcttccatcgatgcttccgccgcctccgccttcactgctgtgcacccgctcatgcaccacctcctctcctcctcctcctccccttccccgtcatcctcaccgtccccatctccatccacgtccgattcatgcccgtccacgatctcagtgcctacaccgcctacatgtactgccgatcctcgtgcgacttaatctccccgcgagcaagcgcggggtaggaggccccgacgaattgagctcgtgcaagaagatgacaaaaatcaagaacacgatgcaagtatacatgtttgggccacacgggtgcgtaaggccctacttctgtgttttgggagatgtgaaacgtattaagcgaccaactctagattagatgccctttttccctttctaatcttccaaccccttgctaagggggtgtttggatacattagtcctaggactaaagattagtctcaggactaaaacattagtcctttttagtcctagcctgtttggttgaagggactaaataggactaaaaccacattaattgagctgtctagtaggtattcataggtactttttaatgaacatgcattgcacaaaacatcccctcatgcagccacagatcaaccaagaccatcttgcggcatggcaaacagattcacagtagagattacaaagtacaagaagatttgttcacaatacagagttaaaattcaacacagttttaggccatcaagcacagtttgacagcaccaccatatgcagacatatagcatacacaatgaaaagtacagtacatgaaaatgcaaattcccgcatacatatcagttattacaagttatatgttccaaagtccataagatgaataaaacaggagactacatattttttaaactccacagtccattggcaaccgtgtcccgaaattgattcatcacttgactatccaaagagctggttggatcatttgattaaggactttgctcagacaatggaacatagctttcatcttggtcacacatgtcgaattcacagtcggctagtttactatctctaatgaaattatgcaatgctaggcaagcgcatattatcttactctgtttttgctgtggatagcttggtaagtggaacaaaatcctccatttatttttgggtgaatacccaacatgatccttgaactttcgcttaaggatcaatttagtccctgatatttcgtattgtccaaacaagtaccttaagttcattgtgtgattcaatatagtccttagaccctctaaacatgccatgtgtacatgccacatcatctctgcatgcaaatttaatatttaaatgtcctttacacccttatgttttcataggaaataaagaaaaactattgagaaaacacacaaaaaaaaagcttttgaccattggcaaaaatatgtagcattgatagataaaaaaattgacatttttctttgttttatgattgctttttcttgtttttcttttctttatttgatagaaaattgaaggttaaaatggacatttaaatgttatcttgcatgcacgaatgacgtggcatatccacgtggcgttttaagtgggtctaaggactatattaagccgtatgataatctttagggtcttgtttggacattataaaacatcaaggactaattcgagccctgagtaaaagttgaaggactaaactgcctattcaccctttatttttcaacactccaaaggacctctctatcacatttcgacacgaagaatggcagtagttaaagtattccttcctatgttggggcattatgccttcgttgtattcctgaaagtgataagttattcccttatatggtgcaagataacccggcctgtttgggtaccctgagtccacgagatagaacatttctaacaaagcctgtttggttgaatgcctcattttagctcttaggaagaatttttccttcaagttcttatatcccctagttgtccatcctccttggggacaatttccattccttatttcctcacaggctactacacacaacataaaagtattttcttctatccaacaagccttgtcataaggagttttatcctaaagaaaaatttattaatacatagattaccatattctgtcctaacaaagccagagaaaagtataatgcatctaaaatatacaagatcacagatccaagtctaaaatatacaaccattcatatagcatgtcaaacaggattgtatgtgtaacatttcaccagatcaatgcatgtaacaaaagctcatcaaagtaaatgaaaaaccaatgaatactctggtttggatgattaccgtgcgttgaccatcgttgtcgtcttcgtcatcgtcctcaacgtcgttgtcctcctcttcggcagctgcggttggggcagaggacgtcccagcatcccatcctcctccaccgaagcccccataccccgtagcaccgtgggacatagagctcccacggccgctgacacccgcactgtgggacatggagctcccatggcccacgacacccgcaccattggacatggagcccccacggccagggggaacgaatcccctcatccgattgccggcggcggcaccaatggtgccatcccttccgcggcctcgacctcggcttcttccacctcttctgccgcccctggaaccaggtactggacggcgcgacggggcgatgtcggatctggtggcttggaagagtggaggtattcctccaccatcttcttgcaagatctgctggtaggagccgaaatcggggaagtcttctgcttgggagtttagatccaggcccgccgatctcctccctagaaaatggtagcccgcaccagatccgccatagcctaaggaagcttggctgaatctgtactcggtggcgtcaacggaggcggcttcgtgatgtgcttgtgattgggagaaaaaaatcaaacatgtcgtcgtcatggccggccatggctgaagggctacgagcggcggcggcagagacggcagccgcgctcacggcggaggtggcggccgcgtgaggtcgcgcgcggcggcggcctcgggagctcgcggaggcggtggccgcgggagcttgcgcgtggcggaggtggcggccgcgctcacggcagaggcggcggccgcgtgagctcgcgcgcggcggccgtgggagctcgctcggcggcggccgagggagccttcgctcggcggcgtcggtggcggcacttgcgccggatggggggagtgagtagtacaggagagagatagcgaagtgtgtgagagagagaccgagtgaagtgggagtgacatgatagggttaatgcgctctgttataggtttttagaccgtataagctcctcccccagcgacttattggcctatgctgttttagtctcttttaagtccctcccgtttggtagtttagagactaaaaaatgacttatttgaagggacctatggattagtccctcaaaccaaacaccacctaagttgcataactcctcttatacttcgaaggggagcctgcgccattacattttgcatagggttatgtctatgtctagtcttgtcattgtccctcctgtcacattagtctgaatgtactcattgctactgaccgagcctacgcttgtgccccaggaagctgagcatggggcccaggacagctggaacgagcttctagcgtcacttatcgtgaagtcgggcctagtggacctagatgagggcgtaggggattgtccgcccttcataacaccatgcagccataccaagtgttgctcgctggtgcatggcgcgttgttctagccctattccttcgggtgacacaactagcttgatcacttcataccttgccacctccttcttgcatgtatctgagttgtaatctcgaattgtaattatttgggtaccgctttgctgtggtttaatgtcattgctcgctgggcccgctaccctgcatagccggctgggagatctccaccaagctcagggcagcgagcaccaccgatgtggtctccaagtcaaacccaagtgacatgtgcaattaggctcgccttttgacatggtaatattatcatggccggactcatgccctgagaatgcaagcagtctgcaatctcaaggcgcggttcgtgcttggcgttggatccgtgttcgggccctgcaggtaccctcgggtctgcacatgctcccatgctgcttgacgagatgtcgtgttatttctgataagcttctcgaaaacgtcgttgatgaaggatttcatgatagacatggcctcagagggagtgtcgatgttaagatgtggatcttgtaggtttccgcactcttcttgatatcttgaagatataaaccttgtgtggcgttaggcgccgggatcccagggcccaggatgaaccaagccttgggttcccaccttacgccacacatcacctaccaccttagtggttttctgataggtaatgaattatgtttgtgtgaagacgatcctgcaagcccaaggtgcaacaggcccttggaggaacaagaccctggttcccatttctctagctaccaacatttggtaattataaaaatttctactcgcagaactaccaatttaaggtgtcaaaattttggcattagcaacaaatgtgttttttttttcagtgaactcaacaagcctttcgatctaagcttcaaacttcaaagagaactacactgatgcatcacaggagatcgaagcaaagagacgatgaaatggtgcaagatcattgcattagaacttgcaaggcacatttggtatacatacatggttacatatcacccaccaagaaatatattgcactgtggtagatactttgaaaagaagatgcagaaaactgctcaactgggcaagaaaccagcaaaatgcaggagaaggttacaggggaaaacgcctctagtggagcagggaaggagatcaccgaagagcgcatgggatagcaccgtagcaaccaggccaatcttacaggatcacctcccagccacaagaccactgaacacttggctgttcccagctagcgtcgcttcccactcgatcgacgacagcagtatttgcgatagcgtgattactgcctgcttcatgtctggccgaagaacaggatcttcctccacgcactgtttcgctagcatggccatctttataagaagaatttagagtgagatttagctttgaagcaaaggtatgtgaaatgtgcaggagatgttgatcatcaagcaccaacagattttattgtgcataccttgtatacacagtcatgtggatacaggtccattagattagggtcaatgcagtctttcaggctccccatatacattgagttacgacaattctttagtgcactcaacatctgcattgttaaaactaaattagttcaaaacttttggagtcaaaatagcaagtaaaatatactaaaacttcaataaagccagtgaaaaacactgcaacttgggatggcaaaataattctaagcccgtaagttataatgggcatatatgttcaattgcttatgctgaacctagaaaacttacaactgatgccaaggaacgcctttctgagtttgatccttcgttcaatccatcagtccttgtaattgcctcctttccagatattaactcaaaaagtactactccaaaagcataaacatcatttttcgtagttgccaggccatcgcgcaagtatctacaggaataaatgaaatgtcaggattgagctagatatttttcttttccaaatccatactgagctaccagaaaatgtactcactcaggggccaagtaaccaaatgtacccacaacttttgtgacagaagcctctgcatcagttgacttcactaccagttttgcaagaccaaaatctgaaatctacggagacagaaaatgcaggtaaacaagctgttctaaatggtgccaggagaaaacaaatcagtaaacaaatttcaaatcaattaacctttgctctgaaggattcatcgagcaagatgttactcgatttgatgtccctgtgaacataatgatcctttgtatgctcatgaatgtattcaagtcctctagccgcatcaagagcaatttggaccctgtagatccaagacaatgatgtgtaacctgaaaaagaaacaacacaaaatcaatcaataacgatagaaaatgtatgtgtgttcagaaaagaaaagttaacaaaacttgagttagcagcaatcaagaaatgttctcaagcagcaatattttagaacttgtacataagggttgcttttgattggtacctactcaacaaatacaatatcaaaactgctggaagtggaaacattacatggcgagattacccaagttaaacagaaagcaattagtaaatcactcgtacaagtcctaaatgatggtatacctttgctttgaggatcatgaaggtgattcttgagtgaacctttttgagagtactcgtaaataaggtatagttcatccttgcttgctgcatagccaatcaactctacctttgacaaatcatgggtaacacaaatgaaattcaataaacaggatataagacataatctattagaaggatttacacaactgtaaaatggcataccagactggcatgatggaccttacaaagaactttcatctccactataaactctttagttttagttgctgtcattctctttatagcgacctcctatgaaaaaacatatttgttattggcaagggaaaatcacaacagttttgcatggatatggtcagctcagatcacatacctggtctcgaagaacaccataataaacagagccatatgtaccatgacccagaagatttgcatcagaaaatgaatcggttgatgcaagtatttcttgataggtaaacacaatgggcttctccctatcaaacacgtccactacaacacctgcatgagaggaaaattgagaacagcttgtatgtgagaggaacgaaagaaaattagaacaaatcaaagcagagcgttctaggctgctagaaatggcttgtcacactaagaaatcatgaagttgtttagttgtgaatttgtatcttgacgttttgttttctttgatattatttggacaatgtacttcagtatagaagttcagatcatcagatgtgtttggtgctacttgaactcatacaaaaatttgaacagatcgtattcctgcttaaatcattgcaggaaaagcaactaagcgatgctgacatgagtgtcatatgcaatgacaatataacattttgaaaaaacaaaacccctaagggatatgcatatgacaacatttcgatctttaatatgcctatataaggcactagattcatcaggccactcctatattaatatccacgcaaaatgaactcagcaaaacccattcaccactgcattgccgtgctgtgcagatgcagtggccaggaattattcccatcatatatatacaaaaaaaacatgttatgcagcacaatgatggttaaaaggagatgaactaaccttttggggtattcatatgatgatcactgccatccgttcttgattgtttcacatttccaaattggcaacataagtatcttccagaaccataacaaaaactaccactcttaagaagttgaaacttgtgtgatatagactggtctgggctctttccctggttatttggagcttggggattgtattgggagagcttgcacagaacaagtgcaaggagagcaatagcaatcaaagcaagtgcaactcccatgctgccaataacccatccataagggaattttgtggaatgatgttctgatacatctgccgatgtaattcagaaaaatacactgttagtttatcataaaaaggaacatctcaattgtaggctacccaacctaacaaaaccaaaatatttcaacattaatacttgaagaaaacaataggacaggatcctcagaatgaagtgccaacaatgtggtagcatgttatacaactattagcattaagtgttctcagaatatcatatagctgccaaaaaaaaaacctagaaaacaaagtgcatcaactctaacaggtacctccatacctgagaatgtattttgtgcgggtgctggcgcaggagtaggagaggaaggagatatcacgggatatggttgtccaggaactgcacatgacatagttttacaggaatgaagccaaaaaaaaaaaaaaaggtaaaagcaagaactatgcccaaaagaaaccttacaagctagaagagaggtatccaaaataacaaaataaaacatcataaaagaacaaagtggaataatatcattgtatttgtaccaaaaagggagtgctatacagatatgaatgataacattgaacaaggttaacccgcaaaaatgcaaaataagaaaataagatgaagcacctagctaaccaaaaaggccaatattgccaaatattaaacgtattgtggtccttgcctgtaacttagggtctcattctattaaatacatcaaacagatagtaccttatgtttggtgacaacacaatttggttaaattcttagtaaaacttagaagcatggcatgtgtttcgagtacaatcattcgatatcacaatgtgcctccttgtttgtgccaaatttgtctgtagcagcacatcatcagatgccaccaaccagtctaggaatgaagggattattttactccattcagtatagtctctacaggcaatcatatggacctcacaactccatggtggtaacaattttcagagatttgtttaggctgaactaaatggtaatgagcactttacgtgtttcagattgttattttactccattcagtatagtctctacaggcaatcatatggacctcacaactccatggtggtaacaattttcagagatttgtttaggctgaactaaatggtaatgagcactttacgtgtttcagattgttattttactccattcagtatagtctctacaggcaatcatatggacctcacaactccatggtggtaacaattttcagagatttgtttaggctgaactaaatggtaatgagcactttacgtgtttcagattgtgttcatgctattaagttgcatgcaccagccagttgcacctaaaagcctaagctgatagggaaaggcgggcaattcactttatacactccaacacatgctccttcctatctgaggtgatctcaagcaagaaatgaactgttaaatccagttcaatatagctgattactatgtaatgggcaagcatctctgttcctccctcattaaataacgctgcatctataaattattagaccaattaatttcaccatgttcatgaaataaatggtaaattctcggttcagccaaaaagaaaaatgcagtataccgtgtgtaaatagggaagtttgattgatcaaattgccggagtgaatgatcgctaaacatttgttcacctgagttgagtgggatgtagtacacctttcccgtggttataggatcagggccggccatgccattggcggcctcgatggcgtccatgctggccccgaaccgacttgatagcgattgcaccgtgtctccgtcgacgccgacgtagctgaggagatagttccaggggccggatgagcagccacagagcaggtggagagccaccacggcgccggggcgcggcggccgcagagccggtccgcccggcggcggcacggctagccccgcgtacgccgcggcagccacgtcggccgccgtggcgttcgccgtcgccccggcggcggcggaggggacagtgtaggtcgtattggcgaggtatgtgcgggaggcgaggcaggagcagttcttgcggacgaacgcgtacccggggctggcggccgcgtcggccgtgatgtcccccggcgcggcgtcgaacatggactccagcacggaggcgttcgcggcctcgccggccgccgggaacgcgacgaacgccgtgcagacgcgcgagagctcggagcaggggagcggcgccgaggcggtgacattgccgggggcggcgtcatcaccggcgacttcgccgggggaggcgagcgccaggaagatgaggaggatgagaagcccgggcgcgggcgggcggcggcggggaggcggcattgaggggggctagggttctgggctcgaggtggcgaggtggtggtggtggggcatggaggtggcagtggcgagcagcgagctggatgcttcgcgtggtcgggtcactggagcacactctgggggacggcgcttttagtaagacgacggggttaattagcaagcaaagcccgcaccgcacgcacggccatgggtactggactactagtagatcactgtctccttcattccttgtgtgttatgcccatattgcccttgcacgcatcaataatccgcccgtttttgcttccgtcggtctgggaggtggtaacggataatggtttacgacgcctcaacttgttgagtgctatctctgtttcaaaataaatttactttcaagtaaaatacatcagcggtccttaaaattatcgtgaggtttcacttaggtccacaaacttgtaaaacgcacattgagatctctaaacttggtttattgtatcatttcggtccaaagtctcgtttgaccgtagtcttgcctacgtgacacgccacgtggacgatgacgttgaattttttattttttttctcccttcttttcttttttttctcccttcttcattttttttctccggcggccgctgcaccgcgagctccacagcagcgcctccatctccttctccatcagcctccgctccgctcgccgcagctttgccacccgcttcctgtgacctcgtgtggcctcctctctagctccatgccagacaccccgctgtcgtcttcctcgtcacggcgacgatgcctaaccctccttccagctcgatgaactcaccgtcgtccgaccactcctcttcctgcagcggcttctcgacctcgatgatgacaacgacaacgacgacgtggtgcgaagctcgcgacgttcattgtgccggcggagatctacccagcgaggctgcgtgcgacgagccacgggatatcggcggcgtcggggaaggtgggcgcgatcatcgggtcgttcgggttcctgtacctggcgcagagccctgacccggccaaggcggcggcgcacggctacctgccaggcatcggcgtccgcaactcgctgttcacgctcgccggctgcagcttgctcggcttcctcctcaccttcctggtgcccgagcccaagggcaagtcgctcgaggagatgtcacgcgagaacgaggtcggccagccatgatccacccgttaattccaccagcatctgtatgcaagatccatgcatatgcacggttagtccactatgagatttttgttctcttttttctagaatccattggaagcatatgttttcttctctttttttttctttttggggtttagagcggtgacaattagaggcagtatgatgaaataatggccgccaattaattgttgacgacaatgtagtttagcatcaggtgggtcatataatggacgatcattagggttcatgctgattctgtttcggcacgagggatcctcgggttcgctccttttttctgttgatgatctcctccaaaaaaacaaaacagaacgcatctctctctataatcaaaaggattccagctcgatgaactcaccgtcatctgatcactcgtcttcctgcagcggcttctcgacatcgcctttgtctggcgaggaagccgcacggccgacgccatcggtgtccgcgaaataacccgaagcaagacgagtcgagatcgacaatgacaacgatgacgacgacctggcagccacctccatcatcgccgtcgccgccgctgcaatggtcggcgtcgcgtcaatagatggcaaaactccgagaacacaaccacgagacgacgtcgacgttattgcgtgcacaccacttgcgagacagagagcgcgcacgtgcggtggagaggtggaagaaggccctgacaggtgggcgccggccctcagcggcagatgggagaggagggaggcaaagtggaaaaaaatagagaagggagaaaaataaataaaaattacatgtcatcgttcacagggcgtgccacgtaggcaacatcacggtcaaacgaggctttggaccgggatgatacaataaaccaagtttagagatctcgatgtgtgttttacaagttcgtggacctaagtgaaacctcatgacaagtttaaagaccgctggtgtattttactctttactttttatattttacacgtatgaatacaaaactaaaagtactttatcaaatctcaatagaactatttctcatcttatcttcttctaatacaactgtttcctattttcacaaagcatgatacaatgattactttaaaaatttattttttaaaaaatggaagtaactataaataaatttaatatcagaccgaagaagtaaaaagcttaacataatgatgatcattgatcagggggagcgaaatgaatgagcttccaatgtaaattttctttccgcaaaattttattttgtaatggttcgttgtcgtcttattaaccttacgatatgcaccacaatgtgtttttaacagtgaaaagaaatatgtattcccttcgtttcaggttaattataagatattttaagtttggtcaaagtcaaactgctttaagtttgaccaaatttatagaaaaaagtaatattttcgacccatgataaatttttattataaaaatatatttaattattaatttaataaaactaatttaataatataaatattattatatttgtatataaatttagacaaacttaaagcagccttataatctaaaacggagggagtagttgtgatacagcaacattggcgtgtgttggtgttcaaaatcaaaaactaaggcttagggtagcatctctggataaattactactggaagtgtggttatattacaaaaactggatcattggatgatggatccaactatcacaacatcgaaaatccccccggttacatctatcaacaaatgttggtttctgacagttcccttcatatcgatcaatcgtccgattgcaccaaattaacaacagtgataaaatttggtaagaactaaagataggctagtaagctacgataatataataaacttaaaacttactaacaaattatggcatgtataatatcgtctttcatgataatcttctaatgcgaattaaacaggtatttgattaattagttaatcaatatatatcataacaaatataaaaaagtaaactcgggcactgtaaatatatccattcctaagatcaaagaaacttcggggagcgacgtgggaattgtaaatctaccctgcgcgtggatcaatccacgtacaaaacaatgggagcagggccaaacccaggaccgcacaattaacgagcctccgtttgtctttgatacactattttcactctttgaaaaaggttagcaatccaaaagctcccgatgatcaaagattccattagccggctagttagtgttccaaattaaagaagagggggtaacagggtagcaactgtaatgctgcctcctcctcattcggacacttttgacggtgagttatctatcccccacggcccacgtattatatgctgcatactgttcagtgatgttcaccgagagagagagagagagagagctactgctccatccactgtttggtttctcttgccatctctctgcgtactgctacgattacaggaggatgtactgcaacttatggtaccctgagcaatgaatccaccatgtacagaatgaaatcgtttcgcagttacaccggcactattgcactaaccattaattagcagcatagacgggctgagtaaagcagggtagtagtactactgcccgcaataaggcctggtttagttttcaaaaaaaaaaatttcaaaaagatcacatcgaatttttaacacatatatgaagcattaaatatagataaaaacaaaaactaattacacagtttatatggaaatcacgaaacgaatcttttgagtttaattagttcataattagtcataagtgttacagtaacctacgtgtgctaataacggtttacttatgcttaaaagattcgtctcgcggtttgtaagcaagttataaaattagttttttcgttcgtgttaaaaactctttctaacattatcaaacatcccatgtaataccaaaaattttcttttcaaataagacctcggtggtagctgggcgtcgttatggcctgggccgagcggcaacgaaggccgatgtagccaaaaggccccgcacgtgggggtggccgacagctggttgcccggtactactaccatggaactatggcagctaacgccacgcgaggagggagccccgagtgggcgaggaggtgggtgccgtggtggcgcaccgccacgccacgcgacgccactgccagcgtcggtacagacaggcgagaaaagaacgatttcctcgctgagttgtctgagcgttttcgtacgagcacatccactcagatctcccgggggtttattttaagcgcctcgcccgcagctcacaaagcctgccgccgtgcgtgcatgcgggctgcgcaccagcaccagctttgcgagaaatataagatggttttcttgattatacggcggggtttgcgtgtgctacgtgctgtccgaatatttccgtggatacggtggatgtatagtggttacagtattatcccgtactactactactgtgtcctactgtccttgtttagtactccgtaggaatttagggcaaagctcaacacagaaacagaaaagtaggtgaccgaattgacgcacgcggtgctgttgctgttgctgaacgttagtaaggccgagtttagttcaaaactttttttaaaaaacttttaacttttttatcacatcaaaacttttctacataaacttttaattttttcttcacatcgtttcaatttaaaccaaacttttaattttgacgtgaactaaacacaccctaataagcagtcccggattgaagtggaactaaattggcagtgacacctaggggggacaagaaaaatctcgcctcccatgtcgtgacagctgtgccaatgcttaattcatgcgtcggtaatgcaaaacagaagtactacatgaaattcaggggaaactatgataatactcgtaagcacctgctgttgtgatcgatcaaatcatcaactgatgattaggccgcttccacgcggacgggcacctcacgggtgatgtgcgattagtgcgaacgtccggtgccccgcgtatgccgcgcgcgctatccgtcgtacaggacgcgagagtagctgttacgtctcccggccggactgttccagtgtcctgtgtccacgcgcacggtaccgggcggggcggccggtataaacgccgaaaatacacgacagattccataaaacaaccccgcacatgagctctatttagaagagaacatggcctgcttcgatggacgcaataatggagatggcccagacgccagtgggtgagccccatcaccgtggagttcgagtgaaacactgaaacgtaaccaagccgatcgataagacgaggccatcgatcacagcttcacgtacacctttcacggccacgatctgcacgaaaagggaggagtccaaaacatccgaggtgggggctactgattgacgtggtggaccattttaagactttgcagaccgcaccacgtatatggcgtatatcctcaatattggaccttggtccaccactccagcctggggacaggcccgaaatctttttatcagctacagtaggtagctttcatacacaaaaagatgatactgtagatgatctcccgtttgcaattcagagtacagaccgaacctcggtttgcgatgataagtagcagtctagcagaaacagtgatccactgcttagctttacctggcctatgttagaccgtgatatcgtttggaatacattcttgcttgctgctagaagaaaggctacctacacaaggtcacacctaatggcaactggagggtgggagacacagaactacaaaagcaggggcattcatgagtggtgggggtacagccaggtagtgctgcactgcccgcgtaccactgtccagctcgctaagcgactcatgtcatgtgttaggtcaccaacacgaagcgctttctcctctccttgtctcctctcctgtgttgctaccagccctatgccaatatcggaacaccaacgaatgcgtgcttgaaaattgctaatggaaattgccaaatttcatgtgctctcagtcgcctttaacctctagaatggggtagacaagaagataggagagccaggggtggtggcagccagggcttgtcggcgacgaccgacgaccgcgagctccttgacaaccccttccatcttccgcaccgtgaaggacacccgaattccagcaacggatgtacggattatggggtttttagggtgggggttagaggaaggggaagatgatgttttttccgagcttgaaaggatggctagggagatctgcaggggaaaaggatgggcgacaggatggtggtggccgtggcatcgctatagctgaggctcgaggacacgggcatgcattagatcaggagtggttagaggacggagtttaaatagtttaccttctatacctccttaattgatgagatggaagaaaaactttctcgccacactgcgtactataattcttctcttgtgtgatgtatactccctccggactgataacacttatcattttagacaagggtgaggtcaaactttagaatctttaattatgaatcatttttaaaatatttgtctttcaaatatggtgactacatgtatagcttagtcaaagtactttaataaaatcatatatttgttagagaatttttatagtccagtaataggtaccgcccagtactgatatctgtaggtacctaaaaagatcggaccgttcaattcggaagcgtacgatcgggagaaaatgtaggtgcgctcgcttgccatctagtcgcagcccacacgcgtgtgtgccgtaatcctttccccttccatgccctccagcggcaactcctcagccgccacgtcctcctccttcactgccaccgccgcgtccccttcctcctccgccggcgcctactcccccgttgttgcctcctcctcctctggcactgccgccggcggcttgaaaaggatgagagaaaaatagggaaaaaaaatcaaggccacgagtctccgtcgccatggaggaggagagcacaagctccctgtctactcgcaacggtgaggaaaaaaaggagcaaaaacgaggagtcgaacaaatcactctcatgaatgaatcaatagtttactcttttaccagtttatcagtgagtgaccttggtccttaccagaagcatattagtcggagtcacccaccggaccggcaacacaaccactccggccttggtaccaccactgtgtgttgccgtcgagggtttcctccagccactgaacagctcgcttggtagctagcttcctcgttcagctccacgcccttccatgtgtgctctacttcacgctagttgccgcatctagggatccacacgcactgccgctggccgtctcacatgccgccgccgtcaccggccgcctaatccgaacaaagaggttcaccggctccgatcgtttcaacctcatatccaacgcaaaaatacagttttacccttccacctctatctcctttggccggtaccacctacaaactgaatggtacctggaggtactgattgctgttagccgttcgatccatgcccctcaatggttcagatttggtaccgacccaggctgaagaactgtaaaaataatctagttgttaacatttttatacatattataataaaaaataatggtcaaagttattttttagaaaccgtacccttgtccaaaacgataagtattatcaatccgggggagtaccatatataccactaatgagtaaatatttttttctttgattccaagatttacatgtagatctcataatatataactagtgggcttgcattttttttaagtaatgaatgggaatacaatggacatgcgttgaacttggtcttctaaaaaggacagatatatggaacttggtgatataaggtatatttgacaaggctgtaactttagcttcattcctcttgaagctagagcccaaccaaaaagttttaattccatctaaagaaatagtagagaaggttacagtgatctgaaaaaataaactagagaggtgcatcgggattcaaactccattcttgaaattattgtttggaaattggagccatgtcaaacatggccagactagtttgtagatattagtggatacttagagcctcttttggggagcttctaacatatgcagcttctcctagaatctctaattgccagaacctcctttaaacagtctagattttcagatagattataagaatgtgtagttgtagaatctaaaaaataaacaagaaaatacaagttgggaaacccaacttttccaaattctcactagctagcttctcaccaaccgcttctcagaatcttggagcaccttcaaacaaggccttaggctagcggctaggcgttggctgctctatggggcctagagcctaggttagtcgcccactggccaaacagatgaagtagagttatctcccatggtccagattggcacggacatcccaagagcaacaaatgttactcgcttgccaagttatcggacagaaaatgaataagtccactttgactccctcatatatagctccaatctaatttacgtccctgaaccacaatatcggatattttgactccccaactattaaaccagtgtaatttgatttcctcagcggttttggagggcggtttcgctgatgtggcgctttgatctgatctatcccgctgagtcaccaagtggagccacatgtcattctctcactcctttccttcttcatcccgtagacactttggtctatggagaagccgaatagggaagaggaagaggaagaaggtaaggaatgagataatgacatgtgggccccatatgatgactcagtgttatagacctagtcaaaagcgcaatgtcagcgaaacaaccctccaaaaccgctgagagagaatcagattacattgattttaatagttgggggttaatatatccggtattgcggtttaggagtaatatgaattaaattggaactatattgagggagtctaagtgcacttattccgacagaaagacataacactggaaatggcccaagcttcggcttgacaccattttgggcctaaactacttactgcttatcaggccttacgccagcagagagctcggcccattttatgccctagtgaagtctacgcgtgcctaccgactaccgagtaccactgacttgtccggttgtcccgtaatgcaggagcggcggcggcgtgccagcgccatcgtatcaagaaacaaagaagggagttactccctccgaatttgaattttaatgtataacgttgttaacttttcgaccaacgtttgaccattcgttttatttaaaatttttgtgcaaatataaagatatttatgtcatgcttaagaaaatttgatgacgaaccaagtcataataaaaaataatatttacatatttttttaataagacgaatggtcaaatattagataaaaagttaacggcgtcatatattaaaatatggaggtagtacaagacaaaatgagataaaatatggtttcagcggttacatgcactaagaagttgataaaggatatctatcgcgcgcctagcggtttcatccggctgataatgtcgcttatgcctgatcagctctaagttcgtcacttcgtgggctcgtggcgctcctgcctaccgcgagaccacgccgagcagcaagggcaatgacccagcaacggcgcaccgcgtatgactatcaacgcgcggggagaaattaagcagcagcaccctgaaacacggagtgttcggctcgtcgcgtcggcgtcgaaagaggcaagtgatgcacgcatggtgcagatcgatcacggcggaaggggctggcgacaacggctcgcgtcccgtccaaggtgaggaggacagtattcacggaggcgagctctaaccgcacgaacggagccccgatcgaccaggcgcaggcgcggccggaggataaacccgtgctcgacgtcgccgaagcccgaagttacaagcgacacccccggctagccatgctcggcgccacggcgccgtggttcatcgcccgcaaggtcctctcacgatcaaccagaggccagagccggctgcagctctccatcgtcgtcaagggcaaggacatggccccgcgcctgctcatcaccaagaccggccttgacggaagccgagaaggccctcgtcaacgtacaagcgcggccgggagcccgggagtactcgctgaggttcaggtactcagcggcaacgccaccagctaccagctcatccgaagctgggtgaagttcctgagagagaatgaattactcatcggcgccacgcggctataagtttgaagcgccgtgtgtggaccgtggggatgacctggagcagtgggcattacgctcgcgcgaactgccagcctgccacatgccacgggccccgaggatgccggccacccggatggcgcgctagggtttctcgtgttgcacggcgacgacgacatggaggagacggctgccgtgatcaaagaaagaagaggtgcctgcggctgaccatacgtccatacacgtgcagagaagggtgaggagaagtcgagtttgatcgcaaaacttgctgcatttgtgatggtgtacgtactcttgaggacaagcactcgatcaagggaaacgaaacacaaaactgatgacgatagacgaaggccatagaatcttgcatgtatgcagcagatgcacgaggaaattaattgttgtcagtgctcttaagagtagtatgttacctccgtgtcccgtttcttatacacgcaagtttaatatatagattattgtgtaatctatcactttaattattaacacataccccctccgtgtcttaatatgagggattttgacatgttacttgcactggttgaccatttatcttattaaaaaataaaattattatttattttatttgtgatttactttattatccaaagtactttaagcataactgttcgttttttatatttgtataaattttttgaataagacaagtggtcaaacagtgcaagcaaaatgtcaaaacggaggaagtacaaggtgaaaacctacccatgaaaaaaaaatcattatggtgcggtgttgttgttagtcggatattctttttagttgctccatgttagagctcgtgaatgatagtggcactacaattcatctagttaaatatttttagtgttttttttatagatatatatgcaagaaaaaaaaggtgtgcccttaaatggcttaaaatatagtcccacgctatatgttacaggcattccccctgtgtaaagggtgtgttctttacaacatcttcctaacttttactttctcttctttcgtgcgcacgttctctgaactaattaaatggagacgttttttttagcaaaagtttgctatgagaattactttataatccatttctccgctttacgtgcccaggagaaaacgtttctataccctcccctaaagaatacacccatccgagctgggaaaataccttgactttggaagggtgccaatacattctcttcaaaccttgcttttgagaaagcaaattggatgtttttgtagctatatcttttactacatactcctaccccagtctacaaatatgattttttttaaatttttaatgttaaaaataaacctttctgaaacttatttcaagatctgaaccttttgaccacgggctgacatggtaggataaaactgtcacgtacgcccgtagcgggtggcgtgacagtgttattttgccacaccaaaatatttagattttgagaataagttttagaaggttttatatttaaataaaaattacaaaataataaaaattccacaaatataaggcgtgtaggtgcatatcttcgagttcgatagactgaggtagtatgcgctagttatagatggccatatggcctgtggcccgcggctcggcccaaagaacgcgtgtttggcccggcccaagcacggcgcggcccgactggagtcgtgctcgtgccggcccggcccgacagcgggcctctgtcgggccgtgcttgggccgcgccatcggcacgctgggccaacacggcacggtggaccggcatggcctggcacgctataacggcaggcacggcccgaccgaggcacgcacaccgcagcccagcccgctggcccatcgcctccctcgcatatataagccgcccccgccgctccgctcctccgcctcctccgctcctcaaaccctaaccctagccgcctctctctcgaccgctcgtctctctcgactgcttcgtcgctccaccgcctccacgcctccactccacggctccacttcctccacgcggaccagcggaccacgcctccatcgcttcgctcttcgccggatctagcaccgacggtcgccggcctaccgctggggacatgaggggctgagggccgttcttctctctctttttctttcatctccacctctccgatggccacgctatcgatttcctctttttttttgccaccctcgtcgttgctccgtgagcacttcgtcagatccacccccatttccagtctctgttctcgtcttcttgtagatctgtcgatctctgtcatcaacggcaactccggtgcttcggatgcgtaggtaggtagagtaaaaaaagtccatgtttttctttagttttttttccatgcgacccctaaaccctaattattctctgtgtattgtaggtcgctgagcggtgagcgccagtggtagccaccgttgaggaacagtagtgtcgtcgatggatgatccatccttctgcaacttcgagttgaggctattgggaatgcggggtgatgacgaagatgacttggaggaggaacgcgtggaggtgttcggcaacactgcctcgcctcggatcgatgggtcgcagccggagacgaagacggagccggacgatgacggtaccggtgctggtggcaacggcgcgccgtccggctcaagtgctagcaacaaacggtccagatctcaggtatggaacgactttgaagagctctatgaatcctgaaatggcagtcaggtttgtgtccatgctaaatgcaattactgccataaaatcttgtctgctttttcatctggtggtactggacatttgattaggcatattaagtcatgcaaacctataaatgctggtgctctgtctcagtctatgctccggtttaatgctgatggttctgttagtcaatgggaatataagacagatgttgctagaactgagttggttaagttgattgctagagaggatcttccactttgttttggtgaatctgctgcttttgaggagtatattcaaaaagctcataaccctagattttgttctgtctctagacaaactactagtagggatgtctttaaggtttttgacagtcagcgtgctatgcttattgagactttaaaatctattagctctgttgctttgacttctaatatttggtctggtaatgctaaggaggattatttaagtgttgttgctcactttgttaattctaattggcaattagggaagaggattttgggtcttgtgctgattgatgtgtcacacactgctgaaaatatttcggaacatattctttctgttgttcaagagtatggtttgactgataagattttctctgttactctggacaatgccgctgctaatactaaagcaatggatcatctaaaacatgctatctctggttatgttggtgatttatatttgcatcagcgttgtgcatgtcatatcatcaatttaattgttaaggctggtcttgagatcttcaaaaacatgctggctgattttagatctgctatttcttttgtgaatgcatctaatcagcgcattgctttatacaaaagcttctgcattgctaagggtgttcgccctcgtaaatttggtttggacatggatgttagatggaatgcaacttatttgatgcttaaaaatctcttgccacataagggtatcttttcagtgtttattgcaactaaccatccacctgttaatggtcatgcattgttgactgatttacactggacaattgctgagactgttctgttattccttgaacaattttatgattcaactattattatgtctggtgtttattatccaacatctccattaattatgcatcacattcttgagattgctggacatctaaatacatatgagaatgataggaaccttagaaatgttgttattcctatgaaatcaaagttcttattatactggtctgagattccatttctgtattcatttgcttttatcttggatcctagggctaagatcaggggttttagcaatgttctccaaattatgactggtaattattctgagtatttaactgaggttagggctgcattgtctgatatttataagaagtatgaagctaagtttggtgatgtaagattgcaaagggcaaccccaagcagttcttgtggtaagaaaaagacagcttgggggaaaatttttggatcatccgctagtggttccagtgttggtgctggacctggtgtaggtgatggatttgctagtgccagtccaggtgctggacttagtgctagtgctagtccaattcctggatttggtgctagtgccagtccaggtgctgggcttggtgctggtctatttagcaggagaacttctgctactgctttgattcaagctgtttattctactgctaacatgaatgcatctgagttgtttgcctattttgacagtgacacagtcaaccaattcgatgacgacttcaatatccttaactggtggcatgagcacaaacacacctatcctattctttccctcttagatagagatgttttgaatgttcctgtttctactatatcgttggaatatgcttttagcttaactggcaggatcatcgaggatcgacggcggtgtctaggtcctgccatggtgcaagctctggcattgatcaaagattgggagcaagcagaatcaaagaagcagcattcagcggagaataaagagcttattaagtcttttgaatacttgtatcttgatgatgaaaccactggggatggggatgggactgggactggagatggggctagggctgggactgggacttgatgctatttgtattggacttggactttattatgaacatttgatgaaagatgtggattgcactcttttttcctttctagggttttctcacgaggtgtgagtttttacctagaaaggattttaatgaggcaaccattgcactacacagctactttatatttgcaaataattgccttgtgtctgtgatttgtctgaatcagtgaatgaatgagtgactgtatgactaaatgctttcaaatattgtgaatagtgcatctgtgatatgtgcatgtaattttttggacatgtgacttgtaattttttgaaacttggtgaatgaattgttgttaaagtttgttgattcaatctgtgaaatgagtacttctgagttctgattcaaaatgttggtgcaaagatctgctgaatgagatgtcacaggcttatcgtgcctgggctggcacgagcccaatgggctggtcgtgcctttgggccaacatggcacgacccgagtgtttgtgggccgtacctgggcctgaggtgcagcccgtgggagggcacagcacggcacgaagtgccagtcttgccgtgccggcccgattgacctcggcctaggcacggccgtgcttgggccgggccgggccgggcggtccatttggccatctatagcgctagtggtatggaattttgttatatgatcatgtcagccaaacttgtacagtccacaacctagatgtgtcctatagaacaaaatttgcagttggacataattagagctagtgtgtctttgtgcttctctagattataacttttgactttatatcagtaagactaaccaaacaaagaaaaataatcgtgggagatgttgaatattggtataagaaattgcctaacacgtacgtaagacaaaatcaatcacttgatggatgatggataaatgccaaatggttgtttaattatgagtatattagttggtgctcctattgttacacacatttgatcctgaatcgcccaccgtttgaaaggtggagttaaaaaataagtgtatctgagattggcaggttgcccaaattaaaatcgcagaggaccacatttggaccagcagtagttacaacacatgaggtgatgagtcgcaatcaggtaagctctcaatcaagtttttgctgagtttctgaccaactcgctgcatcaggatttgttcagcgacgtcaatcttccgctcccttcactgtccacagttccacatatgcccactgcagggatcttaagtgcactactcttgtagatctacagcgttcgtgtcgcgttgtttccagctaggagacgagccatccgatcggaatggccgtgcttaattcgggcgttcaatcatcaggaagcctgtcggagacgcagctaactttcccacagctagctcggtagctctgcttcctgcacgaacgcagcggtcgcaggcaaagcaccggaagacacagagagagacagggacgactccctccacaaaaccaaccgcgagtgcgtccaaaacacgcacgacgacgacgacgacggcgaacagtgtggagagaggcaatcaaacgtgcgcgcgccgtcccagtaaaggctgtgcctgcccgcgccccctggaccctgcgccgcgcgcggcagctgaggcgaccagggcgtcaccggcggcatcagggcgcgtgcatgcatggcgcggcatggcatgcatgctgcgttcgcgcgtgagacggcgtgcgcgatcagatcagggggagcgccagagcccgcgcacagtgcaggcgggtcgtcgcagccgcgcagcgcgaggaggccgatgcgcgcgggggccggatcgagggcgacgggggccggcgtacgtcgtcggcacccgcggctcacgagcccccgtttttctttctttctttttttgtttttttttgtcccgtgcccatcaatcaggcccctggccggctagctactagcctgtgcccctgtgcacacggccgcgccagccacaaccctgcctctgacgcgctatagctccatcgtctcatcacccgcgcgcagctgcgtacggtgtatgtaggagtacgtgcaaccgctggcccgtcatgcgcgtacgtacgtggaccatgcatgcaacgcagtcacgcagcgcgctcgcgtttggtgcgcatgattgaatgcgggaaaatgtttgcttcctctactgatgtttcaccactctgccgcgcgcgatccgatccgatgcgatcgcgcgtacctatacacgggtagctggagtagcatgcatgcacgggccggtgatgagtgatgatgcaaacgacaacggccgccctgtgacgtgccatggcgcatgccgggatacgtgccagttgtgtccgtgcgtggtcaccgatcgccgcgctgcaatgataaaccaggccatgaatccctacgacatgccaggacggcaggtccattttgaggaagcagcgaagcacagtgtatatggcactactgggcactgtgtgcgtatactgactgctactgttagatgctttttacacagatataaatcagatttctctcggcattcgggtagagcagctagctgtgtccatggagggcactaccgtttcagttcacatgattgaaactctcagttcctagctaggacagtccgaataaatttcactaaactttacaatacatattcatatagtgtagtgcccctgttttctttgagctttgctcctctacatgcaccgcgccggccatacctctttctctagtgaatggcaatacatatatattcatatggtgaaggcaagggtgatatggtgatctcgtcgagaagctcttacaataggtcgccggccatacctctttctctagcgattggcggagccgcggaggtaggaagctagtatgactagagtcataaggggtcaatataacaagagcgaatagagagaacaaacctccgtcaaatgcatgcttcatgtcaaagataaaagatagtgacagcggtgtgtaaggccgtaaggaataaaaacggtgcttaatggcatacaaagtatcgagcatttcgatcttcggggcatgaaaggaagtactacctccatttttagatggggcaattacaaatttaccactgctttgaatagttattgcaaaattgccactagaaaattacaaaaataccactataactatcattcgagtggcatccttgtaaaattgaaaaaccggtggcaaatttgcaaatgcccctttttaatatacaactccattgatcttttttatacattacgtttgataattcaacttatagaaaaaataagtatcatctattccctccatcctaaaatgtaacaacctaattaatacacacatcataatactagaaaatgtgtctaactagtactagggacttgtttagattcaaacttttttcttcaaacttccaacttttccgtcacatcaaatgtttggacacatgcatggagcattaaatgtggacgaaaaaaaccaattgcacagtttgcatgtaaatcgcgagatgaatcttttgagcctaattacaccatgatttgacaatatggtgatacagtaaatatttgctaataacggattaattaggcttaataaattcgtctcgcaatttacagacggaatatgtaatttgttttattattagtctacgtttaatacttcaaatgtgtgttcgtatacttcaaaaaacttttgccacacgaactaaacacagcctaggttactatattttggggcagatagagtattttgttgtgacttattttatcactaaaagaaagcatgacttgaattttttttacatctgcactaatttttttaataaacgccatgtccaaaagcctacatcgtcatataatttaaagcgagtagtagtaccgattagtgaatgtttagtggacatgtaagaaaattacccttttatccttttacatttttaacaatacatactataccaaataagaaatgtggctacaactctattgttacaataaaaaaaccagctaacacaagataaagaggtatttcccttttcttttggtttcggtcaatttggtgctagagttttctgttagtacattgttatgatttctaaagacgcagaatgcagaaacttgttgaggagaggcagctggagtatatagatcaagtactaagatttgagtaattggaggaggtatatcccggggttggtagccgctcttgtcgtaatgatccggacgcgtgtggctgatttcgacaaaatgggctttaaaaacttaggagacggaaagtgactaggctgtaatgattagagcacaagcagcacctattatactaatgatggatgagaggtagtagcactgattgagttttagatatcaattagaggaagctaatcatctgtggtaaaattggccagctttgagaaaaggatgtgctatttactctttatagttccaatctgaaaggagggaggggtacgcttttgtccatactgtttagattatgggcaataaaagtacatgctgcagcagcactgcacgcatgcagaccctaccagccgcatgacatgcaacggacggcagagggcgcccaggaacagcgaaagctaacaaatttgggatttttcagagggaagagccatactaaaagccactactactcatccttattagtcagaatccgtgctgtttgttcagtcatgttattttagaagttcagtaacatgttggatgcattattggtgcatcagtgagggactttatgcaattatttcaaaactcggcccggtcatatatacacacagacaatgtttggctaatgggaaatggcaatgattttccacccaccaaaatgcatctttaaatactaaccattcattctccctctttcatttaatcctaaccctttattcatttcccaattccaatctcaccctctatttcccattatccaaacacactcataagagtttgactgatctcaatatatagctgtatatccacgagtccaagaaaaaaaacaagtattctttttttcttttaacagatcgagtcagctagcccaaagttcttgaaaagtcagatgccggggtcaaaatgcctggagcagcatgcgcgcatccttactcaacttgcacgactgatgggccctcaactgtttaaagattcgatatgtcaacgagttgaaacagtaaatgttatcgccttcctttctttaagcctctctttctgcacttagctaaggggggccaatgtaccggccgaaagccagcacaatccggatatcaaacaagcacgagttttgtcaacaaagatgatctaatggtccaagcccaatcaattgtctctgacaagcatgaatagtaagcaggtggagctccactccaatccaatccaagggttcagcgaagatcaggagttcagacggggtaatgtcctcatcaacagtggtcccctgtggtcggggcgtggaaggaggtggaaccattccttacgccacaaccaacagcagcgccaatggccacacggatggagtatgtgcgtaagccagccaggaagacaacccatcaaatcactcatcgcgcccccacttgcccggataagcgtgccgctgttcctgtcctgggcgcacgccttgctcgcgcggcgcggccacaccctctcccatatcatatcgcccccaccccaatccgccaaacggcacacgcacacacgcgcaagaggacacacgggcgaaaaaacgcgcacgctttcgtgatcgagccgccctctcttctataaatggattctctactgtaattcacatgctaatcttccagccacacacctagtcagtcatcaaagtgtgcgtgcttctccagaacagtgagagagagaggggcaaagggaggcaggataaaaagccgagctgtaggggactaaagaagaaagaaaagcatagaaaagaacggcaagcaagcagctcgaggcacccgcgctagtacataaagccaccgaggtgcgatttcgcgagctctagccgcttccacttggccatttcccatctgcctcctggagctttagctctaactctagttctagctctagctccggctacgtttgcaactgttgtttatctcctggtgagtcctcctgtcatgttagccgtagattttggccggagcacaaggtgtttttgttgcttgctgattttacaggttgcaggttgttcttctctttcctgaaatggttttgacaaaagagctgttttgatctggggctgcctcaatcatttgcttctatggcaggctatacaccacacttttaagatgttttagcctcattggtattgtttatgtttcattatgagttattacgaaagactttaattaaaacaaacgtctagggtgctgcttgttgcacaaatgagttattcgttccgctttcaatttttcattgccagaacctgatcttaactccgtgtttttccgcgttctctttcgttctcgcttagacctcagcttacgcttcgggctggtttggtgcttttctccagcctaagttgagtgtagaactaaactttttaaggagttggttgaactcctctcattgccttcaaactcttcctactattctaggtggatagcatttagactcttgaagactttgagctagttaaccttatggaagaagggtccaacaaaagagaaggacttcctcctcaactcctagatctcatcccagatgagaaggaatggaagctgagagaagcattaggtctagggagatcaagaaacgcaggcttcgacggtgaagaagacaagaagctagacctaaagcttggtcttcctggttttatagaagatgatgaggcagaaaccttaagagattacaggctacagcaagagagcccatctctctcccttagtttctttccaaagcactccaagaccaccagcagcactactacgacaactggagcaaagaggggattcatagacacagttgaggacaaaacagaaggtaacaaacagcttttcagttctctcgtgagcttgttcttgaaacatgtttatacttgggattagaaacatggaaacaaactgatggaagcactgaactgaaaattactcttttgttgctttataaggttataacgaccagaagcagcaggcaagggcaggatgtgggaaggaacttgcagtggaggaaatgatagcagccgtgagtgagaggaagaaaggatgctgccccccaccaccaccaccacatggtgctcctgctacacctgcgcgcaacagaccacagacccagggaaggtactgatagcctatatggtgctttttccatcttttctgctctcagccaaggaacacatgctcgtttattcctgtcactcatttatagttcattcgaaggattgcatatagtccctccatgctcttttccaggttcccagaaatcgcaggtgtcctatgtccatttcaatcttttgattttaacgtgacgtgcaatggctaatttacttagctgttcttggtcgatatgaacctcaaagaatatactacttcttttatccctcaaaaagcacccctttttttatagaaagagagttgtcctttttctaaacactaaacttaattcctacgctcatagtcttgtctatttatcacttattcaactaagggcattcccgacccaatgactaggatggtgtccatagcattaaataagctgccacctaggataaaaaatgatgtggcaaatgaattaatgaggaaagagaaggaaaccatgtcttgcatgagacatgatttctacataacatccaagatattatgtgagataagtagcattaaatttaagtatggaatagtagtgtttgcattggaagagtagtgtctagtactagtttcttgatgatgtagagtttatggaaactatatctagtgtcttgggttgagaatgccctaagtctccttgggcacatatattcttggattataatcactctaacagtttaattggttggaacaatagcagtacaaatagaaaaatatatatactagtacaaccaattaaattattttaactattttattttattaatattatgcaatcatttatctcgatggcctttcagagacgaactcaccagttttctaacctgtttgtagaggagctgcagcaccagtggttggttggcctccaattcgatccttcaggagaaaccttgctagtagtagttcatccaaacattcccctgaaccacaaaatgataatgccaatgcaaaggtgacgctcacctgcaagaaaaaccctcttgtaaaaatcaacatggatgggatccctattggaaggaaaatagaccttgcagcctataacagctatgatgggctatcgtcagctgtcaaacaactcttccatgggtttcttcaaggtagaaattaacaatctatccaaataaaataagtacttcattttttataaaattcttagcttttatctgatcatattgcagctcaaaaggaccaaactaatgcgcaaattgcacagcaaggtgcagatgacaaaatattttatcaattgttggatgggtctggtgaatatactctagtttatgaagacagtgaaggagacaggatgctggttggggacgtgccatggaagtaagtttgctggtcccccttgtcatttacagtttttactggcatttacaaaataatcaaatcttaaaaacaacaaaaggacactgccaccataatttatattaggcaccaccaaaccatctaaattatttttcctgttctccaattcctgcagagtatttgtctcaactgctaaaaggctgagggttctaaggagttcagagctttcccataccctggtaagacaagctagaccacttaaagtcgtgtccaaatctttggtgtagccataaaaaaattagctttcgctaaatttgaatgaagatagctacacttttatgttagtctcatattctttactatttttttcctattctccagattggagctactgctagggtctagccgtctaggagagtcaccaattgctgaaatgctgggatcttattaaccattcggaatgaatgtgtgcactcaagccagtccattctccattttaggactacccctattttgcctatatagatgatctactgagatgagttggcatacagcaaatgcaaggaaatggcaatctgttttgtaaattaggttaccttgctatgacatgttgcttaattcaattcgaagcgattttggttttatcggggagagccgcatatgtagacttgcaggtcacccatgtaaagtgccttgttctgcgtgataaatttgtattaatcgctgctgcaacccgacatgcagatctaatgtcaccagcgtgtctcagaggacagcaactaggctaacctgatagcatcaagtcatcactccacgtggaatatgctactagtaggaatttttttttttgaaaaaaaaacagaattatccactgggtgagttgttatccttctaatcccatcactttccaaaatttgtcacaagcacagcgagaaaggtttgacccgactatgaaactgccgaaagcaaatatgtgctaatgccttcgcgcttattgggtgtcaaatagctatcatgtgatacaacagtggcatgattgtgaccacacacaagaggggtagatgttcatacttcgttttgctgtgaaagctaagaaataaactggttgtactatttttagtttttaacatgaatgcattatgtaggtccattaatgattaaaaccatctgatagcactagctgccaaacctggatgttatctccaagctgccctggtgaccatattcacattggcttttttgaataagccaatatcaacagctggtggcactgtttttattttctccccaagataaatacagtgcattagtttcaacttgacggttaacactgcaagcatgcctaatgcgtataactcttgcaaatatgtaacacaataggaatattagatgtataactcttgcaaatatgtaacccaataggaatataagatgttagaatagacactggtaatatttttggagggtaattgttatgaggcgtacctgaaataggactgcagaagaatcttataagttacatataatcttgtagcgccttcagtgcccaaagttttgacaggaaaatcaccacacagccatttccagcagttcatgccatctgtacagataaaaaccttatgtatttcaagatcaatgaagcaaacgggcacgaataaaaccagagagagagagacagagagagagagagagagagagagagagcttttctggtaaaggagaatattcaccttgatgcttccgagccttgaaactggggacaaaggaaaggtctttgtcattggaccatccctaaattccggacagcaggaaaagtagaagagacggggtggattacgaaagaatcttaggctcttttgtaatgtccttaccaaacatctttatccccacagtattgtgtgctcatgtgctggcacttgcagtgtgcgactgtataatttacctgtgtggcctaaaaactatactccttttgcaagaacagttctttggtgacagtgaaagccaaaaagaaatgcagacaatccaatgacagaactaaccttatttccagcacccaatcatgtggatttgctggcacaacaagttgaatactagatagattaagacgctaacaccattcaaagatgttctatggaaatacaatagagaaatgtaaaggagtgcatttatttgacacaaagcaatttggcatgatgtgatcaaaatctaatgaacaatgccatgtatctcgtacagtgtgctctaattcatgatgctacagttacactggaaaatgttaacctgacatcgacagtcgccttcagatttcagccccaaaagggagtatgcataaaaaaggataatatttttgctcacctatgaggctatagctagatgacctactatggataaaagtggtactcatcccatgttccacttcttagatgtttggttattaacctcgtaaacatagaccttgcattagtttttagagaacacccaggagagtggcacatgtttgttattaagcagatagctctgcaagacttttaggcttattaactcatgttatcatgtaggatgtgtaagtgcgttcatgggttggtccaacccaacccatttgctgatttgcatccctatgcccaaacataccaacacatctcttatgtccacatgaacagaatcaaatatcaataagagattagcagaagatcacacaagaattatgtacaatattatgatatcaagaggaagaaaataaccgcaccagcaaaacgcatacgtgtaggcttgatggataaaataaattcaccttagggttttatttctggaactgcatataccaactaataaaaaacaaataaatcactatatgccacatttaggaagagacgtgagccaattgcttacgttgcattagagaacaggcacaaagaatacctttacagcacaatcagcaatataatttcacaaagcaatgtaattaaatataaaatgttagctaaaatggcaaattggaaattgtgtaattcagaactccatgtggggcaccatcctgcatatgtgcaaccttataatcaaccatcacctagcctacaaaataagatcgggacgcagcaatagtgcttatatagtttttaaacattatttttctttcagcaaagatattgcatcttacctgtgttcaccgaacataaggcagaaatttgttcccactttatccaggtatgccaactataatttggggtattccccaaaactatttgtaatggattgttccatttcaggtaataagttgggtttctgtgtcttgtattggcatcatgttcctatttccaactctctagccaagtacttgttgaaaaacagtataaggatggtgtacttatgatctatcaggtcaaaccagtgttttacagttgacagctcagcaatgctctttgttttgagaagaaaagtagaaaacatgatggctactgtgcatcagtaaaccttcccgtgtcataagaatatacaaggccagtttccttcattttcaaaatacctgtcagcaactcagccttgactagtatcattattcaaattttaaccaccaagaacttctaaattgttaggtcatattcaacaaaagatatgtgattacatttgccatgcaacatacttcaataatacaataatatgatagctttgaagtattttcaagttcgataaaaaagtggtcaaagtttgaataagaatagtgtttagtgacaagtattgtgagtttgtgacatgggagtagtaatattattacaagagaacatcttgggctacaatagcaagagcaataatatgactatattttgcgacaaaacatgtctaggtatgaatgcatttgaaagagatgtgaaactatagtcttgtagcttgcttactgtgaggctggtactgttgaactattatgttgttctgctttcacttcctaacttttactaagatgatgctgaaagttcaaacatcacaaggggacaatcataaaaatcagatttccagaagatggaaaagaacgccagccaggagacggtaaatagcaggaccagattctgtccagatggttctatttgacttccaattcacatattttttcctctaaatcctaattttcagcaacttgtaaatcaccaacgtcctccatccttccaccaaaaaaaaaaagaacacaatattaatactactgtgaaacagtaactcgtggccctgcatgctgagcaaggatcagttaactctggtttttttaatctccaagcaccaccagttaaaatagactggcattatatttccagaaaataatcacaaaatggatggcaatccccccccccacccccgcgcctttgtcaaacacgcacgcacaccaaacacaaaaaaaaagggaaagaaaatgcccatgatatacagattaaaatacagtaatatactcgtattggtgatgttattgttgctgtaataaaagatgcagtgtccaagatgcctctagaaagatcaaaagtaatacgatctgtaattgtgcatacatgtatggatttcaaatgcaaaaacggtataataatactctataacaacaatgcagtcgttatcattgatcaaaaaggaaatccaaagagaatagttagttagttattaagatcattagttatatatatgtgagcaaagatgtactaaacacaagcagagaaggcagaacatcaataaattcctatgcatgctttatatgttgaagaactttgagaaaactatctgtctgtgttatattatgagggaataattagcaagcaaggataactttgtggatttttcatgaatgccactcagaccctcagaatagttcgaacttcgaacgcgcctcaccttacagccttcaatcatcagttccacacttgaccctcctaactatcagttgctttaaattctctaggtctacactagctgtgttacttttctcagtttattgctttgcgttggattacaacagcaatatatgacatctattgtaactgactggctgcattattttcactaataaattaacacaacatgcagtatttgagtttgtaaacaatgccatccatatacttcagtcggtccatgacaaacagaaaacaaaattattataggccatcttaatcttaaattatttaagtcatcaaaacaaatgtgtgctgaatgaagctgaggtgaaaacggaagcttaagcacaaattatatagtatgtgtaccaagaaccaagcaaatagaaggacatatttttttaatgagaacaactccatcttaaatattttaatgtgtaccaaggaaagccatgcatatggaagctaagttcgagaatatatgaatgaaacgccatacattgaaacgtattacaagactagtgatatcattcttcatatgaccaatgaatctagtttttttcgatgttagtagtcaaagtaaaagaactttgacagtacagcttctaaaaaatcataaattagtaggtacacccatgcttgcaaaattgccttagcaaaccaagagatgtattagctgttagtgcgatttatctagatataatgcagtaatttggtgactaaactaataagaatatatggaatatagactgtaaaaagaagggaacagagcgatatttataggaatgaatttgaggatgacaacttgtcaggaacagagcgatgttattttccaagttgggtcatctttctagtgttacggtattacagagatatttataactgaaaaaacgacactaaacatgcaatattgcaaggtagatgcaggtaatgctcaatttccttggcatgctcacaagagtcgtccaggtaaggaatagatttcctctgccttaatcttttttgaccttttggacttctgaaaaatatttctaactagcaattctttatgtgcttattccagaacataattatggcactatgacaaagaatcatttatgtagaagcatgcgactgaaactgaactcagtacatagagggagtaagtgttaaaagagaactaatataaataattatgatatggatggatgaattatgtgacatccttacataagagggatgctaggcttatcacttacaggggatgcatttgttccagccagatgataaagcaaaacccctgctgcgacacttacattcaagctctccactgcaaggaatgatttcatatcttggttacctgaataattatcaccttcttcccctccatctgtgtctgtatctgctcctacaaaagatccatcaacattacccggaattctgaccaaatgtgtgcaggatcgctcaaccaggggcctcaaaccagtgccttcactacccaacacaaggattgttggttctcctggcacaacttcagatagaggtatagctttaggagcaacagtaccaccaagaactcgccacccattttcagccgatgaagataaaaactgcatcatgttcctacaggagagcagttcgatcaactcaagtgagcctgcactagctttgctcactacaccacttaatggagcagagttcttagcacataacacaacaccttccgcgccaaagaagtaggcagatctaattatggctcctaggttctgaggatccatgacctcatccaaagctatccagacaggtgcctttccatcgtccaccctgactggctccaactctttagtattcaccatttccaagggtgatgcatcgagtacaaggccctggtgtggacggttatccacaaccatgttaaggtcatgctttgatgcttcgatgactttcagcccaatcctctctgccagttgcaacactttctcaatccctttcttgtccttcttcttcttgttgctcacactaaaatccatcccttcctgaatatacagcgcatagaagtccctcctctcagccatgagagctgcaagcacagggccaaccccataaaccccctgtccaaccatttttggcactgtcgattcccctgcctccttccatgtcttcctcccccagttctcctgcctgctccactgcctaacctccggcttgtcaaatctctcccctctaaatctctcaccacgggaccctctatccctcggcaccatccgccgatacttgtccttgatcctgccccacttcggattgtcaatcgagccattatcctcttcctctctaattatctccctgcccgaaccacgatccgtcaatacctcacctcgcgggctttggtcgcctctggagaaaaacttctccgcggaggtctcccacgaggaggagcggccggcgctagccctcgccgcgggggcggcgccgccatcgcggctcgcggcggcgagccaagggagcgcgctcccgccgtcgggcgatgcggtaccatcaggtgcggtggagaacgaaaccctacctcccagccccagctgcgaggggccgcccgggctaaccgcggctctggcgctcgcacggttggtgacggtggttaccggatgaagcgcgggcgaggaggccgtgggcctggagaagcacgctgcgcggagaaggccggcgaggaggatgcgtcgcggcgaggacgccgccgcgaggagcgggaggggctgggatttggtgaggccggagtggagcatagcgcggggcggggggagtagggttttggatgaggctggagccgagggggttttgggcggcgcgcgccacccgttcgacaaaatgccgcaacgagccgacgacgacgatgcgtggaaagtcacggttttgcagttcgcttcatctctggcgaccaattcatccaacggcacacgtgcatctttcttcctttactcgcacaccgtgcggcccagttcacctacagcaggccatcggctagcccatcagaattcagaaagaggagagaagggacttctgtattttgtggacccctttaaaactacagtactgtaagggcaattactataatgcttcatatgctacctctagaaataacacatagaattaggtgatgaggtggaggagagaagtgaggtgagagatgataaaaccacccctaaatgaagaggtggcttccacacaaactccaagaaggatgtgagagtactaaagacattgatatttgtctattagggacagtggcggacccagaaaaatcatattgggtgtgcccacgctaggatgtataataccattctttaactaaaacatgtcaggttataggtagcaaaagttttatgaaatttgatcaaaatttagttcaattaattcatgaaaagttggtaaaatgtacacaatttatgaaagaacccatttcacccatgcttggtccgttgtcgcaacccatgcttgattttgcattttagttttgatgaatttgaatcaagtaacactggtccaagaatcagatattcagagaaagtaaattatagaagggtaaaagactactagttcggtgatggctttagggcctcaaggctccaggccattggcgtcggcgtaacatggactgcgttgtgcgatggtctcagcctcaccgtggccgaccaccacaacatactgtatggccattgcttccgctacttttcttgcaccaccaactgaccaacagaaatgcccacaacaactagagaacgagatcaggtaagccttttggtcttccgtttgtttaggaacaagggcatctaccaaatatttaggccacgaatgaatactacatcctatattttctctgaaatatttgggtatgtccgtgcatacccggcaccatacctaggtccgcccctgattagggatgacctattgtatatcttgcatcttaatttataggtaaatgatataaataaatttgaaggtagcaatcacatctactataacacttgctttaaagcactgtaaaacttgtgtctagtgctggtcagctggcatgtgaggctcggtattatagtgagacgtactgtaaatatccttatggctttgctgttgctccccgctgtcgtctgctactccatacaggaatgcaaaggacaaggctgcaacagaacaataaaaactgaaccgctgaaatataaaattgatttaacattgtgaaggcgaaggatgaaataggccgagtttagttttaaacttttttttcaaacttccaatttttccatcacatcaaaactttcctacacacacaaacttctaacttttccgtcacatcgttccaattataactaaacttccaattttgatgtgaactaaacacatagtagagaaggaagcggaggaggttctggtcccaaagagtgggggcggtggtggcgatgagatagtggtagtgttgtcatcggcaacaatagtggctgcagcggtggtggcacgtgagtcatcataatacgagaggagtttattggcatccctgtcgctgggcaccattatctcttgtttgtctggcaccttgttttcaaggtttagatctagttccaccatcgaaacaggtgtgcactatatagatattttctagcatcggctgataacgcatcatatcaatgatctggtacagatgggtatcagtcgatactagtgagatatctgatactgtctttaggtattactccgtacctgatatcgcgtagggtaccagatggtgtgatacctatctgctatcaaagcatagcaacccctaacaaatgggcctgttcggcaggccgactgtgagggatgcggctgcacacagtgagtacggtgctgttcgtgcgcagctgcagcctggcaaccgaacagatccaataataactcattatgcataatttattatactattttcatcttaaaatatagaatagtttgttaatgtaacctatataatttttaggagtattctgtaaggaaaaaggtgtgtggtaaacttgtgctggaaagagccgtaaagattccgcaacgtagcaccggcatgattcatgagtgccaggtgccaggtgtcaaataagccatgaacccaaagccagtcaaaagtgacgaaaacggtgagggtggttcttggccgctggctgcctgcctccctgcaaaagccggctcgcgaacttcgcctggcccaacaagcgctcctgcatgccgcttttcgttgcgcgcctcctctactcccgtagtcccgttgcccagcaagcgaagacagtttttccgcggtgtctctcccttcccgacctccgtttcttggagatctcaggtgactttccggttcaaaagctttcaaggtgttcattcttcctcgcgcgaggggcgcacgactgcacgaggcatgacgcagctacgatgcttctgccgcacagctcatacggcgcgctacttgtgtttccaccgtgtgtgcaggcgatcgctcacggttgttcgatggccggggtttgggtttggtttggtttggtggtgcttctcgttgttgcgtatacttgcatgaaaagttgaaactgcagcgcgtcgtgtatgcatagcgattgatcgatcaggccatcatatggtcctcactcctcacacgtactagctaggagttgaacacaacaatatgcaacgacgatggttaattatacacggatttactctagatgtacgtgcgtaggtgtgcatactcgagatgcgccgaactgattctattgatcgcttacgcgttagcttaggaggtaataaaggaaaaaaaaaagagagaaagaggttaaggaccgagatgaattgatctgcatgagtcccattttttttcggcacatataatgtccaaataactcttcaggactgtttggataataggttaagaggaatcgaattaagataggaatataagtggacgattgagatgaaacgagggatataaagaatcgatggttaggattaagagtttaaggtggtgtttgaatctcttgaagatgaaaatgaagattaagtgttttatgcaaaacaatgtgataataacgtgtgattagttgagttttattttttacaaacttgaaaaatggattaatctgatattttagaacaacttttatatagaaagttttcgcacgaaacacaccgtttagcagtttgaaaagcgtgccacgaaaattcaaaagtttatccactctttgtcgtggattcgaacaggatggtgggaaaatattttcccatcccaggctcaataataaccattcttaaatagggaaaattggaaccatgccattataattttgcaaaaattgagatatgccatcc

SEQ ID NO: 28907 - DNA, 25716 bp, Oryza sativa
  unsure (1)..(25716): unsure at all n locations
gacccacatgtcattgacacatgtgggtcctatattcattgagataccgatggcatatctcaaactttgcaaaattataatggcatggttccaatttacccttgtaaataagttactccaattatctaaatctattctaatactttctccgtcctaaaataaatttatttttcacctatctcacacataccaatagaaaacctgaaagactagaatacccttactttatcaaatctcaatgcattcctctactttattgctcctgtcggagtgtgaaattcctctgacagataaacaacgcgacgctcgcacgataaaaatgagggaggcaagttttttagactgtgttacagccctgcctagcgacgcgtggtgcaggactcaccacgctcccccccattctcaacaagacgggatggtatgcatgcgccacatcactattaattagggggggggggtgttgagcaaccccctcgcctatcaaaacatcatcgatgcgactgcgcttttcatggggtgcctaaggcaggtggcgcgctcgggccactgcttgggcatgaagagtgttcttacgtggtttgtgtaatctttgattctatcttagctgtatatgagcttgcaagagctacaacggatgtgccccaagcataacccaggaggggggcacgctatgggcggatgtgccccaagcacaatccgcggggtgccgcgcccgaggaaaggagtgccccgagcacagcccacggggggttcgtatccggaggtaagatgcgcccgagtagttggtgatggtaactctagttttcatttctctaacaacccccaatacaattattccctacttatgcaacaattactctaaaaataaacttattttggaacaaatgtaatgagctaaaaataaacttattatgagacgaaggaagtaagcaatattgaaattttgtttcaactggttggactcccatttgtttagtgtcgccagtttacgtgtgtcagggttatggataccacatacctaatagtagttgacttaatctcagcaggacccaccatataccatgtcttatacgagaactaactttagatatggagggagttccggataaggaaagacaatcagagttctacatggaaacgacaaggactactcggattgtatccatattggtttccctagttctaccttgacaaagggacacctatgggtataaatacaaggccctctaagaggagagtagacacgagataatcgacacccaccacaatctacagaataatatatcaagacagaagatcaacatacaagccaacatacgccaagacaagacgccagatatcgacttcagagataggcacggctagtcccctacggtgtctccggatactgtcaggagagacgaaagcgctatctttgatctcgccggacacgaactcgaggaggaagactaccctgttgtcgactacgagtcagaccttcagaccaccatgtcgacaacagttatatatgctaccctaaatattgtactggtgtgattatggtgaataagagcaataccggcttcggccaacaggatgtagggttattacctgacaactcaggggcccgaacctgtataaaaatccctgtctccatctcttttacctcagtctcacatatatcctagtaccaacgatccccatactatgcaaataccggaatcgcgacatcaaacgtcgacaacgtgttttagagattttctcatgtgttatgcgaattctcttttagactactatgaaacacaatattttaaaaatacagggataaggaaaatatagaaatatgtcatcacgacttattgaatcccagagaaaacaaaaccacatgaatcgctcaaaatagatatttggatgattcacaggaacaatatactccatccgtcccaaaatataagtattttagactttgatacggtcttcgagatgctattttgaccaacgatattgtgatagtttgtttaatgataaatctagtaatattaattttacatgattgatcttatttttttgctattaatagttaaaattacaaatatttgatttggcagtatgctaaaaatgcttatattttatgatagagtagaaaacttaagattatattgcgatttgttagagagaggtgagagagaaagatataagttgtattgaaattcttaaaggaatttgaaaacataaggttagatctcacgctaaaaatactttaaaatatggaggaatcttttcctatcctatgaaaatcttttgaatcaatcctaataaccaaataataacctccataggaattgttaatgtgagattgggggtcaagacagcctttcacacgttcattgcattgggcatcgattggttcgtcgcccagccggaaactctgatgaagtctgaactctaggttagaattcccggtcacgggagaactgaaaagtctgaaaagcgatcccgcgccgaggtgctgatcccacggccacgggccgttgcgccgttgagcaccgacggctgccgtcctggtttcccatggcagagcagccgcctctgtcggtcagttgttcagtaggcgacgatggccagcctcttctgtcggtcagttgtccaggaggcgacggatggcgtccgtgcgtggccggccagccccaagcgagcgagattcaggctggcacccggtctacaatctacatccatgcctcccgaggccgcgggaggtatacaccatccgttacctccaatggatcccccgccttcccctgtatgctctcgtattgcgtattcccgtggccgtgcgcccgtgcctcactgcctctgctgtatgcccgtacttattccgtttgtatgatggttgaacgggtcggtactcggtagtaatgcttgctaggtgttcgttgttttgcctgacaagaagagtcgtggccttggcccgagaagcattagttacatttcgttttacagttctcagttactgaatttgttttgctgccgtacctctctgaattcccaagtacaactagtgagaaattgaccatggtttgcttggtggtaggtgccatgtctactattgtattcatattagtctttttttttctattcttaattgatgtgtagttccttataggtgccacaccaaatatgtgtagcgttgatcaaacattttagtctgacacatgacagatcagtgctttatctaattatctgttgtcttaatgatatcgaaaattccaaattgttgctctgattactattctgtgtagtacttctactcctgtcagttttccacaaacagatagttcattaggttggataagtggttaaatttagttgcaaactctgggagagatgcaactgttatcttaacaaacattggatcaggggaagcacatggagtgtagaagataagtcaaacttatgtcagattcccaaggaacatgatatcatgatacacatgcttccagtatagttatacattagcacctggctgcttcgccatttgttgtggtgatgctcatttattatagttttttgagcaagatgcacagttctattaagtcatgtaatgcattttttcattatgcacttgacagctgctgaattttaaattgactttcagtagaagtactattgatcttagactcaatatttttcttaacgcgtgcttgccattctgaaacacaatttctagtttacctgcggctgttattaactcactgcaagttattttctgaacacgaacttgtaagcaattgttctagtacaaattcatatggccatgcattatgtcagcattaatattagtgaaagtgggcaaatggatgtcgaaagaattaaaattaacactttataccatgaatgaacttccttctccatagctttattattctgattttacattaactgtgaagtttcacctgtgccaaatgtaaaagcaagataggttacttttcaaatgtttataaatgctcttccaaatttatttagcatgctgctttatctttcattttcactgtgaggtttgctaatcgaattctttttactgggatattcctggattctgactagattgatcatttcaaaacaggaaataagtttggtgtaaattgaaaatcactcacaatggttaagtttacggttgaagagatgcgcaggattatggacaagaagcataacatccgtaacatgtctgttgtcgctcatgtggaccatggtatgtttgagtagagtgctctaagactgttatacaactattatctttttcctgatatgccacctgttatgttgtcattattatttatactcatgcaaaaaaaaaaaaactactattcctttttgtagtagtgactgtcagtgctcctgccttttttttttcagaaaaagggcccatgctaagaacttttgctctttatcatctgtagttaatgtgttattgtcatatttatttttgcttgatatgaaatgtctgtaagcaaattaactgtatctgccttttcatttgcatgatctcaaaattaaaagctagcattttatagtatcaccttcatgtgtgcatccttcatcctgctcactgtttgtgctttttcgttaattaataaagtaacttacttgtttggtctgttatcacttctttgtttaacagagggttcctgatttcctgaatatattatgctcttgttttcctatttgtttgctgattcaacatcttgagttatatttgatgcaacaatgatgtttgatctgttatgatttctttgcaggaaaatctacccttactgattcccttgtggcagctgctggaattatagcccaggatgttgctggtgatgttcgaatgactgatagtcgttcagatgaagcagaacgtggtattacaataaaatctactggtatctctctttactatgagatgagtgatgagtcactcaaaagttacaagggtgacagagatggaaatgaatacctaatcaacctcattgactcacctggacatgtcgatttttcttcggaagtcacagccgcacttcgtataactgatggcgctttggttgtggttgactgtattgagggtgtctgcgttcaaactgaaactgtgcttcgccaagcccttggtgagaggattaggcctgtcctcactgtgaacaagatggatagatgttttcttgaacttcaagttggtggtgaggaagcttatcaaactttctcccgtgtcatagagaatgcaaatgttattatggcaacatacgaagatgcactccttggtgatgttcaagtctatccagaaaaagggactgttgctttctctgctggcttgcatggatgggctttcaccttgtctaactttgcaaagatgtatgcatccaagtttggagttgatgaatctaaaatgatggagaggctttggggtgagaactactttgaccctaccacaaagaagtggaccatcaaacacaccggttctgatacttgcaagagaggttttattcagttctgctatgagcccatcaggcaaattatcaacacctgcatgaatgatcagaaagataagttgttgcctatgctgcaaaagcttggtgttaccatgaaggacctaactggcaaggctctcatgaagcgtgttatgcaaacttggcttcctgcaagtaatgcacttcttgagatgatgatctatcaccttccctctccagcaaaggctcagaggtaccgtgtggaaaacttgtatgagggcccccttgatgatatatatgcatctgccattagaaactgtgatccagaaggtcctcttatgctgtatgtttcaaagatgattccagcatctgacaaggggaggttctacgcttttggtcgtgttttctcagggagagttgcaactggcatgaaggtccgtatcatgggccccaattatgcccctggccagaagaaagatctgtacgtaaagaatgtccagcgaactgtcatctggatgggcaagaagcaggagtcagtggaaggtgttccttgtggcaacactgttgctatggtgggtttggaccagttcatcacaaagaatgctaccctgacaaacgagaaagaagttgatgcctgtccaatcaaagccatgaaattttcagtgtcccctgttgtgcgtgttgctgttcagtgcaaggttgcctctgaccttcccaagcttgttgaaggtttgaagcgtctggccaagtcagatcctatggttctctgtactgttgaggaatctggcgagcatattattgctggagctggcgagcttcaccttgaaatttgtttgaaggatctgcaggaagacttcatgggtggtgctgaaattactgtctcccctcctgttgtctcattccgtgagactgttcttgagaaatcttgccggactgtcatgagcaaatccccgaacaagcacaaccgtctgtacatggaagcccgcccaatggaagagggtctgcctgaagccattgacgagggtcgtattggcccgcgtgacgatcctaaagtacgctccaaaattctatccgaggagtttggttgggacaaggacctcgcaaagaagatatggtgttttgggccagagaccacaggccctaacattgttgtggatatgtgcaagggagtgcagtatcttaacgaaataaaggattccgttgtggctggctttcagtgggcatcaaaagaaggtgcactggctgaagagaacatgcgtggccgtggcatttgctttgaggtttgtgatgttatcctccattctgatgctattcatagaggtggtggccagatcattccaacagccaggagggtcatttatgctgctcagctcactgccaagccaagactgcttgagcctgtttacttggtggagattcaggcccctgagaatgctcttggtggaatttacagtgttctgaaccagaagagaggacatgtgttcgaggagatgcagaggcctggtaccccactctacaacatcaaagcttacctccctgttatcgagtcatttgggttcacaagcacccttagggcagcaacctctggtcaggccttccccctctttgtatttgatcactgggaaatgctgtcagttgatcctttggagcctggcaccagacagctaaccttgtcctggatatccgcaagaggaagggtctgaaggagcaaatcacccctctgtctgaatacgaggacaaactctagatatttaatcatgttattatgcttatagtgttatatcgctttataattggtagtggccatctatgtgagcagtgagctgctatttcatgtataatattatgtcgaacggttgtacggtagcatgggatgatgatcaggcgatattgttataatttgttatggtatttaccatcatatcataatctgttctctctcgtatgactggtgcttttcatgccattagctctttgacccattttaatgctttgtactgtaacttaatccgatcattgattctgggagagtaatgtatttgattttatgctgagagtattataaatttataatgatgtattgctggccggaggggtagaaatcgcaagtcttttgtgtttcacttgtgcagtggagtaaggtaagaaagcaggtcaccgcaaacttttctcagactaatcacagttccatcaacattttttaagcttgctgaaatatgctccaccgtcagtgtgtggaccgatcattccaacaagccgactgagagcaaagataataatatagcaagctgcagagcatagatctttataatctatctctcagattactcatatagtggttaactcttcactataaatatatggtttatctatctgtctcatagatctttttggttcctgtgactaagccggctgtaaacttacaacccgcttctcatctatcccctctactatcttatccatttacagcccgcttctcatctatctcctctactatcttattcacctcagtattcagtcttcttataaccctctattgtacttgctctgacaagaacaaactataggagtatgcactagtaagggtgtgtttaatttaggtcaaaattaaaagtttggttgaaattggaacgatgtgacagaaaagttggaagtttgtgtgtgtaggaaagttttgatgtgataaaaaagttggaagtttgaagaaaaattttggaactaaactcggcctaatcccaaacggtgaaacaccacgtatgcttcttttattgatctgaatcttttaaccactgtactgtaaacagacagagcgaagcaatcatccaaccattccattacacgatcgaacacatctaaccgagctgagcctgagcagagctcactccggtttcttgtcaaggcaggtgttgttgagccgctcgatggcgaggatgagcgcctgcgtgccgaggccgccctcgccgtgcgcgagcagcgacacgtagagctggtgcgcgagcgcgagccccggcagcgccagccccatggcctggcactccgacaggcagatcccgaggtccttgacgaagtggcgcacgtagaacccggccgccatgtcccgctccagcatccgcttcccgtacaggtccagcgacttggaccccgccgcgcccgtggagatggcctccagccacttcgccacgtccagcccggccttgtgcgcgtacaccatgccctccaccagcccgaccatggtggacgcgatcgcgatctggttgcccagcttcgcgcgctgcccggcgcccggcccgcccatgtacagcgcgttccccatcagcttgaacaggggcgccaggcgggcgaccacggccgcgtcgccgccggcgaagatggagagcgtcgcgctgcgggccccgcggtcgccgccggagaccggggcgtcgacggcggcgcagcttttggcggccgcggcctcggcgatctccgcggcgagggtggggtcggaagtggtcatgtcgacgagcaatccgcctggggcgaggccggcgagggcacccgtggaggggtcgagggaggtggagcggacgtcggaggggaagccgaccatgaggaagatgacatcggctgcggcggcggccgcgcgcgggctttccgcgagggtggctccccgggagacgagcccctcggccttggaggccgtgcggttgtagacagtgagcgcgtagccggcggcgaggaggtggccggccatggattggcccatgacgcccgtcccgacccaggcgacgcgggtggtgtccggggaaatcggacggtcggagacgttcacgccggtggcggacgacgacatggctgctgctgcggcggcggcggcggcggaaagcggaaggggtgggcgacggcgagtgaaggatcgggagatgcttgcgagcatttgggggcgaagtgtgagccgaataatttgtctctgtgtgcagatgaattgtcccaaatgccctctggtgtcgccggagttgataaggtgagcctcgtttgcggtgctcctgaatgcatctcgttcgtcggaaaatttctttcccaaagatccatttgtcaaatttttcgtttaaggctgtgtttggttcctttcaaagttagaagtttagattgaaattagtatgatgtgactgaaaagttgtgtatgacaggttgatgtgatggaaaaagttacaaatttggatctaaacacagcctaaaatctactactctagtatggtctatagtttcatttgtgtactggcactctatatcgaattgagtagagcatcaaaaataaaagccagaatctcctaagagcgattctagcggttctatctaggccacccctcaatttcggcctaggagaatcccatgccacaccgaatccacaacacctgcatgaccattatcacataacatagattagaagcggtcaaacgaaggccgaaggtatagaacgtcatcgctccccgatactcgttcagtcgtcctatcaatgtctcacgtgtcggcaggggctgcgaggcatcttagcttgctcagaacagctcggaaacatagaaaaaacacgtagaaagtacacaggtttgggcctcctaccagataatagcactactcctttgcttttactatttcgatggagagttaagctcttgaacaatataaatattcgagggaatctaagtctctctctatagcaacttaccgctaggcttttatacccacgggtcacgtcctcatccttaggccggtgaaaacgccacgatatcccttctcgagaagtcaaggagttaccatggcaagccaggtggttgtgggtttgttttctttctcggagagagacacacatccaaccctgaggaggggtgactcacttgatccagccaggtacgttcttaacgaagaacaagtggagtttctgggcggctcgccaatgagtttcacacacctatggacatgccacgtttccgtgcccgagcaaccctaggctcccgtctaggtttcgattgttttaatcttaccatgcttatgtgatttgaatggcaaagaggcacatggaccttcttgaaaggacctttatgtcgcctagaggggggtgggtgaataggcgattttgaaatttacttcaaattgcagtggttaaaattagggcccagaacttcctggcaaaaggcccggaacttcctggtagctttttatgccgagcaaagaaagctgcctggaacttccggagttcttcctaggaacttccggggagttgtgagttgctctttcgagcacctcacaacaagtaaattgattcacaaggaagcctaaaccatagaaaggtgcaacatgtatcaaacaagagtaatacacatgaaactacgcaagatagcacaatgatcatacaaggggagacatgatagcacaactagacaaataaggggataagcatcacaatcacatagataaagagagtgggaggagacaaacgatttgttttcccaaattcggattctccaccgagaatcctacgtctccgttgaggagctccaaagagacgggtcttgattaaccccttgcctcaccaagcaaaggcctaggaagaggtctttggtcttcaagccaacacccctaggtacttctctttggtttcaaatgaccactaagattcctaacttgaacaccaagagaacaccacaagtgaggcttgctctaccaagacgacctcctaaaccttagctcggaatccactcaccgggtattctgtttcctttcggaggtggaataacgccctcacaaacttcctgcgattcaccacaagcttgggagctcaccgggcaactcctagccgtctaggaggcttaacctccaagagtaataaacacaaacgatgatttgcttgctatgaactcatgtgctcaaatgatggagtggatctctcaagctctcaaccttgccacctctcaatctctcaaatatcttcccaaatctcactcacaaagatctaccactaaggtgggaggtttgggaggggctatttggtttttgataggtctattcttacccaaagtcagcagcaaacaaaggagagagtggaggggcttaaaaaacacaagcccccaaaaaacttgccattactcacataatagggcccggaacttcctgccccgagacccggaactttttgtcaccctcctcgcccaaacagagagattgggtcagaacttcctggctcagggccctgaactttcgagctaccatgacatcacttcacaaaaacagtcataactccttgctctggagtctgttttcggtaaaattgggctctatggaaagcttattaagagggccacccaacccaaccagaaaaaagctctaaaaccactcatagattaagttaaggctttggtttctctcaaggtagcacttgcataggtcactttgagcaccgagacataaacaaacatatcaatgttgcatccctcttaatagtacggcattcctatactcaaatgcaaatagaaaagctataccactaggaatgccttcttgccatcttcttgcttcaccttgaggggtgccaacgtcaacgccatttcaccatagggactattcttatctacaactagttaagcacactagtcccaaatcaattatacctttgtcttgatcaatgcccactttggcttttgacttgatgttcatcggagaaccgcatcctcttgatcttcggcattccatcttgcggtcttcttataattgatacggattactcatagcttcaaatggcctcgtacggtccatcatgacaaagccttcgctcgcccttcaccaccggattcggtccgtcggcgccaagcctcttgcttgcccttcgctcccgcatgatccattgtagctgagccttacttgcccttcaccattttgccatagatagccacttcatacccgcatcatcaatgtcttcacttgctcttcatcaaggtataatgtccatcttctagccgagccttacttgctcttcaccgttttgccatagatcgtcatttcataccccgcatcatcaacgtcttcacttgctcctcatcaaagtaaaatgtccatcttctagcttcaatcttttaactcgatgccggaacttaacctaatctcactaactcatcgaaatagttagttccaacaacgggttgtcattaatcaccaaaacaatcaccgcactcttagagtcatagatattccaatctccccttacaaggcaactctagggcataaatctttcaaaaccatatcattttttaagtaaaattggcaaacacatgatgcactggtaatgcctagagaattctgacaacaacaactattaacttattaaagtaataggaaaaaggagccaccattttcgttctcacggcctaaaaattttcacattgataggagaaaaagaaaaaatagagtccatataaaaatgtaatttaagaatagctaaaatttggaattaaagataaataattttggaagatgagttttgagtatatatagagatacaattaaaaataacggaacttcggaactaaagaaataggaaattggaaaaacagtctagatgcgtccatatatgaacttagatctaactggaagctggacttaaataataataaatttaaaagtagagtttagaattcgtatagaaatacaatttagaaataactaaaattcaaaattttaaaataagcaagattaggagaagagttcaatatagaaatacaatttataaataagtaaaatacggaattcaaaaaaataagaaatatttagaaaaaaaagactagagtctatatagaaatacaatttataaataactaaaattcggaattaaaaaaataaattttgaaagatgagtttagagtccatatataaatacaattagaaataacgaaaatttgaagttaaaaatatgaatcttagaagaataatctagagtctatataggaattcagacataattaaaaaataagaaaaaaagttaaagtagagtttagagtccatagagaaatataattttaaataaataaatttaaaaaattaataataaacaagattgagagaagagtctgtagtccatataggaatataatttacagataacttaaatttggaataaaaaaaggtatactggaaaaaaagtttatagtccatataggaatacaaagtacaaataacgaaaattcaaaattaaaaaaaactaggaatattggaataagagtttagagtccatataaagatacaatctacaataactaaaattcaaaaatatgaaaaacgaatattagaaaaggagtatagaatccatatatgaataaaatttataaataatggagaaattaaaaaagtaaggaaaattgaaatatgagtctagagtccatatagaaataattaaaattaaaaaaataatcataactatcacgtatatacaataccatataaatatcacatattggttagttttgtcaagttattacataatttaaaattatgtattttaataaataaaatgtggaaatatttaagatattatatgagaaaaataaaacgatgctagccgcgcaatatgcgcgggccaccatgctagtttagtttgtcttacctgccttttattatactatcatttttttaattttaatattgctaaatttcgaaaaggtactaatcgtcctaaatttggaaggatgcgtcacggtggtgagcggtgacgtagctagtctttctatataactcaggccgtgtttagatgctttggaaaaaaaataatgtatacgtacacacgtttgaagtactaaacatagactaataacaaaataaattacagattccgtctgtaagctgcgagatgaatctattaagtctaattaatccatcattagcaaatatttactatagcaccacattattaaatcatgatgtaattaggcttaaaagattcgtctcgcaatttatatacaaactgtataattggttttttttcatatttaatactatatgcatgtgttcaaatatttaataaaagttggaagtttgaagggataaaaacagcctcaggctgatgagaggacgcataaaggcaaaccggctagtgaggagcggacctctcggtctctcggaccgatcctgtgggcgcgaggccgcgagctatagttaacggtgtggattggagtctacgcgagtaacgcaactcgtcgagtcatcggtccgcggtggcgacccggctgaccagtcaacggtccactggtctccgggtggagctttcccgcttggtttccttcctgcagttgccccactagtgaatctttttctttcggttttctttacggaccagtctcgactctcgagatcgatcacacgcgcggtgcgcacgatcagctcatatggacgtccttttcgagcttaccaggccgcgcggaacgccgaaaccgttagtgctaatcaccgatgtggacactcccagtcgcttccgttcaactctctcaggaaggtggagtggatggccggacgttgtatgcacaaaatactctcaccccgtcccaaataaaagaacttttatacatgaacttgatatcttaggacatacagattagtgagtactcccttcgttctaaaaaaacttaatttttaggtttccgtgtctgatgtttgaccgtccgtcttatataaaatttttgcatgattagaattttcattattgttaaatgataaaacatgaataaaactttatacatggcttattttttaattttttttataattttttaaaataagacgaacgatcaaacgttagacacggaaattcaggaattaagttttttttttttggacgaatggagtagagaatagtgagtgccatttttattggtagagcagtattcgatcaccagtattgtttgcatgataaaatctgtatactctactataagctcctgtgtcggggcaaagctcggttacatatggcatctgtagtttataaacggatttgtggaacggtaaattaacgttctggatcttgactcttgaccagttcatccacacgtgtgtagtccgtttgttggttggttgctttcctgttccagctggaagtttttgacctacagtaacatcatttttcgctttctattttgattccccgttgccaagtcgacagccgacttgaacctgagcctttcggcgaaacttgaaacctccaatccccaatagcccacgtacggttgcagacagccttgtagagtcgccgtgtttcaccggagcgaactgtatactcctacagtttaagatagttcggtggaaaaacgagtcgttagttaacgacctgagtaagctccgacttaaaaaatggtgaaaaaatgctgttaatcatgcgtcgggaagacctaactcacatacccatatttacaaacgaaaaataatttatgaataaaacttttatatatatgttcttaacgatctaaaagtaaaggttgaaaaataaatatggataaaaaacaccaaaattaacttcaaatttaagaccgaaaatttaaattttgactgataagtataagtataagcgaaaagattaggctgccagttgggcctttcctgaattctggactctcgatgtcttctcgaataaccatgccgtctgaatcactcttaagtcttactaatccacagaaaacaatcatgtgctccggtaagcaacatgaagcttcgaagcaagcacgcaggagcttataacggtctcgttcccgccgcatttgcttaacattctcaaaccgaactccccccacttcttcccgcgtccacagcggcttgcggcgggggcagaacacaccatggaaaccatggcaaaagcaccgggccctgtgtacctcctcttcctgctgctcgcgctgccttgctgcctcatcccgcaccgcggcgcggcccagcccgcggcgaacgaggcgcggctgctcctccagatcaagcgcgcgtggggcgacccggccgtgctcgcgggatggaacgacacggccgcgcccgcggctcactgctcctggccctacgtcacatgcgacaccgccgggcgcgtcacgaacctctccctcgccaacaccaacgtgtccggccccgtgtcggacgccgtcggcggcctctccagcctcgtgcacctcgacctctacaacaacaacatcaacggtacgttcccgacgagcgtgtaccgctgcgtttctctccggtacctcaacctgtctcagaactacctcggcggggagctccccgccgacatcggcgtcggcctcggggagaacctgacaactctagtcctcagcggcaactacttcactggcaccatccccaagtcgttgtcccgattgcagaagctggagtggctgatgctggacaacaacaacctcaccggcacaatcccgggagagctcggcgacctgacgagccttacgacgctgacgatctcgacgaacaagctcggaccgggtcagctgccggagtcgttcaagaacctgactaagctgacaaccctctgggcgagaaagtgtcagctcgtcggcgacatgccagcctatgtggccgacatgccggacttggtgacgctcgacctggcggtcaacaacttgacaggaagcattcctccggggatctggagcctgaagaagctgcagtgcctgtttctatttgcgaacaagctcaccggcgacatcgtcgtcgccgatggtgctttcgccgcagtgaatttggttttcatcgacctgtccgcgaatcccaagctgggtggaccgattcctcaagactttggtctcttgcagaagcttgaagtcatccacctgtactttaacaacttctccggtgagataccggcgagcatcggtcggttgccggcattgaaggaaatacacctattcaataatagtctcaccggcgttctaccaccggagcttgggcagaagtcaccggatttgtgggatcttgaggttgatttcaacaagttcaccggcccgattcctgaggggctgtgtgacggcggcaagctcaacatattcaccgcagcgaacaacctcttgaacggctccatcccggagaggctcgccggctgcaccacgctccagaccctgtttctccccaacaacaagctgtccggcgatgtgccagaggcgctatggacggcgacaaagctccaattcgtgcagctgcagaataatggcctcaccgggactctgccttccaccatgtacagcaacctttcgagcttaaccgtggagaacaaccaatttcgtggtagcatccccgcggcggcggctgctcttcagaagttcatcgccgggaacaacaatttttccggggagatcccggagagtctcggcaacggcatgccggtgctgcagacactaaacctgtctggtaaccagctctccggcgggatcccgaagagcgtttccaagcttaaagtcttgactcagcttgatttgagcaagaaccagctctccggcgagataccggccgagctgggcgccatgccggtgctcaacgcacttgacctgtcgtcgaacaggctctccggcggcataccgtcgtctcttgccagtctgaatctcaactcgctcaacctctcgtccaaccagctcagcggccaggtgccggccaagttcgccataggtgcctacgcccgcagcttccttgacaaccccaccctctgtacctcaggcctgggctccagctacctcgccggcgtgcggtcctgcaacgccggatcgccaggcagcgcttcctccggtggcgtctcgccagggctccgcgccggtctcctcgtagccggggccgcgctcctcctcgtcatcgtggcgttggccttcttcgccgtccgcgacatcaggagaagaaggaagcgcgtggcgcagcgcgaggactggaagatcacgcctttccagaccgatctgggcttcagcgaggcggccatactccggggtctaacggaggagaacctcgtcggccgcggcggctcggggagcgtgtaccgcgtcgcctacaccaaccggtacaccggcggcgacggcgccgtggccgtgaagaagatacggacgggcgccgcgaaggtggaggagaagctggagcgcgagttcgagtcggaggcgcgcatcctcggcaacgtccggcacaacaacatcgtcaggctgctctgctgcgtctccggcgacgaggccaagctcctggtgtacgactacatggacaacggcagcctggacgggtggctccacgggcgccgcgccatcaacgacgggcgccccgtggtggccgctgtggcgagggcgcggtccgcgcggggcggcgcgcccgctttggactggccgacgaggctcagggtggccgtcggcgccgcgcaggggctgtactacatgcaccacgagtgcaccccgcccatcgtccaccgcgacgtcaagacgagcaacatcctgctcgactccgagttccgggctaaggtcgccgactttgggctggccaggatgctggcgcaggccggcacgcccgacaccgtgtccgccgttgcaggctcgttcggctacatggctcccggtaacgatctctctctgcttgacactgttaattttgtactctccttttgtgccgtattctatacagaacatgtctagttaattaattcgagtattattatcactgagacttactctctctctcttttcagagtgtggttacacgagaaaggttgatgagaaggtggacgtgtacagctttggggtggtgctcctggagcttaccacgggcaaggcggccaacgacggcggcgagcacggttccctggcggactgggcgcggcaccactatcaatcgggagagagcatccccgacgctacggatcagtgcatcaggtacgcgggttactccgacgagatcgaggtggtgttcaggctaggcgtgatgtgcacgggggccacgcccgcgtcacggccaaccatgaaggacgtgctgcagatcctggtcaaatgctccgagcagacgcaccagaaatgcaaggcggagagcgggcaggaggagtacgaagtggcgccgctgttgctgccgcaacgaggcagccgccggaaacagcccgcgaaggccaaaggagcagacgacgacgctgacgagaggagcgatttcgattccattgtctgaagaaaggagcagagcactgccgcacctttacctactaggaaacactgatgtgagcagggaatggttagtctatgagccagcactgcactgcatgaatataaacgccatattagacagtactagaaaagatgatcatactctattaccttaccttgatggtacacttcttagtactattttgttagctgctcgcggctgatcagatcatttgagctttgataccagtgtgtaagagtacatacatagttcaaactgacatacgaaaagtgaaattatgtccccctctttattctgaaatctgaatgacaaaaggctacacgcgaaaccgctgtgattggtttgcgacatcgcatcacaatacaaacttacagggaaagggggaaaataatttgcaggaaaagaacggcatcattcaagcccccgttttcacttccctgcagttgcaaatgcttgttcatgtgataactgcaaactctttggcgccatactagctacatcccgctgcacaggcactcgtttatgtgactgcagaatagcaaaaggagatgcgaatcgcaggagggaaacgaactcccattggaaagaaacggggaaaatgggaggaaaacaagctacactgggagctcagtcccatgagctcctgttactactcgacgctagcatactgggagtgagatgctgcaagaagtgcagctccgatgccagagccatcgtttgccaacttgacaacaactgatgaggcagcctcctctccaagcaggtctgcaagcgttgcttctaggcaggttctgaacttcttgtaatgctcatagagaccaccatccagagcaatgacagtcctctgcttttgactaccgtcacttggcactctgtccctgcccagcttctttagaatgccatatataccagcagcagctaagcgtgcacctctctctgcaacgaggtcgcagacatgaagggtgatgtatcgtgcttccagggaagtatcagcgacctaaacataagttcaggcatatcgtaagtaatcaatggttcttgaaaattagatttgatagtatcctattttcaagatatgtattatcatacccccaggatatccttcagcttagctcccaggtgtttcagatcatgtgaggtatcatgatgcatcgctgacatgtccggcgtcctgcaataccacaattggagttccgttaagaaattttctacatagttacatgaatttatcttattttgatagttctgtgctaccatgatcaaggaacgcataatgcacaccatacagtctatgttgaaattttatcttattttgatagttctgtgctgcatatatgaaaagctagatacttagatgatcaacataggggacatagaagtgcacctcagtataaagcgctgctccagctttgttggaacaacatctccaaacaaggaagcatcatgagcaagcttaagcaagattctgcgcacaatctctccaagatacatgccggaaatcatcttttcatatatctgaggaaaagaagaccgaaattctttcatgcccacatatagttggaaaataaaaagataaaataaacaatacctgctcgcctgggtttaaactttcaaagtccaaggcattatcgtaatctgaacgaggaagcctttctgacttgaagtttccccattccatgttaatcaccttcatcataccaaagatccaaatgttataatattaattgatgtgacaatcatccagtgcagaagttgaagtggatacatacatttatacaaggttcaaagacatttaatgctacaagtataacgaaatcagtcactaaccatatttcctgatctaggtagtaatccagtccattttggaattgcatttgcatgctccacgtaggctgcgtttgtgccagtgcctaatattacagcagcagcaacgtcattatcaacatatcttccgccagccaatgtgcctacagtgtcattaacctgggcaaaatattagttgtcaatttacatgacacagtctggtgatatactagtaaacatccaaactcatagaacattgaaaaactccaaagtcagcattttcataggaatgccaatgtatttacccatcagcatatagcagtagcaggcatgggaaagtttcagatgataaataattttaacagagtcatgaaccaagaatttacttacaagagctgtaactttcatatcaagcccttgcctttccatagccctgctcaattcagccacaacatcttcccccacctgagttcacagaaatcattagtctatacatcaaaattatgggcataacattataaaattaaaaaagatattgcagtgttgatgccacatttgtcttgagaggctagaaattgccacattaaaagtaggaaacagaaatatgactagagtgcttcattcttggaggttcaaatttaagaagtgcaggataagcaaatacatttttttatggttacaagtgttgtatagcaaacacagctctaattgtaacatctgcattcacaatcgccgcaggatttagaagcaattataagatacttgtgaattggataaatggggacatatgccaccatgtcccgtttatatcacatctaagaataactttaccaaacatgttaatttatggataaccaaacatcagtccaaatattctgaaaggaaaatgaagggcaacggctggtcacttggtcaatgcagggaacccaaaagtcaaaagtgacacagctagtgagaattcgtttgctgacacaacgtggtttctaatcaagactgatcgtcaaggtaataaataattcctagatcatttagccatgaaatttatactaaggccattcgaattttaccgtgccattgatggaaaatccctttgtccacttaataagagtgcctgatgatattgatgtttggtgcactgggaaagaaaaggtgaagcctaactctctctgcctgccctctggcaagtggaaatcctctccctcggtcttgacaaaactttccaactcagccgcaatgaagtcaaacagttcctgtactcatatttctgaaatttgagtaaccatgaaagaaattgtgcaaacacaggagaattgaaacataacagttgaaaggaataagccactgaccatagaagtcccaaccatcaggtgaggtggaatggcaacctcttcgtactgttgactaacaacacgcttttcccttcctccaagctgaacacgtataacacggaaattggtgcccccaagatcgagagcatagaacagtccgtgctcatccctgcacaagtggcatgcaaatcagaggaagcataaaagaagatttcatgaagtgataggctcaacatttttcattttccatacgcctatggatacatataataaactgtcaaactcactgaaacttttaagcctcgagtccttgaccatttctttctctaaacttattcataaacctttcatgacatttcctacaaaattcacatggtacaaaaaaaagaacgattgttctgtgatcgactgatcgtaagcccagcatgaaggcacaaattacaaaatggacacacagatatatatagttgtcaaaagtgaccggaacctaattgttcattttataattctgtctggagtcttcactgcgaaaaaaaaattatgtcaagtctatcctggtggccactttctgctaccaccgtgagaaacctccactcagtagatcaaaattccataggaaacgaataggtctcatcattcttccgtgatcaataagaaaagagctaaaaggccgtgtcaaggcacagtgctcttgatatcaatatgtcgcacctccatctcaacaaccgaagatcaatgccacatttatgccaaatccgaacctaagcaagcgctaagccgctagggatttccaaccgattcgcccccgaagagaaacacccctcgcgaacacagtaacaactattcccaagctttctcgtgtcacgtacaccccagaaatcataaaaatcgcacaagcggagcggagggaggcctacccggtggggaggttgtcgacgtagctgatgagcatcttgagcggggcgtgagggtcggcgcggaggccgcgctccatctcctccaccatggcgtccgcgatgccgcgcagcagcgccgtgggcgtcgagaacctctgctccacctcctcgatcacagcggcggccctcctccgccgctcctcctccgcctcccgcttgctcctcctcctccgcgacaccaccaccgccaccccaaccgccgcggccgctgcagcgcacaccaccaccgccgtccccactaccgtccccttccccatagccgcgcgcgcgcttcttcacgctccccccaacccaaccctggcctccctctcgatcgagcgcgcgccaggagcaaatcccccagaccgggtcggcttcccggatcgggagctacgccacccaccactgcagcgtcctcctcctcctccttcctcctgcctccctccctcagtctctctcctctactcttttcttccgcttgcgcaagcgtgggaatgggacgagagccacgagttgggcgtttttgctcgcgaataaatcgccctcgagtttgacgttatttacggatatgcccttacgtatgaacggccctgatttgtcctttctgtaaccgtagggctcagattgcagatgccccaacgcgggctttgtctggattcgtttcgtggctctgcgtgctgctgcctgtaatatggagatttcgtgaggggtttatgtatcaaaagcttcacaagattaacgaacgaacgagcatgacagccagggaccagcagatggcacctgccggccgtgcatttaggagagccaagaagggtgttcccgtcaaattccctaattttcactagagtagtaggagtaatcagttccaaatgtccaactgattactttgtcagaactcgggcaactaggcccaccgatcagcaaaaggctgggagtgattagttaaaagggtggcaggacgtgattatgatacgggggtcacgtgcacgttggggcccacctgcagtaccgatgacgtgaccatgagctcagaagtatacgtgtcgatgaagcaacggccggctgcctggagatgcgtgctcagcgactctgagcacatatcttccctcgcgcttgggcgtgggcgtcgataattcacgactgtagcgagcgagcgatccatccatccggcccactacgtatcgtcgtggccgacgctcggatgggtcgccgcacacccaaaactcacgatcgttttagctactgctaataaaacatctatccccatcctataatataacaacttttaattacgaatctaaacaaatatatatctaaatttatagttaaaaattattatatttaacaacaaaggcaacaaaaagcagtgaacaaagcaacgaaaaacagttttagataaattacaggtaaaacactatatctatgttcttagtggtttaaaagttaatacttaaaaatatcgaaatgtgttacgattaaataactctaaaattaagtgtgaagattaaaattttggttactgtcgataagctaacaaggacgaagagttgaaaggcgcatatctatgggtaccttccacgatttgattagtcaatgtcagaaacagctttcgcacaatcactctcacgcaaaacgtgatataggccctaaagccattagtcataggctcaactggtttgctgatcatatcttttaatcagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28908 - DNA, 2524 bp, Oryza sativa
accactaatgggcgcataatcgagtttagggacgttaaaatataatttgagagtataaggacctagatgacacacctcgacaagtttgaggaccgtcgatgcacttcactctaaagaaaaactagcgagtcaattgcacagcggtcttttatccggacccgtgccgagcctccgctcatgttccgattttccctgatccgaccgatagcaaaaagtaaaagtatctgcagagtcatgtatacgtaaatatgttgtcatgttccatgtaaataaaaaaaatgatcacactgtagtcacgcaaatgattaatctgtcatgggcacgagtgggtataatgggccgaaaccgaaaaaccaaaccaaacatatcgagaccgaaaactcagtccaaaattcgggtagcaactctcactgtccgaatttatattgtgtttgaaagtgagtttgattaagctattaactcgtttaccgtgagcatggttcttacgctactaaacggaatgatttcttacaaatatttttttatataaaagctttcttaaaattaaataaatttattttcaagtatgtagtaattaatacacaattaattatatgataatgacttttttacgtgccactaaaatataaaccaaactgccgatttaatggtcaattcggttgtttgtctcggctaacccaaatattacaccaagctgctatcgtggtattgctatgatgctatcttcacagtttggtgtgttagacattgtattattgtcgatgggggatacccataaaccggatatagagtgtattggagtccgttggtacgagaatctacgtagtacgacatcaagcaaacgtaagacaaggattatactagttcagtccccttagtaggtagtatccctaatccagttggtataggattatatgatggaaaccactgattacaaagggaataacagaactcgatgataccgacgagaccgtagtcgagttggttcgactagatctcccggtgacttggctcctgtaggctctggctccgtaggctgtggtaggtgtgttggcggggagattcgatgccttaagtcctgcctgagggtcccttatataccgcgggtcagttgatctccaagtagaactcggagatatcggacccctcacgatatggtaaaaacccaacctcgtccgagtaggactccacccatccgtagattctgcttctatcacgggatagatttccttgacgtacacggaaactatccatatacgcgcgggttatccatgttagtatacaacatatattaaggatagagggtatactttatccataaccctaacaattattatcttgtaatattttactatgaaaacattggtccaacttgtaagagaggcaatgcttccaacattcatttgtaatttgtgcaattatttatcagctattctatatatttaaatttggataaccaaaattttcaaaagacccaaccgaattgttcggtcttaccgattaccagtatcattactacggatttgaatcaggtgtagtcggtacgactacaacttatacagtcaagagggtgatagatccgaatccaatgttcaaaatacgtttgtagcccactatagcaaaaattgatgggtacttttcatcgacactgtagctaatgatctggtcaattcataaaaggatgggatatctcctattgtgtatagtaccttaccttgcagtcctgccgtgttctttccggtgagtttctaactcatttttctcgtttttcgcgtgcacgtttttcaaaccgctaaatggtacgcgttttgtaaaaagtttatatatgaaagttgctttagaaaatcatattattttatatttaaaagttttttatagccaatacttaattaatcacgtgttaatctgtcgctctgttttcagtacggaacaaggagttctcaaccccttcgaaagaacacaccatagtgaaaccgcagggaatcccaatcccgttacgacacactgctgcattcggaagagagcagtggaagccggtcgactcaaaacttctttattgatgcaagcaccaacgagtgcttctccggagaaaacgacggtgacgggtggccgacggcgcgggtggagtgagctgctgagccaatcgagtcggcggccgacggggacgcgaaccatcttatctcatctcacggcgacaaggtcgaggccgtacccgatcggccacagcacaggacgccgcgaaataatgctgtgtaatgctggatcagtcaagtcgacgcccgcgctccccgctgctgcaagatgcatggcaccttcttctcttcttgactagtactgtgaagaccaagggcaggactgactgatgagtgaccacttccacttgatcttttcaaggaataggacggcaatggccttctttagatcctccggggttaaatagctatataaaatattgctatttaggagtattaaacataaattactgacaaaactcattccataacccctggactattttgcgaga

SEQ ID NO: 28909 - DNA, 18227 bp, Oryza sativa
aggacatatcgcatcctatgttagattgaggctgtgtttagatctaggggtaaaattttttgccttgtcacatcggatatacggacacacatttgaagtattaaacgtagtctaataacaaaacaaattatagaatccacctgtaaactgcgagacaaatttattaagcctaattaatcctcattagcaaatgtttattgtagcaccacattatcaaatcatgaagcaattagacttaaaaatttgtctcgcagattagccgcaatctgtacaattagttatttttaagcctatatttaatacttcatgcaggtgttcaaacgctcgatgtgacaaggtgaaaaattatgaggtgggatctaaggcatggtttagttcctaaatttttttcccaaaaacatcacatcaaatctttggagacatgtatggagtattaaatatagataaaaataaaaactaattgtacagtttgcatggaaatcgtgagacgaatcttttgagtctaattagttcatgattagccataagtgctatagtaacccacatgtgctaatgacgtattaattaggctcaaatgattcatctcgtggtttccaggcgagttatgaagttagttttttcattcgtgtccaaaaatccttcccgacatatggtgaaacatctgatgtgacacccaaaaattttcttttcacgaactaaacagggtttaaaacatggcctgaattttttgggttagggtgtgtttagttcacgccaaggcctggtttagttcccaactttttcttcaaacttctaacttttccatcacatcaaaactttcctacacataaacttccaacttttccgtcacatcgttccaatttcaatcaaacttttaattttggtgtgaactaaacacaccccaaaattagaagtttgattgaaattagaatgatgtgacgaaaaagttgaaaatttatgtgtgtaggaaagttttgatgtgatagaaaagttggaggtttaaaaaaaaagtttagaactaaaccattccttacagggagcatcctgctgctgttgctgtcgcctgtgtgtgtgatgtgagcacctctcatttgctaccatgttcacgtgctagcacagcactagcttagcaatgtgtagcagcagcacgccagtacgagaaggtaaggtgtgcgaaccgtgcgagacttccactgtgaatatgtgagaggggcaatggcatatgggaaaggagacaacacggaactgggacaaaatctactagggctgtgttaagttcacaccaaaattgaaagtttggttgaaattggaatgatgtgacggaaaagttaaaagtttgtgtgtgtacgaaagttttgatgtgatggaaaaggacacgactacgcgtcggtcgtccgacggggagcggggaaatcgggcgctgacgtcaggatttatgtgcaaaactattttaaactgatttttctcttaaattaattatccaaatcatgatccgattgcactattaaatttgttgcaattaaatcttttaaacaagaccacacatggatatattccgacgaaaaattttatttagcttattattgaattatttttaaatgttgcacgatatttcaccaagtatatcggaattgtttcaataagcacatcgaaaatgtttcactcgtttaaatcggatgttgtttcaccttatataaaaacaatgtttcagcaaatagcgaaagaatatttcagttcactgtaaaattagatctatacatagtgaaatattataagtacactaggtgaaacatttttcggtggaacaacaaataaaatgaattcccttaatagggggttttcaaaatatatgggttttctattgcaatggaatatttcagttcactgcaatattagatctatacacagtgaaacattgtgagtacaataggtgaaacatttttagtagaaaaaaataaaccaaattcccttaatagagaggttctaaaatatatgggtgatttgttgcaacggtagataggagcatagacatggtggggccaggcctgtatgcagcgcgtggggggaggggcgcgcccgggggggggggaggggagcgcccgatccggctaccctcgcgctggacgaccgggtttaatcattctcgggaaaaattagaagtttgaagaaaaattttacaactaaacactgcctagtttgtagtgcatagggttgtgattgtacctgccgggttcccatttggagggtgggagagagtgggagtgccagtgcagttctatctccccatgtaggagtactacaattccacgcatcaatacgcacaagccttcctatcataggctcatagcccattctctctcttctcaaaatatacttcatccattttatattataattctctttaaccgttttataaaattcttttagtttgatcaaatctctactataataaaaattaaagatgtttttaccggtattttgatatgtcatctttatttgagtcggtttttaagtttgttcgcttttgaaaataaagatccgtgtttgagtcggattttaagttcgtttgttttgggaaatataaaaggagtcatataagaaatctcttttaaaaaaaactcgcatgctaacttgagatgaaagttagactcttaattgcagctcatgattttcttaaaaaaaatccaagcgaattccaaaaataaattttatcctagctaaaccgtataataataataagattaaaatagcattcaccggttgaaacgcatgggcattttttcttgtgtatagaaaaatttagctttttctgtaacaccaaactactttcattagatgtaacgttgaatatattttgataatacgtttgatttatgtagaaaatattactatatttttctttgaatttactcgaaaacttaaagtgacttacaatatcaaatggagggagtagtaatctaggactgaatgagacaaatactagtgtcagggttacgagtaaggtgtaccctctacccttcgatatacgtcatatatcgatatggtatatttgcgcgtatacggacgttttcggcatacgttaaggaaattcattatggagttcacagatggaaggagtcctactcggatagaactgggtcgtcattgtatcgtaccgggtccgatgtctctgagtcctacttggagaccagttgacctgcggtataaaagggaccccccgggagtacctaaggcatcgaatcttaccgccaacacatccaccacagcctacgaagccggagcctacaggagccaagtcgccgggtgatctagtcgaatcaacttgactatgatctcgtcggtatcgtcgagttccactattccctttgtaaatatgtggtttctattgtataatcccatatcaactggattagggctattacctatcaaggggcctgaaccagtataatctttgttttctgcctactcgatgtcgtattacgtagatcctcgtaccagcgtaccccaataccctctatatccagtctacgggtatcccccgtcgacagtggcgcgccaggtagggggacttggtgctcaagattctactactgtgacatccagcttcgtcgacaacagcgtcaacaccaacctcaaccaaggagttcctacttcaacgatgctagtgtggactcaagtcggcgaaatcgtcttcccggtttacaccacggtgccgatctcagctggtccatcaatggccggaaacgagaacgcagtggctacaacccagaacgattccatgtcgaaggatcctcccgctgaagcggagatcggaacgtcgacgacatccgagcccgagaaggatcctagtgcggccaaaccttgcctttccgacaagaatcacgagccgacgaggatgacttccgaggtgacaaggtcctggtgtcctatccacaaaaccagaaaacacaccttgcaagcctgttgggtttttctcaacgtccacgctgaaattcgtgcctgcaaagagcgtggaattcagcgtacttctccaactcgtgatgtctattgtcctattcacaagacaaataatcacgacctctcaagctgcaaggtctttctcagcgccatgaaaacgtcacctcctaaggtccagcagtcacacatctccctcagggatgaggacaaggaacaaggagcgacgctgatttcagatcgaatggttggggtaatcggcatcgatccccacgaaccatcagtcttgtacctgctcgaagactatggctcatcgtcaacgagtacgccgcgcgaggtattggctatcgacgagaccggcacatcagcgcgcgccaatgcggaagcggagaatcaagtgactacaccggcccagcacatcagggccgtcaacgtaatactgagggaaaccccctacgatcccgttctgaacgacgatcttgcacgatggacagaacggttacaggaatcagtgaccaacccggaacagccaccaactggcgatgctaatggtgaaaaccctgaacagcgggaatcgcctcatcgagtcacccctccacctcgcggcaccggcgatctccgcgatcacctgaatggccgccgagaggcgcgacgcacacgagacaacgagaaccgttcccgacatcgcgtctcttcacagcgtcacgataacgaagaacgaggaggccgttcgagcgaagaccgagaccgtgataaccgccacgatcatgacaatcgcgaacggcgggtgctgggcgatactggtcgaggacgtcgccataatgatgacgatgatggagatcgccaccaagacaacaacgggagacgatgataagattctcgagaacccggccgacgtcctcataatcgtacgccggagccaagtgacccatcgtcatcgtcgtcatcttcctcatcctcatcatcagatagacatccacgaaggacgtacgatcgccgacaacccaccgcccccagcgctgggtgtagagctttcggtcgttcacttcgagatgtccaatggcctgaaagattccgaccaggagcaatagagaaatacgatgaggagtaccgacccagaagaattccttcaggtttactccacggtactctacgctgccggagcagacgacaacgcgttggcgaattatttgcaaaccgcattgaaaggctctgcgcgttcatggctgatgcatctccccccctactcgatttcttcatgggcagacctgtggcagcagttcgtcgccaacttccaaggaacttacaagcgccacacgatcgaagacgacctacatgcgttgtcacagaacccggatgaatccttgagggattatgttcggcgctttaatgagtgcaggaatacaatccccgagatcaccgacgcttctgttatccgcgccttcaagtccggtgtcagagatagctatactacctaggaaatggcaacgaggcgcatcacgactactcggagattattctaaattgtcgatcgatacgctcacgcggacgacgcactgagacgcaagaatgacaaaccgaagaccggaggagagaagaaaccagtcaaagacgcacctgagtcgagcaagaagaaaaatcgcaagagtgggaaaaggaaagctcaagcggatgttctcgcaacagaatacatggaccctcccaagcgcccagacccacaaggcagcgacacgaagaaaacatggtgccctatacacaagtcagacagacactctctagaagattgcctcgtcttcaaaaagtcgctcgcaaaacacatggcattgaaaaaaggcaaacgagtacgtgtggtcgagaaggacgctgaggcggctactcaggaatcggactcagcataccagactccgatctccatgtctcgcacatcttcggaggttccacggcatactcctcaaagcgagaatacaagaaggtggaacgtgaagtctattcgacgtggcagggggctgcgcccaagatgaagtggtctgagcagaagatagaattctcagaagaggaccaccccaagactgctgtcatcccagggcgatatccgatcgtggtcgaacccactattcggaatatcaaggtcgcacgagttttgatcgacggcggtagctcaatcaaccttctcttcgccagcaccttggacgcaatggggatcccacgaagcgagttgacacccaccgatcaacccttccatggaatcactcctcagtcatcgtccaaaccattgggcaaaattacgttgcatgtgactttcggccaagcaaataacttccgaacggaacagatcacctttgatgtcgctgaattcgatacagcatacaatgccatcattgggagaactgcactcgcgaagttcatggccgcatctcactacgcgtatcaagtgctcaagatgccgggaccgaagggaacaatcactattcaagggaatgctaagctggcagtgcaatgcgacaagcggagcctcgacatggtcaagcacacgcccagcccacccgtcacagctgagccacccaagaaagtgagcaaaacaaacaagacaccgaaaccggacggcgcaatcaagatcgttccactctccagtgccaaccccgacaagaccgtcaagattggggcatcactaggcgagaaataggaactcgcgctcatcaccttcctccgcgacaatgctgacatgttcgcttggcagccgtccgacatgccgggggtacccagggaggtgcttgagcacaaactcatggtgcgacccgacgccaagccagtaaagcaaaaactatggagatttgcaccagatcgaaaacaagcatacgagaagagctcgacaagcttctcaaagctggtttcatcagagaggtactccatccagagtggctagccgacccagtcatggtgcggaaggccaacgggaaatggagaatgtgtgtcgatttcaccgacctcaacaaggcgtgtcccaaggatcacttccctcttcctcgaatagaccaactggtggactcaacagccggttgtgagttgttgagcttcctcgacgcttactccggctaccaccaaatcagcatggcgaaagaggacgaggagaagacggcattcatcacgccgttcggggtattctgctacgttaagatgccgttcggactaataaccgcaggaaacaccttccagcgcacagtccagggtgcacttagcgaccaactcggaaacaatgtcgaggcctacgtcgacgacattgttgtcaagaccaagacaagtgactcattgattgacaatctgcgggaaacgttcgacaacctccgacggtatcgcctcatgctcaatctagagaagtgcacgttcggagtaccatcgggcaagctactcggcttccttgtctctggcagaggaatagaagcaaatcccgagaagatcaaggcaatcgagaacatgaagtcgcctacaagactcaaggaagtacagaagctaaccagatgcatggcggcactaagcaggttcgttgctaggatgggagagcgaggacaaccattctttgctctactgaaaaagcaagacaaatttatatggacacaggaagccgaagagccattcattgcactcaagcgctacctatcaaatccacctgtacttgttactcaagcgccactactttcaagcccacagggtcacagttgtatcctccttccctctcggtgaagtagtgagaaacaaagatgttgtcggccgcattgcgaaatgggtagtcgagctaagccagtttgatgtccactttgtgccacgaacagccatcaaatcccaggtacttgccgacttcgtagctgattggactatgcctgataacaggtcagacaaccaaatcgataacgaaacgtggtcaatggcgttcgacgacgcactcaacagccaaggagcaagggcaggattcatcttgacatcacctttgggagatcaattcaagcatgcaattcacctcaacttcagggcaactaataacacagccgagtacgaaggactactcgccgggataagagctgcagctgcactcggagtcaggtggctgatcgtgaaaggggattccgaactagtcgcgaaccaggtgcataaatattacaagtgcactagccccgagttatccaagtatctcgcagaagtcaggaagttggaaaaaggttcgatgggatcgaggtccgacatgtataccgcaaggacaacattgaaccagatgatctagcacggcgtgcgtccagacgagagccactcgaacctggcacctttctagacgtcctgacaaggccatcagtgaaagacgcaggcggcgaagatagcccggtctccctcaacaacagctcgggggctacagaggcagagcgcgccgttgccgatatcgagaccacagacgactggcgcaccccactcatcaaattcgtaggcagcgaagagttgcccgaggacgacgcagaagcctagaaaatatcccgtaaagcaaaagtctactgtatgatcggcaatgatctataaaagaaggcaccaaatggggtactcctaaaatacgtctcgtccgacgacgacagacatctcctcctcgacatacatgaaggaatctgtgggtcacatgccgccggtcggacattagtcggaaaagcttttcgagaagggttcttctggccaaccgccctcaaagacgcctacgacatggttcagcggtgtaaagcctgttcaatttcacagtaaacacacagggctaccaacgcaagcactccagactatccctctcacttggccggttctggtggtgggggttaaatatactcgggccattcccacgaggacagggcggctacagattcctattcgtggcaatggccaaattcattaagtggatcgaagcgacacccacgggagaaatcaaggccgacaacgccatcaaattcatcaaagggatattctgcagattcggattgcctcaccgtatcataacagacaacggctcctagttcatcaatgccgatttccaggattactgcatcaggctgggagtcaagatctgtttcgcctcggtttctcaccctcagagcaatgaacaggtcgagagggcaaacggcatagtactacaaggaatcaagacccgcgtctatgacaggctcatgtcacatgacaataagtgggtcgaagaactcccatcaatactatgggccgtgcgtaccacaccgacaacgtctaacaaggagacacccttcttccttgtgtacggctcagaggccatgctccccaccgaattacgacatcaaagtacacaagtacagaaatattccaatgaggatcaggaggaacagcgaaacgacgatgtgaatctactcgaggaacatcgcgaacgagttgccgttcaagcagccagctaccaacaggcccttcgccattaccacgagaagcgcatccgagcacgcacactttcgatcggcagctacgtcctctgacgggttcaaagtcaagcagggcgaaacaagctctcacccaaatgggaaggaccgtacacgatcacacaagttctgcggccaggcgcattcaaaattgcagacggtgatggtcgcgagttgtcaaattcctggaacattgatcaattacgtaaattctatgtataagtcaatagtatccatgcttgtaagacatcttacagcttcaataaagcctattttcaggtacagactacaatcaaagtgttccttcccgatgatcccttacccagatgacacctagtgttgaaacctatcctcatgtccctttacgccgtcttgacaaggcctccgaggaacctaagggaacttcggctggggacgcccagagccgataaggccttgtcggatcctatagagacgaaagaccatgtaagatctggtcgtgtaagagttctcgccgtgcgtattaaccaagccgtgtaatcggaaataaactttccaacttcacggctgggggctaggatcaatgcttgttcaaccgaggcaggtcaaaggtccaagagccttatcttccgagaagaattctccgatgacaaggctgggggctagggagagtgtataactcaaacgactgatcgaagtcgcgaagtgagaagacactcatacacgctacatccagagtaagaaagcttagttagatagatttcttttctatttcacaagtacttcttacaattctataaaaatccaaaattatattaaacttttcccctaagacatttgtcacaagacacggagaccttttccgccagcggcgccatcgacttcgccaggccatctatctccgtaggagttctccgagaacgagaaaacccttcgtggaggaactcgaggtgcagctgcggacgatgatctcgtatacaagccaatacatgccccccggcatatcagctcgatcgacgacactcctgcttcagggccttgtcgatacactggtcgatgccctcgagctgggcgcaggccccattcagccacgagatgtatccagccgccgattcctcgggatccccacggggtactcggagctctctacagacccttgacatggaggtgcagcaactcttcagatacgagttgaaccacacctcgcgaccccggagtgtctccacggcctggtccttcttcacttccagcatagtcctctcgagttccgcgacctcaaacttcgtcctccaatactgggtgcgacggtcctggtcagcaagcgcactctcgaggtctgctcagcatggaaacgactaagtcaaactgctcttctctcccgagaatacagcaaatcaagtcgatccagacggaagagtaaaggagatgaaaacgaagataaccaacctaagggagtcgtcgccatgcccgtttccacagcgaattttgagctacatcgccctccggcacatgtggcccgaacacaagtgccggaacgatcactggcaactcaggctgcccgcgctgctgaacatcctcgacatcaacatctctacaaacgacaacaaagtactcaagatcaaaatgctaaagaaagctaaggcgatgactgcacacacagaggcggttggaaccaatgaaagttttacaaagcgtgactaaagagtacaagagagtcaaaatcctactcttcaaaaagtgggagaacagactcccccagatcgccgacttcttccatcacatctttgcgcgcgtcgctagccgccccctgatccaagatcttccgcagatcgagttcagggtgcgccagcctcacacacgcaaggacatggcacgccccggtatagatcccgttggacgtctcctctccgatcctagccgcgtgcttggaggggatctcctccatcgccgtcgcaagctccgcaagagaagtcgtcagcgagaactcatcgggattcgccgggatggtagacttgataccgcactcccggcgagctggtgcagaccagtataggtgacccgcaacgagccacggatttctgacaagttgttctcaagctccgacatgcggtgctcgagtccctgccgttgtcgctcattgccggccaccagctccctcatcttctagaggtcctcgcgaatctccgccaaatcgtgcgccagccggtcgacgcgctcattcgccgacgacaccgccgccgcgagcaccagcctcgaggaggcaccccatctcgacctagagctcctcccaggtgaggacggcagccggcggaccacgatcagccacgagatcgctggctgggccgctaggtgtcgcctcgcggctcctgggcacgaccacgacatccatcgaggccacagcaggagacacgctggaggtccccccagacccgtcttgcaccgccttcgcccgcgccgccctgcgaaaggctacaattgagacagactgcaagagtttgacgaaatcacgaaacctcaaattcattcacttgcttctcgccaagcgtcacaagccgctgccatcgcggaggcgggggagacgcatccgaggcctggagtgtaacgtatatgaggtgaggtggaagttccccgactacgcgacgaaggaccaggagaacttactgagggggtgggcgtcttccgacgatgtccgatcacagaggagaatttcctccccttcttcagaacgttgccgccactcgttgtggcagcaccgtcagacgcctccttggcgactttctccttcagcgacgccgccacctgatggtccacgagcggcccgatgatgtcagtcagagggagagcctacgcttcatgaagtcataatgcgatcccggaagaaaaatgcaaaaggaccgctgagtacacttacattgatggcagcttcgcgctcggctgcccctttcttgcaaagggggacggggacgttgctcaccattgtcgggccactgatcatcagttggccgacgcggcgctccacggttgcgctgtccaagcctgtagatcgagaccagaattcgataagtcaggaagaacacgcacataaggtagtcaatttaactaaaaataaaaataccccgaggagaaacctgggtcgcgtcctccggcccagaataatcaaaggctgggtgggctcgagcctggagcggctggatccgcctaccaatgaagtcggcaacgatttcataccccgacaaccaccgtactcggaggtcatcaatgatatcgatgaaagattggaggaatggggtcaaggcgggtttggtggtccaagatgaaatcttgtctggttgctccttaggaacaatgaagaccagatctaaatcttctatctgaagatagaaccacctcccctgccatttgctgcgagatgaggggcactggaaggggatgtatcgcgacttcaggccatcccgaagtcggaaaccgacacatccgaacacctttttgggttccatctagcgcaactcatagtaaaagcggaagaggtcaagaaacggctctaccccaatgtaggcctcacaaagatgcgaaaagatactcaggaaggcgatggaattggagttcaaatggagcaaggaaaggctgtagaaattcaagaccaagagaagaaattcagaaggcggaggaagaaagccacagagaatatagtcctcgatcgcaaccatgcgacccaggacaggctggggttcagtacctcctgcttctctctccatggtcccgcgatcgggaagggcgccatcctcctgcagcttcttcagcgacgcgctggtggaggtagacttgtcgagatccaatgccgccggggatcgccggagaagacgagggacgcttggaggctagagagttttttcacaacaggcggactttaaattggatccccaaaactcccttaaatagacgcacttccgacggtgcgaattccaaggaaaggagagagatggccgccggaaatttctgggtccattacgcgcggcagtttttcggacttcaatttaaattcactcatgaccgttgagcttcacctggcgttgtcgatcactccttgtctctcgatcctcacaccgagaatgacgacaacctcgacatcagaagtcgcgatcggtttcacgagttcatttaagcagaagtcgggggctactgtcagggttacgagtaaggtataccctctacccttcgatatacgtcatatatcgatatggtatacttgcgcgtatacggacgttttcggcatacgttaaggaaattcattatggagttcacagatggaaggagtcctactcggatagaactgggtcgtcattgtatcgtaccgggtccgatgtctctgagtcctacttggagaccagttgacctgcggtataaaagggaccccccaggaggacctaaggcatcgaatcttaccgccaacacatccaccacagcctacgaagccggagcctacaggagccaagtcgccggatgatctagtcgaatcaacttgactacgatctcgtcggtatcatcgagttccactatttcctttgtaatctgtggtttccatcatataatcccatatgaactggattagggctattacctatcaaggggcctgaaccagtataatctttgttttatgcctactcgatgtcgtattacgtagatcctcgtaccagcgtaccccaataccctctatatccggtctacgggtatcccctgtcgataactagtactatgagtctgaatagatggtatgtcataatttgtagtattagaatgcaccccatgttctaatttgtaggttactatattttgagagttgatggacatacctactcacactattaggttgtgtttaatcttatcctaagttaatttattttgaaacacagagagtacattttaatatctatatctatacctatttaaaaaataggtaagacttcgggatgatatttttcgtaagttatttatctagcgttgtcaccacgcgccagagtacttcgttcgtgtaatttggtttgatcatgagtccaccggaacaattaattatccgggctttgccctgactctttccaaatcaatcgatctacatcctaggatacccagatacggctcacaagccacgtatccatatcggatacttcatcggatacgtatacgtatcagatacgctccgatacgtatcccgtacgtatccctaattaccacgatataaaataaagaaaattacttggatacttctctgatacgttcccaatacttctgaactaacaaacccacgcacgcagcacagaagcgcagatcgaatcctcctgcagcgccgcttgcatcgctaccaggggcacactgcacagggcctccacgggttggccgccgggttccgccgccgctcgccacctgaggagcagggcctccaccgccagccgtgcgtcacgtcgccacccctggtcccctgggcgcagggcctccgccgtcggtagtcgcggcatctccgtcaccaggcgcagcttctccgccggctaccaagcccaacgcgtacagtccatcatcaccggctatttggttctttccccttttactggttgttttgttatgtgtttttccttgttatttagatccggtgaattttagaattggaagcttaaccacttatctagcactagtatgtactgctagcgcggctacagattcatcagggtcacttgtgaccaggcatgggagcatattatttacaaggggcaagctacatgatgagcttgatctcctgggatagtactattaaaagatctggtgcatgagacctgtctgggatgtagctctttcaaccacatcgctggctatgaatgcaagcagctcttgaacttctattgagttgaacttatatccggaacaagttttattctaattatctctaatgatgtcatgtaatttgtataactctatttgcaggcttatagttatttatgtgttatgtttttcctttgtattttttatttttttaaatatatatagacgtatccccgtatcggtgtttttaagaaaatgacgtgtcctatccccgtatcgcgtatccgtatccccgtatcagggtaacatagtctacatctatgaattaggttgttctcatgtgggctggctaggcctgtcttgcactgggctatgacactttctatttctaaaccccaaggtgtgattaattacttaatcttctaggtctaaggttaattgagtaattatcctttcttaatctaattttggttcgatggatccatataagagcatattcaaggccttggtagaggcttttagaaactattatcttatcttataataatagttgagacgataaaaaaaacttacataattaatacactaaaacaatatttcatttttttctttccttttcttcattgtcatacaacgaaaattcattttataagcgttaagagttgatattaagccgttgtaatgcgtaacaacactatgtttctctctttcttacatgttagcaaagttaccttgttaacaactataagaatctaacattgtacatgtcctaaggcgttgtttatttcagcttaagattattataatcgattattgagccagattactataagctagattataataagccggcatagaataagcggttagctgtttgtttctctggattattagttgtttgttagctgttagccacctaataattaaaaaaacacctttagagtggattactatcttatagattgtaataatatatcgtaatgagctatatgtttatttcagtttactcctaataatccagattataataataatccagattataataatcctaagctgaatcaaacagggcctaagtctattattggttgggttggttgggttaattagcctgccaatgttatggtctgatgctaactaccttcatccaacatcctacttcattacatatcatttcctttatttatgctctccattctgggaattatgtaataaatgcttactttatttatgctctccattcagtgaattatgtaatgtaatataagtggttgtagattttttaagcaaaggctaggaatttttctattatctaaaatatcatttatttatttgtcatcttacatactttaaagaaatcacaggaaactattcgtatcaaatttcttttttttcaccaaggacgatggatcccacgcaagttcaccggatttcacccattgcaatgcactaacatattttttagttaaaaaagaaaataatacatcttaaaagcattaaaacatatttttcacaaaacctttggtataaacccaggttttactatttgtttcattgaataccagatttaagataaaatatttcataaaacacatgtacaacattatatcgtttatttaactaatatattttaatcgattatggtttgattttttatgtatatattttaaccgattgccaggttgttaactattaggattatcaagttttatgagtgcaaaattgagaatacatgaacggtagaaaatgcatgtgcacttaagagcccactaatgtgaattcatgtaaactaatcatatataataataaaatatgagtattttatataaatataaggttttaaataaatgttgttttaaaatataaggttcctcaaaataaatcacaataactgaggttgtgttacctacggatgccccaacacctaagattttgtgaaatttactcttaccgttaatttgcttctttggaaatctgcaagtgtgaactttgaagatggatgctagtatgctatccaactgctttaccaaagagccaataagatgagtcattttcatagtcggtagctgctgatgaataaacctatacagaatgaaatatcccctaaaataacgggggtacacaaataaaggacatgggggtgtctgttcttctaagcaagggagaagaggtagcaaacaacatagctacacatgcctttctcagccaatttccatgcttttgaagctatacctaaaaaaaacccatccaatgcaataatagcattagttctcacaaatatagagcatatccaggcaaaatttcaagatgccatctcttcaaccttttttttttctagcttcaaaaatggggaaagaaaaagacaagataagaaggcgattgaatgatcatgctgaaaccagcctccaccacagaactatgaaaactgaaattgcatccttcagaggccccccaaggtgctgaaagcctgaaatatgtataacaaaaaaatgaaaaaaaaaaactggcttattaatatagagaactatggccaattacatgcaattcagtaatagacattcatgcaattacagaattgtttcttttactagctgccacatatcttattccatgcacctcaaagttatccttgcaaattcaccatttactctatgcaagctcttaaataatcgagagggcaacctttctaatacctctgtcaagaaacaacaatagataaaacgggaatgaatcgtggaccatggattgcatatcctaccacactttttagttgttttttttagataagggtatttttgcctggcttctacatccaactggaacttagccctgtaaacaacccaatctgaaattcactcctatggagatttgaactcagcacgttgggatgctactcaggtcactgcaaccaataggctacatgccctcgccccacattttttagtatagcaaaaatttgagtaaaagggtaggcagttcacttacattcttgaatactacatttgaaccacatcttcaccagcactt

SEQ ID NO: 28910 - DNA, 1091 bp, Oryza sativa
atttgaactcagcacgttgggatgctactcaagtcactagcacccaatacgctacatgccctcgccccacattgtttagtatagcaaaaatttgagtaaaagggtaggcagttcacttacattcttgaatactacatttgaaccacatcttcaccagcacttgaataaaagagagctaacttttattttctcgtaaccattcaacaaaattgtccaaaataagaggccaggcaaggtctgaatcataattgtcaaatgatgggaagtttatctgcagtaaaaaaggataacatatcagcagtgatgaaaaagaaatgtgtaaatttggtatgagcacttcaaaagcatgttttagcctcctggaaaatgaaataagcagggaacaaaataagatggtatgaaacatgacctcattgcagaaacgaagaaagcccatccactggtccatgtttatcaccttgtattcactttggtgctacacagtttcaaaacggtaagctgttaaccattaaaagtcccacagaagaaagggacctacctaatgaaccaaaagtataatcaatcaataccttgaggtagttaacaagtttgtcaacctgggggcgaaactgcaaccccaatactagattcagcagctcacaagcaactggtatttctatacacttcttcttatcctctggccaaacataaccaaagataagttttctatgaaatgaaaatcagtaaagtgagtaaaatatatcaagcaataatacctgtcaggcagtaacgaaaggcatatggatagaaatcctggaaatttgatggccttgtaacctagatttgtaaagcagattacattcaattacaatataaccaaactcatcatcacttataatgacaaaattattttaatacaatcacaagttgcaacattggttatcgcataggacagtattccctagcaatagcatgataaacttgcaagccttgctactgagatcctatcctagaaaactctatataggactaaccaccggtaaaatatagcatcttccaaatatatttcagtatccattaatatatttgaagtgaaaaaactcacttcttgc

SEQ ID NO: 28911 - DNA, 47313 bp, Oryza sativa
tcatcagagcaggaaacaaaatatgtaggcaaaaaattgacagaataaagtcgatataattaagccatttaaacaaacctgtatccattaagtacaataaaaagcttgaagcatgatctcaggtaaaagtgacaatcattaatatgacaaacagtcaagagttaggaggtaaacccaccgatacaaatatatttggaagagaaaaacaagcatccttgttagctggagtttgatttcaattgttagagtgaactccacagcatatgtgctaaagaatccaactcatcattgtgttgagtatgtaatattctcagggaattaatcacatattatgccacgccaattccccaaattcccaaacgtctatatttatggcaacacaaaattaacttgatcacagtcggttaatctggcccttggatatcatgtagattcgtgctgcggctatcaatgcttgcatttaacagtcatttgatttgctaagtctgtagctattcgctctgtactacgaccctgctgcccctagttatacgttagtttctcattgaatttgcactagcatcttctatttacatctacttacatatgtaattttgggacttacattgtaaatacactcactaaaattacatatgcaatgtaatttagggaactattttcttcatgttttatatggcggcataaatataggtagtcccattcccaaattgtgcaaaattagttggtacatgtaacttatggttctactgattgtagccacctagctattacaattagagtcatcatgtgtcactgtatatgtttgtattttagttgcacttgaaatttgaaaccattttgtagaatgttatgtctgccaatcagcatctcattttgtacttagctgtcaaaatgcagcagtatcagcagtagaggacactaagattgaaaatactagttcagcattttaacaaattagtagagcatgaaagatagcgcatctacaagacagaagatggccgtgatgagcagcaaaaaataatgctggcaaaagagcaaacatgggtaaaaaacatactcaatcatgcccgatgagctgtcagcataggtatagaaaagttggtcgatccgttcaatttcctttgaaactcccctagttgtacctgatatgataatgaaagcgtgttaacctaaacagacatattgtttgctgaagatcactgtatatctctatctcttaatggtacgaagataagacacaccatatattattattgcagaacttgcgacaacaaaagatatgcatgcatttggtagttatattatttcataataatagcctttaaaagaaacaaactcagggaaacaaacaatagcttgacatatatcagttagctgaataacattacaactgctgcaagatttcactaaacaagtaggaaggtacataaaaatgctgccaagtcacatgcatatgcaagaattactccagagtttaaaaatgagtaatccaaaacagtctgtaaaggtaagaccgacaacatataattctgaaatgtccaagacaatatgtattcacatatgtttgtgtaggaagataaatcatccagccacacccaccgctacattattacacccaagatggataaatacaaacaattagatgagtaataacagaaagaaaaggaatcagttcatctcaccacattgtgctttcctgctggtcaggtttgtactgactccttttctttttctgttttttttttcatttacttgtacatcacctaaatataaccgtttgtttagtattcattcaagtatgtataccctcagaaagagaacaagggatttcctaagctcacgcatttgaaaaacaggaaattccaacaagaatgtcaacccataaaatgcatgaatcaaagccagctaagacacaattagagctagtgacaaattttaccaggaacttccactaacacatgattgcacggacaactacccaaccagtcaaaacaggcttttaaagtaacatcatagcattgaaaactcttaaggcagtgaattctagacatcatctcatttttattggcagcctcttccaatcttcagttggcatcacaactaatcgctgatattggtgttcatctccattaatttaattatttagggatagcttcttcagatagaagaaagtttttgcactttgttttacctcataacacttgaagtggttcacataaactaacgtaattgtaaatttgcatcatggaaacataacgcagaccgtaatattttataaacagctcaatctaggcttgcttacaaacaggttcagagcatggccggccaccctgccaaattttatcaagttcactacaaaaataaatccgttaacccaggagcaagcctacatcgaattccacatccccaatctacacacgacccccatccaatccaatctcgtacacgcgcgatccaaaccccaacaggccaatatatcatcaatcaacacgccatcaacgcagcataaacctagggcatggcagggcagagtccatccatcatcaactcgagattggatcttcccccgaggagaagagcacagaaccgaccaaatctcgcagcaggcaaagcaatcgggccccgggcccggcccgacccgccagccccgatcatctcaacaaatacgagagagaaagaggggggaaacggaggatccgagggcggaggagggcgttaccggcggtggccgccgcggcggacgacgacgacttcttcgaggagcgcctcatgacggcgccgcgccgcgccccctcggatactcggttggatcccccctcccctcccggagcccttccccacagcagcctcctcctccgccgccgccgccgcctccgccgccgcgcgggtggaacgcgcaggcctcgccgagctctcggcttcggttgcgagtttcgagttggctgtcgagcagaagagaggagaggagaggagggaggcggaggtgtgggcgcaagtggaccctcgactcttataggattcggcccgggggcaggcgggctgggccccacgtgcgggcccggccacgacgatacctgtgggcccccactgctccccttgggtttcctggatttggtttttgggatgtcgagaaatcggatttcctttcctttccatttcgctttgggtagctgaccggccttgtaacatccattaaaagaaacgcgttgaccatacttggaatgtcaagaggctggatttgtagatatgtatttttattttttcgaccgaattttttatttgtagtaatattcttttctaaaattaattaaatagtaattctaaatagggattctgagaaataggaaggacgctagttagaagagcgtccagatgcggacgcttgggagaatagcgtccatcttgatacgtggtttgtaacagcgtccagctgtttgggccaaacacagcatgggcctgcgtccaggtgcatgggagcacacacagtaaaacatttatctaatccaaatctttgagcatccacgtggtgtttactgtgtaggttatagtacatataatttgtttagaacgatcttatactaacagatattgaacaaatttagtagttaatatcggtagtatgcatattggcttcggtcctttaataacgcagtagtcttataaatctatggatagtttgtagccattttcaaccaacagataatgtcaacgagctagctatcacgaaattccagcagcaacacgacatgacaacaatagtgcaaataaaaaaatccagggtttttcctcaattgcattagcatgcatttcattaaattatggtggattatcgaatcataaaaaaaaaggtcgaatagtatatgtacaaaggaggacgaaatctcaaagaggaaaccagtgagaaaactgaaaattggaaggaaacattgacatacccctaaattacaagaaagggctaattacacctcaattcagtatgcaacagaaagaaatacctatgcagactcccttcgtcagattatgcatttgccttttcttctgatggtcaaccaagcaaagaatttgcatttgcctccatgtatgtgtttgtaggtaagatatgtttttctgttgtactaggtagtcactccagataaaggtccaccgcactctcactgtttctatgactgttgaaccgtgcaaatcagttggtaaataaatatcttgaaacgaatttcaatctgaaacaaaaaaaaatcagttacagtgaaacgtctaaatgtcattcgatatagttccctgaatttatatacaaaatgtcattctaataatcagtttgtggagatgataaacatgcaaaagacacaggaagagccaagcatcaaggaagaaaccgtgttcactaactgaaggtgaagggcagcgctaaccacaaacatagctccgcaagaacgatggcatctcgagcatcaatgagaacgccggtggctgcgcctcagcgcctctcacagtcgagttgccaacggcctcgcacctaggactctatgatcgacatcctcaaccagacaacgtggaggtgggagaacggcgtccgcagaccgcagcctattggcgtagtgccgtagtcagcgtggagacgacggtgacggccgcctctcatgctttcacttaatccctccctgatactacggcggcggtggccgtgtcgcgagtgtgccctacgaggctgatgaaccgatcattgatcagttgttggccttgggtcgtagcgagggaggacgttgctttaaaccgcgtccaatcttggacgctttacataacaacgtccacatctggacactaatagggagggagtccttcctatttttacaaattgtagtttagatttaccacttatttaaatttactattaataattattatgaataaaaaaatcggttttttcgagcattcgtattcatgcgtttttctaatctagtcctcaacaaacactcgtgttaaatagtttgatttagtttattgagtcgatcattatcatgaattatttatttaactatagaataaatttaataataaataacctaaaataactattctactatgtttgtttttgtaagtaatataccggtacaaaataaattgtatttttcggagcacggagcacataatccgtttcagtaatccgaagaataatctgaaaagaacacggcaagtatcagctgaatccggatctcaaatcgacctaaacgtaagccagcaggccagagtccagacaatcgtctgctgctggctgctgcacgcgaggtgcaagaccagaggcaaaacagaattctccaacagggggacaaccagtatgtgacttggaagaagaagcaacacaaaccttgacttcctttcagacgtgaacacgtatccagttgggatacgccacgttgccgagtggaccagccaactttgttgttgactgcgatgttttcttttcaagacctcctggacttctcttgaccaactatttcaagaccttttggccacaaactccatgtccacaagtaccttggcacagctaaacagactccacaattgtgaagtggcagcatgagaagtccagtaaggctcactgggaatccttcggttgctgtccccaaactggagataaataaacgctcatttcctctatttgtatgtacgacagcatcatgtctgtaataggtaatctgtacatgtgaaattgatgctaccttcttttttacaaatggtatgcaaccacagataataaagaaaattgcagaaaagcagatctgccaaaaaaaatcccaccttttctgtgggagaaaaggataattgagccaagaaatatagaactgactttagatgggtactgcagagtcgggattcgcacgatttaggcgaactgtgccaagaatgtattcaggcagctctttctcttcctttgcctgaaaacatgaaacatattagcactcctggtgttacagtcacatctgcacccctgactcaacaaacccccaaaaaatactctttttcattagagaccgtgaacattgttagttgagtagactcctacatgaaatcagagtctttaacatttgcaagcaaagagtggaactgaaggctaggcatatgccagatatggaaaataccatactgaaaaggcgaattagccttagaagggggtttgcattgagatgcgctataaagcacactaataatgagaaattgtactgcgataatgtccttttgctctcaaatgttgggcaggggtggacacaatcgacgcaaaccgagcaaccaagccgaattaatcgagcaagggaagtgctttaaacatttatttgtgatttctttgattttttggatctcctgaatttggtcggtcactttggtcatgaccgaagaatgaaccgaaatgaccaaaaccgaatagttcggtcttcattattttgtaatgcatttttgtcttcatttttagatgacggaaattttcaatagacagaaagaccaaaccaaaatttttgatctggctgaatggccacccataatgttgggaatctccaatagagtaaatacaggatgttgtgcaactgctgttacgttacaatcggggttgcacaggatgtcagaaaatcaactattgttcacactattgaactccaatagacactttagtcttaaagcttagctagaagtaatggaggtatttgtagaatctttatttgtttaaatccacttagaaataggaaatatatgaaaaacaaaaaagcaaactgttgtttcaggtctgattttgcaggttcatacctcaattagaatagcaagatcaacaacaaggcctgtgacatatcccaggactagaccaataatgctccgtgcaacggatgaagaaccaatgtcaacatctatctgcaaagtaaattttacttgtaaggtcaccgaggatttttttaaaaaaaaattaatataatataaatatagtactcggtttttttcccaatttaaaacaataaaattataaaattgagagattcccgattatgcaaatctttaagtagcttgagttcaaatttgaagccaccatgcacagtagtccttccctctgcttaaatagatatttcaaaaaggttcaagattcaacaaagccaaagttcactagatcacctctagaaagttatcctggcgaaggtaattgcatgttactgcttttcccagaagacaagcttttgttccaactgcacgttttaccatccaataaccctgagatcatttatagttcaattcacatcaaaagtttgacttatcaccagtttcacaaatcaattcacatgcaagataataagaaacataaattaagtaatgcatacctcaacaatgcttggtataagtttaaatctggcatctcggaacgcatcggttccatcaatgaatcttcccaacagagaatctttattcacgggcctttctgctgcgtagtacatgaccaagttatagtttggcttcgctggaacctacatgtttaagagttaatatactatccatcctgatcatccatataacaaagatgatatcctcctccaatcaaataaaatgtgatagtgtggaacacaaaaatatactaacaaattaactgcaaactaatttccgatactggaagaaaaaactacaaacctagtttccagagcttatggtgttaagtcgttgagattttctgaatgataaaatattgtgcatagaagctcagagccattagatagtaaagacatggtgtacatgagacccccaaggtcacttccaatggcccggtttcatgaaccaaccattcccttttgagcccacattcatgtgcaaacgacatcacgttaatgagaatagtgaaaatgatggtacacacgagagtttacccaagtctatcaataacttggtagaggttacccatgtgtttcatgtgaaatttggtacatgtctgcatgtacagtatctctgaaggacagaaaaacctactgtttagtctgttatatatatcactatctattgagctgaatccgtagctttattcgttttcatttaatcggtgtctgttacaccattactttaattagtagagtgttgtcaaatagacagcgcaagactcgtgtcatgctccttttaaaagctcaaatgcatgtatgcaatggacggacgaataatccaaaaccataccatttcttgtgtacacttgtggatccacctctaaatgttaccttggttggataatccgtttaggcttgccggtaaattctccattgactttttatataaactactctatagtggagagtccgtacgttacaataaaaaaataagtggttgcattacttctttagaaactatatgagcaaagattttttgtaggacatcttgatcaaaatagaaaaatgttgaccatctatctatatactacagaaaatttctgtccaatagaattatattttgattttgatttttattttttgaaccttttcatttttttattttaaaaataaacccttccaaaacttatttccaaaatttgaaccttttggccacgccaacctgcctggcgtggcaaaacaacactaacacgctacctacagcgggtgtggcagttttgtcttgccacgctagcgagaccggtgtggccaaataacactgtcacgccatcgagaccagcgtggcagtattgttttggcacgctagttcggcttgcatggccaaaaggttcagatctcaaaaataagttttggaagggtttgtttttaaaattaaaatttcaattttttaaaaaaaaatcttctattttggtctacatcaaaactgaggatttctatgttgaacaaaaacaaacattagtcaaatgaaaaatatgataatgccatgtcaggaaacgtgagtagcatacaatatctagaccaaacattatggatttacaatacaattagaagttcccaggttcatggtggtaaacttgcttaagctctgctctctgacccctgccttccaatacaattaagaattacataatataatagagacctaaatataatacttaacacctcctttagaaaatcataagcaggaacatattccaatccatggatcaaatcactacaggaagttcactcattgaaggactgccatatttgtagctatagaacttttgactgtaattttgaactacctaattctcaaaataacaaattagttaatataaccaataattacctgcaagtttatgaccagtatgaagggaatcttctttgcagcttctgactgtaatgtaaatatgtaatgatcagaaaaatcggctgcagtatatggtcatgtcataaagttcagcattgcaagcaagtagacagcattgcaggccctatctaacacttcaatgtgtgttgagtttaaactagagttttgcctgtaggttcatgaaagaataatgaagcttacaatgatattaaataaggacttaatctcttcaaaataaataaggtattaatcttagccaattttattgatgaaaacgaaatatcatcataaagataatatgtaaaatcaaccattcaaggtcaaactagtgctaaacagctgttcttttagcttaattgtaagattaaaccccatccagaaatagaagcttaccatagtggagataattaatgccttattggtacggtctaagattttgattgaattttatatgattgtgattaaaaaaaaagatagattagaggcttaagagtacgtgtttgcagcaaagtcacaatccacaagatagtctaacacatatgactactagattatggatactgatattagaaattttgttaacaaggacactgaagctttggatacttctattggttgtgccaagaaaaagaatgaacaaggaatgtacagttttactctagcatgactgcatcaatactttgaaaggcatattgattctcagttacataaaaacatgatagagaaaaagctggttgcattactttgggatattggtggtggtcaggtaaccttttttacctgaacgaggctcttggggtgtaaggcaactgaatcaaaacgctcatcagccttaaaccaatcgacagcaataagctttagaaggggatcacctccaacaacctatgcaaatgccaaattaaaaccatttgataggtcaaattatgaaacaaggatatttctcagaaggagtaatataatgtcttaaccacaaaatattcagtgttatcttcatggccaattgggaccatattctcatatggccttgtcacaaaaggatgattaaacataaaactagtcatgcatcttccccgcatagcggtttcaactcaataaggcgcataaccaaatgctgggctggtatctgaattttttactggttggtctttggtaagaatactgatataccttattacacttcagactggtcaaaataaactaacttatccacacgataattattattctcctgacattttctaagaagttttgatatacacaccataatgtatagaataaaacccttctacttctttgaagcacaccattatgccttctaacttttttcaacaaacagagaaataaaaaatgtaggttatgcaattctctaattagtggaatagaaatgtagtactctgtcctaccttagtgtaatctgtcaggtaagtctttcctcttatcatgaacttctctccaccaggctcactccaagagtttgggtcattctcacttttcgctcgtcgaagggtgccatggaaatggtttgaatcaatagttaccggagttgaatttgtaaccaattcactcttctcaaccgaagctgcaggagaacatattagaagtaaaatcatagttaagaaggacagcttcctctgtgaaaaaaaagaaaagaaaagaaattcaaggacagcgaaatttcaacatgatctctggatttgagggtacatggttacaactatagcaaattagtgattcttaccgcccttctgtgtaccacatttttatcacctatgttctccttcacttgaaacaaaagggaacaagtgaacaagctttaaaaagacaaatgcccataggatatatcattctttagtttatcccatatgctttttggtagtactattttacttgattaattacaatttacaacatatcactttttctccttctccaatgattaccttaagatatccaaaatgactgaaatgaaccatgagaaatgttgtaatgcaagctagcaacttgcagttatgcattctagcaggttgaagagtaaaagatggcgtgctgcaatttccttcattttcaaatgattgtcaccattgactccattgttcaaactttaatcataattctttttagtaaatttataactagttcaaaataaaaaataaatattgtaatttttatgcatggcacacctaacagtatgattttccttcgatctaattaaatatattagatgctataattggtcggattttgcatagaagagttaacttgacagttattgaaaaacataaggaatattaactggcataattttttttacaaatatagacaaaggcaacagagacattgcatccactataacacagatgtgcacactttgtgtataaatgtcctttttgtggttgagaaactaatggtaaatgcatgtatttttttatcaacatactgtctaccagtgcttgaagagttgaaatgtctcttgtgtttacgattatgacctttagtcggtttcatagcaagacctgcgatagcccatgaaatattcttgaacttcacttttccagcctgtacagaaatttcataaggaaaccgagtctcaatttattactgaacataatataatacataacagtctgattgcataacgctgataaacaataaaatatcaccttaggaatcatatcatcatcgtcatcactatcctcatcttcaaaggattcgcctctagcaagtgcatcatagaattcatcattaagttcagaatcttccagttcactctggatgatcaaagaatcagactgtttgggcttcactactgttgaaggcaaatcagatgtcaaagctggatttgctgcaaagtattctcttagacctggccatatgaaatacaagggcatcattataatgtcctaaatggaaatagtattccttgcaataaaagcaaacctgaccaacctgctacttggctgagcaaagcaaaagcaatacttctgtcaaaattctcgttatgtcttctcttccatctatcccaaaaacttgggctcatttccaacatatgagtaacaaggcatttcggagttgatgatcctggtgggttcaaccttcttagttcccatgttgaggctgaaagaaatgttggaattaacaaattacaataaaatgtgaaaccctaattttttttccagttttgagagtgatgggcaaaaagttcttttttctcgaaaatgcaagagccatgcatttcatttcattaagaagaagaaagagtatgtacaatagagtgattcacaagaaacactctagagggaaaggaagaaaaagcctcgccgaagagatacgcaacaactctcacaggagctaggctcctaagtgggaagcgaccgggacaagagttcatggagtgctcttgccccagcagcaccataacaaactctcttgccacagcatccaaaatagcagtagtgctaggcgtggcattgctatccacccaagttatactacgacatactcaagttatctatgaataggctggtgtgatattgctatccacccaagttgattacaagtgattcattttttttttctgaaatactcatctatgcaactactgcaacatactctccggtcacaaaagaatgtcgttgtcgacccatgcagtcaaaataagtttactttgaccataattattgtttagaatataataagttttgggcatatgaaagttgcatagccaaatttctaataagaaaggatccatccattaattgtttggagaagatgagaaaggatggtaagtaataataaatgaacgcatatgatgagagaataaatgggggcatggtacgacaaaacttaactaactgagaacatggtctgaccaaaattttctgaaacagaaaaataaatggttattcctactctacctgcttcaagtcatcacaaaacaagctgatgctaagatacaggaccaacaaacaactcaaactcactgaatcatgctaaaaatacaaataaagtatgaaagatgaatcttacaattgatttttgtacgctcgtagccatgccttgaaggtttgttcttgtgacaagcaggaatctgcaaaatggctgcaccaaggggggaaaatgaacacataaccaactcatttgaaccataacacaaagtatatcgtggaagacggctgctatatgtgctgttaacacacttgacagctagttgccctatacattgaccacaacatgatttcttatgttcaaaaagcttgtgcgtcaaactgaaaacctaagggttctaggtttacttaattaatttataccctagaacctaaggctgagttcggcccccaaagttgggaactcactcccttttttttccgcgtgcacgcttttcaaactgctaaatggtattttttttgcaaaaaaaattatataagaaagttgctttaaaaaatcaaatagatccatttttgaaaaaaaagctaatatttaattaatcacgcactaatggaccgctctgtttcccgtgcgggagggattcgctcccaaccacaagtaacgaacatagtagcatttagatagctggtcactggttcataaagattgggcaatgctgatgcagaccaacccatcaaatttatacatcaatttgatgtgacttttgtgcactatctcatgtaaaacattatcatgtcacagttctttcagaaatatgaaggaatttggtcctcaactgatatcaactcaactacttcaaagtcaactccagtaaaaatgtattcctggaagcactggccagcacagtcctatcaatcttggtcgatattttttccctagggcatcctctatagccctactgacaagtgttaggaatcaattgattctttgtaggcatccaaccttcctatcagattcctcagtccccattttgctagtgattactagtattcactactgatggacatgccccaaggtgaccaccaccacctgcacctcacatcttagcacaccggattatgtacccctcctgctgtccaagttaaccaattcatttcctgttgttaatagcacctaacagaacataacaacacacggggaaatcaactgatacgtcataagatctagaaaattgtcaagtaatttgtattcaaagttgataggttgaattcattacatcatatttcaatctagctaggtgaacctctaattatatattttaggaccgtccatttaggagtgtcaaagagtagtagtagagatctaaaatatattaaaataaagctgtgatataataaagacttagtacttactatatgccccatcttgtccacgaaaccattgtctggaaaaaacaaaatccttctttgttttccacctgaaaacagtctccatacttaagagctgaattgacatattttaaaaactgttcaatcaggaatagcaacaactcttagctaatataagctgaagcttacatgtacaaatataagcaacatgcttcctaaaaagagcatgtcctatatcaagcttaagttgtccaaattccaaaagaggtctgtttgatcatgttcagacaacccttgtggataccattggtacaaaaagaaaagcctaaatatgtttaactagcaaatgcttcccccaaaacaaaaacagctataagcaacatgcttcctagaaaagcatgatctatgtcaagcttaagttgtccaaattccaaaagagagctatttgatcatgttcagataatctttatgaatatagttggtacaaaaaaaatgcataaatgtgtttaactagtacattaatttataatgttaaacatttatttcaccgtatgcagggaataatgcaaaaaacattgaattaaaaataccagcttaaatatctaggttcataggttccataaaccacgtcatagtatccatcaattgtttctaccaattccaaatcggcagtcagcatatcccacctgcacaggataatttcagtagagcaagttgtcaatatattgtagtacaacttgtatttggttccactgtaagtgtaaggtgcaatcaactgctagcttactcatatcgcttatgcttatcagagctgagaaccactgcaaatacagtatcaggattcgccccaaccacaccaacagacttaagaagtaccccttttccaccctacaaaagttaggaaatgatttgtatagataagcttttattctaaaaacatgtgaatgaaagagaaatggtcctatttggctcattcccaaaatcagccatttttttaaaagaaaagtttatattatgaaagcttggccaggaaaattagtagcttgtggtcagaccataatttggcaaagaaatgaacaacaataccaacaggcgcagacttttgcagcaaacccaatgtgatcaatctgacaaaattttggcaactactgtcttcaaaccaaacagtcactgaagcagcaactttgctgggagggatcacaactcattggatgaaagatgattatccacttcaggcatttcaatcattgaagaacagaactaccttgctctaattttgtactagggtacaaatgtttaaactgttaaaactgagaaacaagtctgggcaaatacacactatcattatgtatggagtatggggctgtctgaccaatattggctgctgcatagttggacatggagaaaccattgttacgtggcttgctccttgcttaatcattattgcatcataaagagtgggggcaaagacagatcaacaaccaagtaaccaacaagaacatggaccatgagaaaatggtgttcctctgttcttcccctttctatctccccaattccccagccatcatctctggctcttgcaattgatccctcagtcatccaggatcataacaaatggggataggttcatctaactagcaaagctacagcaatatgttatacatttcttacctttgtgtttgcaatatcttcaaaaattcttatacctgcaaaacaatcaaacacaaagaaaataagttcatgataatttggacatgattagagagatttcaaatttcatcattatatatgccctaggaattgaataatagacataaaggtaaataatcccacttggtcatgctagttaaaccatgtttagatatcttgattggctagctattttttcttaaatcaagttgcaagttgatgtatgtatcgtgttgcagaacatatgggataaaattgactcggtatcaatttaatttatccgatagatgttaggggtacaaactgagtctcaaggtcattaggacatagtgtcaactattatcctgtgcacttaagcaatgaactcagaactaaagttaactgtccaagatacaatggtgtcttatagttcataaaaataagtgactgttggtcatgtagattgccaggtgaagtgtagagtcagtaattcacaagaatattatttttcagcaagagaacttaaaaagatgttttctgtaacttcatctaacatagattagagtagacatccaaaaggaacaaaagaggaatacacgcagattaaccagattagttataaggtgccaataggaatagcgtaaggataccattaaatgttcgaacatatctccattcgtgtgcttcgaatgcatctccagaatcgcctccaaagtttgtattaattatctcatggctttgaagatttgaagactgccgcaagagcttttctggccctgtaatcaaaaacgtaaataaaagaattgtaggtaagtaatggatctatcacatagttagcactttcatgtaaaacttcaaaattgggctaactgaaaactatctgggtcaatttctttccgtagagttagtcatatgctcatatccaactcttctgcagagcttcaaagtcaaagtgggttggcctgctggctgagttgacaacaattggacacctcacttttgcagagtaaagagcccaccaattgaaatgtttctgaaactgagtaacatcggtcctctataaaacaactcaatctgactaagccctaaactctgttagaatcgaactaggatgcctacaaaagaagcccagtacttttttttcaagaaaattaaattgataaataaatggaaaaggattagcaagttgtacaatttaccgataccacatttggatttcagatcttgattatcacccttctggacactggacaaccaaaatgttttttttttggtttttttttggggggggaggagggtgttaaactgatttatggaaaaaaaataaagtcaaacattcttggtttatttagccaaggaattgagtgaattgtctaacattcaatattgagctgtctcaaaagttatagagtaaaactgtaatctaattatcatggtacaaattaatattgcatttttgttatcttacctttaccaattcgtacaagtttccccaagccttgtgcatatctccttacacgtggtcgatgcccatcaagattaagcctccaggtgtaaataattatatggcgtaagagcttggcttaacaaagaactgtaaattgcaaattggaaaagaaaaactaggtatcatctcacaaagaagctcccatactcgttttcattctgggatctattccaactaacccctctcgtcatcaggtcataatcagcctgttatgagaaatcaggataaaagaatcaaatgaaatgtagcagaaattattaattgtatcttatcttgatttaaagagggtgttaagggtgatattattggaaggttctacacccacctccactcaagatcttttgtgactgcaaatatataggcatgcacatattatttgtaagaattttatagaaaaatgtcgcatcactgcatacaagtatacatatgtagtcaattggtttcacataaatatgtatataggtttcagatttgaatataattatttatttattacatcttgtaatttagactaatatatttatttgggacttgttgcaacacatggacatgatgtgacaattggaagaagtcatacctaaaacaaaaggccagtgctgtctataaatttgaaactcaattttcaagtaaacatttttgtacaatgaattatgataatggttttacagcagaaataacagatagccggcggagattttattaaggacctatctgagtaatgaattattgaaatctctattccccgtgacaaaaacaagtgctaacactcaggggcaggtgccagtgcaagagtggcacatgactcaatgagcttatttgttaacacttcaacatttccaagatttcattcttcccttgcctccctcgtgccagcaatcatgtttattggaagcaagctcgatttcaagagcagctgtttaaagtttctactgctgcaatgccaattttcatgcatccctgtcataattcttaagtatttctggttattgtactgtgatgagccattgtctcaaggatttgaatacatgttaaattttggtgcataaataaataacttcagtggtatgctatcacaacctgaatgccaacaacacaattaggaaaaaatagaaatattttttttaagatttctttgagctgaacgccatgaatacagtatttccagtttggcagttacaggtaactgaagttagcccacattttcataaagggtgtagaagatgaccccaaaaacacataatctactttacaccgacaataacagttagcattttatagaattattaaatacctgctgttttgcctgctcaaatgcttcaacccatttcctagcttcaccggggtccccacatgcaatctagtaaaaggaaaatagtagtaaacttttaatcattatataggagcattgtttacaaatattcaagagcataatgagctgtgcacctctcctttctttgtttgatccaaccgattgtaaaaccgcaagacatacagttcctgggttttgaaaaaaaaaacatatttggttatttataaaggcaatcacatgagacatttagaacaaaacgttttaacaaaaagacatgatttatgctgcactagaaaaatagggacataatatgacagttaaatgttaatcaaaggacagaattggaccattaccccatggctagtaatccggcgaccaagctcctccaccataagagtgtgacttacaacaccctttcggataggttgctaagataaaacaagaagaggtaataagattccatatgcatgtaatgtccaaaaaatctcaagagaaaaaaattctgcaaataaggaatcactttgtgatgttatgtcaaatgtagatctacacatctacccaattgtcttgctaccttgaggctatgtagggacaacagccataaatcattttacgtatatattctagcaagatcaacataaccgtttcttaaaaaaggttcatattatcaaaactacaactcaaaattcaaaacaacccaaacgctgacaaggcacatgcactgcatccagcccaagcatcggtcctaaaattgccagcaaccttcttcatccttaaattgcagacagtgtcagtcgtcggtcagtaactgaacaaatacagaaagcacacacagcttagcagtttactctaaaactcccattttctactggttggatttcagaatcattggtaagcagacaatatataagcggggttataaagcaataccagcagaaccaaagaaaacctgcaacccagaacagccccaaatgcagaaacgatcagtttcttactgtaaatgacacggttgtcatcatccaaaccaattgaagccgcattttcgatagcagtcgcatctatcgatgcatcccctacattacgccaaataaaataaaaggttcgccaaaacaaacccaattcaattctgacaaggtcgaagagcctctgtgcaaagcaacggcgcagtacaaaaccaaaccaaaccaaacccaacaaagagtaaagcagctccatgcctccatccatccaacccccgctcaccgctgcagctccgacgacaagctctaagccgaaaccctcgagaagcgagagcgatcacaaacacgcataagaaatccagaaacgagactaagtgggagcaaggagggaggaggagagagagagagagagtgggggggggggggggaaccgacgattccggggttcttgctcgggtcgcgcttgtacatggccaccgtcttgccgcggatgacgaggaaccggaggtggcggtactcgtggccgatggagttcacgccgaggtggtacacccacccggaggaccccgccgtgctccgcccgctcccaccgctcccgctgctctggctgccgacatccggcgatcccgcctccgagagctccacctcggacacctcccctcccgccgccgccgccgtcgccggcggcttcaaggtgatcgtggccatcgccgacagcgtggggcgcaatccgatgggggaaaaagttggaagactggaactctggaagggaaggggggagaaaaggacggggaattttttcagtgacgcgcctcgtttctgacgttattatacggatactcttcgaaaccagctcacatgttcccaaaaatttgataagttgaccctttttataaacttattttgaaactgtggctgtgtttagttcacgctaaaattaaaaatttggttaaaattaaaatgatgtgatgaaaaagttgaaagtttgtgtgtgtatgaaagttttgatgcgatggaaaagttgaaagcttgaagaaaaattttagaactaaacaaggcctatagaccatgaaagaacttcaacaaaaatagtccaagtctaaggctgagttctttccccaacttctcaaactcacatgttcatactcctattttaaaatcttattttaaaactagtccataaaaagttcatactccctccatacaaaaatctaagcatatatttttatcaccaaaatcaagaagaatttaactttatccatcatgtaacaaaatcaaggaattgtatccatgtaggcaaccaatgagtagtaagataacttcctatgttccgattaacaatttaatgtggtacatggatactataagagcaagtccaatagagtatataaactagctacaagcatatatggaggagagagaagaaaagcgggttacacatatatagccagctacagcacgaactttaagataatatgtgtatgcgaggtggttcaagtattaacggtgtagagaccgagcgcttgctcaggtggcaagcgtcgtcggtgggcacgctgcccatgagcattcgaaccctaggtttgacgctcgtgctcgtctgggaggatttttcccctctttccctgggactgactttggttggtcccggctagataatagagtacatacatgcgtgcgcgttcagtgggactgcacgtttcccgtgcactgatgcctagtgcctccaatctcatccctagcgtgtgttagggacgtgcacgtgtgtgtgtgcgtgtgtcgtggtgtgagtgtggtgtgtaagtgtgcgttctgaattgtacccttctaaaaaaagtattaatggtgtagtatatatttatataaaagttttgtatgagtaggttattagattagcagtagatgatgtaatttttagagttagcagttagctatattattaaacatgctctaaatattaccatctcattcagaaaaacctgaaaatgaaatataacttaggctatgttcgttggtgtgtgttgagaacacatttctagcgcacggaaaatgagtagtccattaacacgtgattaattttgtattagctattttttttcaaaaatagatcattatgattttttaagtaactttcgtatagaatttttacgaaattttttaaaaaataatacactgtttagccgtttaaaaaagtgcacgtggaacaggtgagttgggggaagttggggaaagaactcagccttagacttggagtatttttcatggtctatagttaattttttcttgattttggtgataaaaatatatgcttagatttttgtatggagggagtatgaacttttttatggactagttttaaaataagtttttaaaaagggccaaatgatcaaattttgggtcagatcttctagtctcagatagggatgaaaacggagcggatacggacggataatgctcataccatattcgttttcatattttttaccggatacgaaaacgaatacggatagctcgaatacggaaacaaatacggattatctcgaatacgaataagaatcgaatatcatcggacacgaatacggaaacaattttttatcggaacacgaaaaccaactcaacttctaatagaaacaaatatcaacatatataattagctcattttatataaaatgaggtataatttataaatattttttaaaatttaaataatattaatagtttggactagtgttaagagataaactacaattaaaatctataaaggtatattgaaggttatagagttagaaagaaatggggtatgtcttatgggtcctgcggatatccgaatagcactgttcaccggatatccgaattattatccgtatctgacggaaaccctgataccatattcgtattcgtatctgggagaaaatattcgtattcgtatccgaaatatccgagaattatccgatccgaaaggtatccgtatccgtttttgtccggagctaacggaaactatccgctccgttttcatccctaactctcagatactgtcagctgtccccgccacagcggaagctgtgccggaagcgcgcaaaaagtagccgttagcttcgaggtcgcttcgttattctgatttagtcctcgggtttacgcttttaaaattaaaacacgtagtcacctggtgacgccggtcgcttcctagtttcttttttttaagatgacaatacttgaattttgaccgggctttcaactccaattatcagaaatttcagtgtacaaaatgagtttaaacttgtcttttaagagcagtactcctatgtttgaagggttttttttttgtctattccaatttgtaggagaagttgtcgattatcgtgaattcgaacacatgattttttttctttaataaaaaaatataacaacatgattttcacacgaacaattcaatttccacctaattcataaaaaaatcatgcatttccacggaggccttagcttacaggcaatcaaagcgtaatataacctatttgtggaagtttatttataatttggggatatggaagtaagattggcaccaactgataactagtcaaagttttagtgggccatttgttggacaatcggactatttctagtctttgccgataggttatcttgtcttaatccagaccatcttacctacatccatccgaaaatttagatgcttactaatttattggacgcgactacatcgagagtgctaactgaatagtgctaaagagagacatccttcttccaaaaaaaaatctactagtacattcaatatctatgtatttttttccttcttagataagtttctcttaaattacttatccgatttataatccgattgtgccgttatgttcgttgcaattaaatctttacaacaagatctcacatgattatattttgatgaaaaatcacaaattacttttatgatatgtctaaattagttttagatttcactaagttacttcttaaactataaaagtaaattcagtaagtcttaaagtaatttatatacattatagaagtaacttacaacaaaacgaaggtaactttggcatgtcatttgaagtaaatccgttgtagagataaaaatatgactctatctagaaattaaattaagggtttgctggaaccatgccaccctatatttgcaaaatttgagatatgccacccgtatctcaatgacatgtaggacccacatgagtaaatgacatgtgggtcagggtggcatatcacaaattttgcaaaatttgtgtggcatggttcaaattgtcccttaaattaatcagcacaaattatggaattaactaaaaagtcatattttatccatacaacgaatttacttctaatgtcgtgacaaagttacttccgttttattttaagttacttttagaatatatgtaaattacttttagactttattgaatttacttttatatgtctaagttttatagccatcactctttgtctgacctggatgacctatttagtatccattgccgaaatgctggtccatccaaagtaaggacagtgacgagctaactgatgtacaccaaccatgttcgacgcaagtagtatgatgaatgatttgaagaggagcccaaagtaggatatacatgtaatcccccgtcctaaaatgtaaacattcctaatggatctatactcatatattaaaaatttagataaaaataattagaaacatgttgtattttttttaaaaaaattagagaacaatattttttacccggcctctatatccaaccggattatattggtttaaataagaaagtatgtgaagaaattaaatagagaattattgtgtttttgttgagatgaggggatgagtggagaatagttttattctaaaacaaatcttataagtgatagaaataatatcattctgaaacggagggagtacgttgcatctttaaatatttgtaaaggacacaaattgaaaatttggagtagcttacctaagaaaaccaaacttgggaaattgtcaccgagcgaatagtaatagggtcatagtgtacagatggaacaagatcctctgcagtcggaacaaatgacttttgtctacagtcgatggatatctggccgttcgcttccatccaacggtaaccaagactgcttgcgctgcccccacttggctcgtgggccggcccaacgtcagcagacgcacgtatacaacgtatagagctgcggctgcagtaatttctggcgcgaatcctctctgttttggcgccgggttcacctttttggcgcggtgaaggttctgcgccggcgatcggacttatgctgcctccatcgacagactggtgccaaatctctgcactcatgtcgtctattgctgtgcacttaaacttgtgttgttctaatttgatttttttctgtcctcccgtattgttgtgtaccccaacttgtgttttgttgctggaattgatggattgaaggaaaactgaaatggaagattgaagaaaaatcaacttagcttgcatcagattaaaatttgcgtatttaagatggaagaaaataggtgcgtaatgtcatggttgtttctttttatccatagggggcggcaggggagccggccacgaagccggggcgtcgcggtggcagagagggaagcgccggtgaggtgaggaacgccgtcgtcacaacctggggcgggcgtctgcagtgagctcgatggcttgagcacggtggcaggggacggaaggtcgactggtgaggtgagaactctgctgtcgtggcgcgccgacggatcagggaggggaggggaggggaggggagcgctggcgaggacctccgagcgtagcggtggcgtggagtcaaacgatgcgccgacgaggacctccgagcgtagcggcgccgcggaatcgaacgatgcgatgcgctgcggcggagtcgaacgagccgtccaagggtcccttagctattgggctgatatgggcctggtacaaaggcctgtgtttccacagttttcttttatcacggttggataggaattggatggctctgatcagcgactggagagacgagtcgttctgcctgattttagaggatctgattctatctgtatgatggtcaccgagtgaatagtaatatgatttcaagtaggaatatttgatttcccccctccattcaacgtgggtacagccctacacaattattttccttgtataatgtctcctctagtcctttttgaatggaaggagtatgactttagagggattttacagaagtcgaactaattcatttggatctctataaaattttggcattacaaagaagtcctaagtatggagcacaagggttactcactaattttacaagaaacgacacgcacaaagactaatcaatcggttgaattgtatctcgtatacatgattctgctactagcttcttccactctgttcatcacacacccttgctggacccattcaactggacaactgcaacaccggccacccaaccgtgcaccgacaagtgacagacgacaccatcagcgagtaattcaaccagttcccacgtgccggtgcccgtgccactctgccacttccggctgccaataatttgccctttagcctctatgctagcgtggcaaatgttagcgccatattatctggcgttgggacgttcgatcttagcgccagcgtgattggcgctgagcccacgacctatttttgttaaattttttggcaaggtttaattacgaaataagttttctaaaaggaccaagttataaaaaaaagcggaaaattccactatctacgaaccgagtagacgtgtattcgtatcaacatatgagttttgtgtacttgtgtgctagaattgtactcccttcgttcccttcgtttcaaattataagttgtttcagctctgatgaaagtaaaactactttaagtttaactaagtttataaacaaatatagtaatatttacaacactaaattagtttctttaatcaataattgaatatatttttataatatattcgtcttgggttgaaaatattttttttaaattttggtaaaacttgaaactgtttgattttgactaaagtcaaaactatttataacctgaaacgaagagagtactttaaaaaagaaaatcatacacttcttacgtataaacttgctatattttaagacagactactgtcagggttacggataaggcataccctctatcctatgacttatgaaaccgataagatataccttcatgtatacggatcgtttccgtatacgctgttaggaacttgtcttaaattatgaaaaatatttctatgagttaagaaattgccgaagtccaacttggaaggggtaaaatctttggtgtatcgtgtcggtttacatatccctaagttttacttgggggtcaaggtattacacggtataaaagggaccctagggggaggtgaagggcatcgcatctcattgtccacacacccaccaaggtttacgaagccggagtgcacggagccaagtcgccgggagatctcgtcgtatccctcgactacgatctcatcggtaccatctgtttcgacaactctctttgtaatctgttcttatcgttatcaatctcacataaactggactagggctattacctgataaggggcctgaaccagtataattcttgtcttctatttgcttgatgtcatactacgtagaccctcgttccaacgtaccccaatacttaactcatccggtccgcgagtatccctcgtcgacaactataactagagactattgactcggaagtcgctgatgggtgaccagttcccctcctctagtctccttagagcaggtacaatagcatactattagccatctataaacatattttaatgagataaaagatgagagagaagaacagtgggctatagatctgtagccagctgcaatacgcaatgtgtgtatgacaggtgggatcatatactaatagtatagtaagtaactattgtatgaattggctattagattggctatagacaaattgaagctagtagtggactatactattaaacttgttcttagtatatactttacatacaaacgtataaagctcagaagttgtatagctataatcccttcccatttggggcacaaatttttttttttgctcggcccaacccaatccaaaaggcatcaccggtgaggtcaacgaaccccaacggcatcgccgtcgcatcgcatctccagatatccagcagcatgtgctgttccccggcatctctctgcccacccggccccaccactactccccccctccgccggccgccgcgagcacgctgcgtagaagggagaggagcagcgagcgaataccacagcgcggccacaaccaggagcctctgctccacgccatttccccaccggagtcccgtgctccggcctcgccgccgcattcccgcttcgcgctcgtggtacgttgctcacttgatctctctctctctctcctcagattcgcgcgcgagtcgtggccgtggctgcgctcgatcggctgcctatacgcgccgcggcggcgcgtggtggagccgctgctccggctccggagaaccgggagcccgtttggacggtagcaagcgctggagctgtacgcattactgcaaatggcggtcgctacctgccggattcgcctcgcccaatcgcctgcttcgttcgacaagcggatggggctgtgcgattccgttcactgtagatgcggcactgtagcggtagagctcgctcatcagctcgccgattgggtggctccagtccagcagcgccacctcacagggcaaatcgctgtgaatccctgactttaatgggctaaagatggagaatccgcttccgtattggctgcatgtgcacgggataataaaaaagtctcctgctctgatgggcatgttagtttttgtctctacactcggtgtgtgcgattgtaaatagtggacgcatgggcaccgcactgctggactggtatttgtccgccatgatttggagttttgttggattgtgtagacgaatttgggttaggtttttatattatatgattccatctcacgcggtaattagtactggtgcgtggtcatgcagtgttgtcaggttatgatgtgctctggctagtttttatttacacttcatcagacttcagtaagtaaaggttcatggccttagttatcttagggaattttgattatagtgttgtaatctggaatcccaagttgtgtgataaccgttttgtttattttcagtgttttttattatcctgtatcggagggtggtgaactactgcttctaagaatgtaatttagtttagtcagtgagcacaggagccttagttttctcaactaattggcattgcttgttaggagttcgccaaaagttgatttaggacataaggggttttcccactttcccagagcttgattcactgctaaactgcactctcctgagtttctttgtagcttcttagccatcatctagagctggttattgccttttagtttcttaaagttgatttttactcaatttcttaaagtctgttgatggtataaactatgaaaaggtaaatgcacaatttgctgaatatcttttccagactgttggacgataaccactttgagctggtgcacatccttatcaagatggctgtttctttaaaatcaagtggcagtttttgtagcacaccgcctcagtggctgcattcaacaagggatcgaattttatacggttattctcattcaaatgccaaagagtgcacttgcaagaaaacaaaaaggcctgctccactgtgtgttaaagctacttccacgaaagtggaattagatttcaatgatccatcttggaagcagaagtttcaggaagactgggataaacgttttaatttgccacgtattacagacatatatgatttgaaaccaaggccaaccacattctcactcaagaaaaacaggtttttttttgtgtctttaactgaattggctagctttcccttaagctgctaaagatgtgaacaatactttcttatgcaacactgtctgctattactcgggcagaagtcctgcaggtgatgaaaatggtacacctatggataaatggaatggttatgtgaacagcgatgatcgagcacttttgaaggtcagtaagcaggcaaaattagcaggcagtgttagattttaattttcttgtgtttaatttaagtaggatttgtatctaagtcatcaaagttcaaaatgtttgattgcacagattttgaaatttctattaggttatggagggagttatattttgttttacagtgtactccactgtatctgcacttacttttctccaactaacatttggtatttaaagcaggatgcagttcataaaagaacacctttacttttgttcattgctgtgtatgctttgcacttaacgtaatgtgcttgcttttaggtgataaagtattcctcgcctaactctgctggagcagagtgcattgatcctgactgtagctgggtggaacaatggtatatttctcatcacttatgagttagtagctctttcgattctgctaatatacattgtttcttcaaatatttgattacgtattacatcatatcagtttccaccttcagcgtttagcagttgttaattgtttattagacttaattcgttatattcttaaatggtaaggcgttgataaatagttttatgtagggtacatcgtgcaggccctcgtaaggagatatactatgaaccagaggaagtaaaagctgccatagttacttgtggagggctctgccctggtttgaacgatgtcatcagacaggtcattgtcttttagcattgttcaaacatctttgaattgctcatactgctacctcaaacatttgatatgaattctggtagctacatccattttgggattagggttatgaagcatgcatatgaattatcagcaatagtcaataccctctaattgcttcactttttcttggcaatgtctaattgctgcacttagctgcaaagaaaatcaaaacaccaaataattaattgcacttcatgtacaggtggttacacatcaaacattggttttttaaaaatgcagattgtgaagataaaagtgggtaaaaatgcaccactttatgatactgtatttctgtgtgtcccttgaccttgaatcagaaatatgaacattcctttcattcgaaatccccatgctgtttttagaactatgctctgtagtctattatgtactttgatttcaactggtattttttacttatgcctagaatatgtgctgattccttctgcaatttttagcaagaaataatgttgcatgtatgacttacaaatcgttttttccgcgtttgcagatagtattcactctagagacctatggggttaagaatattgttgggattccatttggttatcgtggattttttgaaaagggcctaaaagaaatgccagtaagatacttttctatattcataattgtcaaaaactcactactccccaattttttttcaaatttcatttgatagcatcatccagctttcacgtcatctggtggagaacataaatcttgctggtggaagttttctaggagtctctcgtggaggagctaaaactagtgagattgtagatagtatacaggtaagcactctgcactgcaaggtttgatgctgtatttgttattcctctctttgagggaggctgaactgttttcaaaattattatctgattattgtaggccagaagaattgatatgcttttcgtgcttggaggaaatggtacccatgcaggagcaaatgctatccatgaagaggttttatgtctttaattttcattcacttcatcattcaatttttatttcccagtaaatctttcaggactcattaggccttcttttacgtgcaaactaaaacagaggccaatgtacctatgtacagaagaatttgcataacatattccgtgttcatccttctttgttataaaaaaaaattatattcatttttctccacaattgcagtgccggaagagaaagctaaaagtttcagttgtagcagttccaaagaccatcgacaatgatatacttttgatggacaaaacatttggtttcgatacggctgttgaagaagctcagcgggccattaattctgcatatatagaggtaagttaaattactgatattaattgtgtgttaagcttttcaaatcagttgtagagatgaaagttcaagggaataaatcactactataattaggcacgaagcgcataccatggcattggtttggtcaaattaatgggaagaagcagtggcttcattgcaatgcatgcttccctttcaagtgggcaggttgatgtctgtttaataccagaggtgtgtaaacattacactgtattatgtttgagactaccaattctcttatgtacgatctaccgataaaagcttactaatatgaatgaaggttcctttcacgcttgatggagaatatggtgttctacgacaccttgagcatttgttaaagaccaaaggattctgtgttgtttgtgttgctgaagctgcaggacaagtaagctaaacttcagagtgatttcttcatgactttttggctacttttgttccagatacagctggaagcacgtgagtcgagagcctatgatttagttattctacgttcattacaggagtttacaaaaatcaggtgcaacagatgcatctggaaatgtgatacttagtgacatcggtgttcatatgcaacagaaggtgtgtatgcgataaccctcttttactttgtgctctgatgctgtagttttagaagcgcatggttgtgccacattttgttgttaaaataggtttgccttaccgtctcatttgctttttctgtacattcgtagtagttcagttctatttagatagttgaacccaaggcttccctgcttttgtcttcccacgtttcttttctgtattgtcaatcataccatcataatagataacatcagttacaattttcagattaagatgcatttcaaggacattggtgttcctgctgatgtaaaatacattgatccgacatatatggttcgggcatgtcgtgccaatgcatctgatgcaattttgtgcactgtacttggacaaaatgctgtaagtcgcttcaggcatgcaggcctctgacatctatctttcgaagtgtggaggactagaggtagcattgctgcccatgtcatatggttggttaaatgaaaactgcatgatggtgcctgcaggtccatggagcatttgctgggttcagtggcatcacttcttgcatctgcaacacgcactacgtctacctccccatcacagaagtcataacagtaccgaagcgcgtgaaccctaatagcaggatgtggcaccgttgcctaacgtccactggccagcctgatttccattgatcaattctttgaaggttccagctcgagatgatttgctattctttcggtgatgtgcttcacacaatcacactacagcacgaactagcctagaagatagtcaacacaatagtgatgctgttataacacttgtttgcaagaaaaatttcatggatcaatgtgattattcaaactccaaagccataactacggtgtacatcagattctcagttctcactctggagtctagccacggttcttgtagtagcagtgttctctgaactgtttctgaagaagaaactctgaattttgatttggttttgctgtttctgcttctgctatctctaatgcaaaattcaggccggtttggcaagccggaagagatagccggtctggtgaagttcctggccgtccatcctgctgcaagctactactccattcaaaaaaagacaaaccctagctacgaacctagacacgcatatgtccaggtttgtaattaggattggtttttttttttttttgacggagggggtacatcactgggcaggcaagcacaactgcagagatgttcttcagatgtgcgatcaaatgaacatgttttgagagattaagttgcctaattgtggtgtcttagatacaacagatcaaggatgcaactaaaattgtacacgagcccaaaatgacgtttctctttcgtgtcttcactgaaaactagtcgacgactcgggtttatatcctctaccataatgtcgctattattatagacactgacatgtgggataatagcagagtggaacccacgtaccagtgatggtggtggtagtaacattatagtagatgatcctaacccatgacgactcccttcaagaatcaattatccatctacattcatttggtttcctggttgcaaagttgtctacgttgatttatcagcttcatttggcattcggttgagttggtttattgagcaccgtccaggcgagtaggcgatccaccccaacttcgccggcgatcatcgcctgcacgaaacggtgaactcgcgcacgaatttcccttcaacaaattcggccaccttaattcatgtcgacaaattcagtccacaatcgaattcggcccactaatttctcatcaataaatttggcccaccaaaaaccatgactgaattcagcccatgaaattcccttaaaaaattcggttaaccacggccacaaataaaatcggcccatatttcccgtcaatgaagtcagcccaaaagtaaattggcccaaaaatattaatggacgaacttcgcccacaatctaatcttcacacctcaacgaagttagcccacgaatttggaccacttaattctcccaacaaattcaacccaagggcaaatttgaccccactgaattcatgtcaacgaattcgatcccaagagtatatttaccccacgtaatttccatcaacgaattcggcgcagctacgaatttggaccacctaattatcgctgacaaattcggcccaccatcgaatttaaccctccttttttctgtcggaaaaagtacaccgaaggtccctcaacttgtcatggagttacaaaatcgtcccccaaacataaaaccagatactgtgagaccctcaactaacaaaaaccgttcatttgagatcctttagtgggtttgactccggttttatccgacatggcggctaagtcggatgccaaatcagcctcctctttcttttgctctcttctctcccttcctcatctctctctctccattctctgtggtgatggcggctacgggcaacgcggggctgagtggtggccagcggaggtggcgtgcgagcgcgcggcggcggcgacaacgctcgcatcctgtctttcccctttcttttttctctttttttttcttctctttgccgcggggagtagcagcgggcggcagcggcagccggcggaggcagcgtgcgagcgcgcggcggccggcggagcagagcggcagcgggcgagtgcatggcggagggtgccgccgccgccgccgcgccgtcacgaagcgaccgggagacgccgacgcggttgccgacatgcccagaaggaggccgggggaggcggtagcggtgcactggctgcgccacgccatgttcgacgcggccggggacgacggcgccgccggcggcggccacgggcgcttcatggacaggttcgtctccgcgctacaccactactcgtgggcgcgtcgtcgcagccgcgttgccttgccttgccgttctccagggcttgctcctgctgctgctcctgcgaactttaatctgaatcagtgaacttgcatttgcatttgcgcaggcagaaaaaaatcagttacttgtctaaaactccgaagttactaacatgcatagcattcactccctccgttttataatgtaagtcattctatcatttttcatatttatattgatgtaaatgaatctagagagatatatctagattcattgacatcaatatgaatgtggaaaatgctaaaataaattacattataaaacggaggaagtacgtgtttaaaacgttgtgtatttgggttgttttgttatagactgttttggaattgcacaactgaaactaaggtaatgataaattttccacatcttcttgtttcaaatggatgaattgaacaaaatttattgtgcttgcatttgcagaaacaagaaattcagtttcttgtcagaaattatgttgttacagtatgaattgacttgcttaactagattgaattttgacgacgaacggatcaacagtgaagaggcgtctacattcatggttcgttcccatgaagatgtacaggtgcaaaatctgccgtccgttcgtcttcatcgacctcctacgccccgtcccagtgcaggcgtcggtgggagagtgcggctgtggagaggcggcggcgacaggtgagcgcggctgcggatggggagcggcagcgccgacgactccgcgccgctcgggctcatcgtcgtcggtggcttcgtgcgcgggcggagcagaggtgggggaagcgaagcaaaggggcggggggcgtggcgggcgagcggctccgagcagcggctgggatagggccaacgggaggaacccgagtcgtcgtcgtgctccgtgtcgcggactgccgcccgtcgcaccagccctcctctcagccgcgctcctccctcgccggctaccgcccgctgcccgtcgcaccggcctcctccccgccaccgaaggctgcgccggccctcttccctgaccggccaccggacgcgcctgccgcgccggcactcctcccgtgctggccgtgctcctcgaggggagaagagtatgagagagagagaggagggagaggaggggaaagagggagggtgctgatgtggcgatgtggcaccatgacatgtggggcttacgctgactcagccgccacgtcagataaaactagggtcagaaccatctgaaggataactcgatgacaagttgaaggaccttcagtgtactttttccttttctgtcactaaattcggcccacaaataaatgtggcacatttagttcccatcaacgaatttcaggcctcgaacgaattctgacgggccaaacattaatacgagataatccggggcttttctgagaaactacctccaatggacaactgctgcctcgctgaccggtgggaccgcttgctccggtgaagcgccggccaggggagaggcgccggcgtccgcggccgcggccgcggccgcgaagagcttcctcgggaagcacacgccgccgaacttgcgcttcctcctcctcgtccgtcgcgacggcgatgcggacgggacaggcgctcggcgtcggcgtggcggcggaatgcgtcagcgtgggcaacggggatcgcgggggagggcggcggatggaactcctggccgtggcggtggaggcggaggtctaggagtgcgcggacgacgaagagaaggaggtggtggcggctgagaggaacgcgctagctgggtctactccggcggcggaggcaaaccgccgcgcgcgagccgcgagtttgtgcggcggcaacggaggaggaggacgacgccgccgccgactgattgcggttgtcccattggagattgaggtaatcactgatgatgattttctaatttagcctatgatgatctgaatgcgccctgataccttttagaactgatccaatccgatcagtttggatcttagtgctttgcagaagaaatgccactgtatcattgataataatgctctatttggtaatcagtaaagcatcaacattgtgcttgtcatcataattcgtcactagcaggcttgcatcataaattatttcagagaaagcctagattcgattgctgataaaatcctccaatattgaacttattgcatcaggcaactgctgctcacgttgtgcaaaatattaaaagagaaaatccatgaaatgccattgacaagcacactaatccaagaaatgccatcgacgaacgcaacttccaggaaatgccatcgtacgagccattttgtcccagaaatgccatcaccgtcacttttactctgttagataccgttaattttgtcaaaatgaccagattgcccttctcaacctaggacaaatccccttcaccgccggccactcctcttcctcccctccacttcaaccactcctcttccacctcttctcccatcgtcggcggctatcaggaggatcgacaccgttgccgcacccccgcgcacgtcctcactcggagcaccccggtcgtcctcgccctcgagcttccgccgccgccaccgctgccgtccccgagctcccgcccccggcgacttctccccttccaccaccgtgagggggccctctctcctctctctctctctccccgacgacgaccttgaatgacgaagtgagactgtggaagttgaggcggactcggtggctgtgcgcaagtggatctggacgtcgttgaggatcgacgccggtgacgtgcgcaagtggatctgggcgtcacggccaccggcgggaggtcgccagagctcctccgcacctcccctggccgccgccgagccgtcctcgccctaccctggccgcgccgcacgtcgccactcacgctgttgcagccggctagaggaagaagacgatggggaaaggagagcaagcagccgggcccacctgtcattagcctatcaaaatttttccatagaaaaataaatcagcagaaatgtaaatcaaagccttggcccacttgtcagccactgtagactgaggatatgtgtcggattaaaaaaatacattatgaacagtgctgtttcatttggtgaatttttgagatttttctcatgtatagtttttcctatgaaaattccaaaatcttaatttgcatatacattatacatcaagggcaaaatagtctttacacatcatctaacggagtacaaatgacagagtagtgacggcgatggcatttctgggacaaaatgactcgtacaatggcatttcctggaagttgcattcgtcgatggcatttcttggattaggatgcttgtcaatggcatttcatggattttctcatattaaaaagcaagttcagagaacgaaagctctgttgtaagccttgtagcaacaaaagtattagataataaacgaacaatttgtctcttattaatacatatttcgtcaacactggtagcattatcctcctgataaaatatcagctcatcagcagagagagagagaaagcagcctcacggcctcacccaatggatggctgctcttcctttttgttctctgctttatttactcttcagtgcaaagttaaagaacaaagcccctcgagctggaattgcttggttaggaccctgtgcattccaccaagcagcaccatgcgaactcacttcttttcttgtttaaagtaaagagaattagagctttagtagtgccccaagcagcatgctatcatgtgtgtgggcgatataatattataatgtgcaaagaggcagcttaaacttgaatgaagaaaagaagattggacgttgcaatgggtgatcttttctgtttgctgttctttgaaacttcggtttgagggtaaaaatccatggatcaacaagatttaaaaaaagggggcatcatttaggacaactacttaagagaaaggatcatttagcacaatgaactaagtatcgatgttttctctgttccttgttagtttgcatggggttgggagcttcttgattcaaaggggaatttctaaagcataaagcaatagttcttgagcttgttaaatgccctatcccaacacttctcttctttacaagggttgcttggtgtgcaggacagggactaggggaggagaccagggaaccggtgtaaagattcttagcttcccaaggtttatgtcaccatctctttattcatgcctgtcacaaccttctaaaacagccttgaattaccctcaagcggcatgcatatgattgtgacagaatctaaattgcctgctgctatttctttggaccctctcagctcatatataggagcagcaattgctgctggcttccctacaaaaacagggaaagcattggaggggaaagggaaatggcattgtctgccaataggctgctaactgttcttctatgcttgttgctgttatctcatcagcagaaggtgtatggcttgaaaggcattagtcttgccttcggaagggaagaggatgaagtgcccgagaagaagccgcgggtgcttgctcaaagtaatgctgccaatctcaacaacaagggcgggtactcagcaagtccttcatcagctgatcccaacagaatgagtgaaagaagggttcggaggggttcagatccaatacacaacaggtattgatgcttcatcatgtagggaggatcagagacaacaagaacatcatccaagatatgatggatcagttgatgcgaggcgctaaaggttttttggtgctttctacttgtttttaaacttgtctgtttgatgcttcttttctatttcatttgtgtttcttaattatttcgtaatggatatatctgtaaaaagtttttagtggtaaagaatgacgacgtactgcagtaatcaagtgtggttttgaatgaaaaagtgtatgcgaaatctccatatgttcatgttttagcttagcttcccaaaatatattgctgtcaccaacatgtatcctgcgtttgcttcttttccgttggctggttcacaataaggttaacatcaaaagcgatcggtgcaatttgaacatttataaccttatcacatcttattatcgccatgtttgtttgaatcatgtagattactgtatttcctcaaatcattatttctttctttggggataaaagaactaataagaataatataatttataactaactgtctaataattacctcttggacaaagactggctgcacatagtccttgcaacttagattgcaaaatgaccatagaactttaccagccacatgaaaattattgatcaaaaactgcaacctatagctctgaatctcctccatgctttgctaccctaaccttttatgattcagaaaatgtcctctgatatctaccacgcttgtgaagttgcagcttcaccaaatgcatcttccgagctacagctccccagatcatctgaacagcgtcaccaggctgcgaagggtactggtactcgaagtggtgtgcaacctccttcagcctcctccacattgccgtccattcttcctgggagatccccctgaggagatgcagcaggaagcccctcttgacggcgtcggaggcgcggacgaacacgcagaaggcggagtagtcgaggacgtcctcgaaggggagctcgatgtcgtcgctgatgatcacggggacgcagtggctgacgatggcgtcgaagaggcggttggaggagggggtgtcgccggcgatgttgaggcagaacttggaggaggccatccccttggtggcgcgcctgatgccgttctgacggacgctgccgtaggtgaagtggacgtccttctcgtccttgatcagctggtacagcctctgacgaacccttccaccctgaaaaaaacattacagtttggctgaaaagttcagtgcaagtgtgcaactcacttagacagtggcaactcagtgttttataccacctatatttgaccatagtcctttagaagaacttgcaatggttgagccctagactctggtagaaaatagagtttataaattaaagtttgaagtggcttaatcctcttattttggtttaaaattaaaatatgaacaaaatgtctcacactactaaccataatctaccagtagctccaactccaatttacttttggagctagaaaaaacccaactccagaaatcttttggagttgaaactgtagcaatcaggggcatagattttaaatcaactccaaatcatgaataagtattccagaacgatatgttttcatgtccagaggaaatggtgcttcaagtcgaagacaaacttacatctttcctatgatttaatttttaaattttgtgtgagcaaaaatcattttccaaaagtcaatagcgtcgtgtatttaaaaacggaggaaatactactttgatttggtggaggaagtagtagtttgatttggtggcgaacttacatctttccaaaagacacgaatattaggaaaatgacctaatatcaaataattagaaagggtgagacttcgaacccaggtcatctagcgcaccaccttatggagctagctagaagacccctgggtgtttctcgaacttacatttttcctatgaatggcgccctggaagtaagcgaggacggggcgctgctcgaaccccggcgagtcgccgtcgccgagggaggggacgacgtgcttgtacggcgcgatcacgtccttcctcaggttggcgacgtccggcgggtacctgccgaagtcggagaggacgaacatggcggcgctgagccgccgccgggcgtccatcatgctgttcgggtggtgcggcacgacgaggtggtccgcgccgccccaccgccgccactcctcccgcctcgccaggtacctcaccagctcgccctgcagctgcctgtcgctccggccgccactcccatggccgccgtgcggcgacttcgactgccggttgtagctcagcgacgcgaagaacggcaccaggaacacgtcggcaaggctcgcgttcgtcaccctcacggcggtgcacggacggcggcggcggtggtcgccggaggtggtggaggagaggatgtccagggtgagccagtactcgacgctgtgctgcaggttcaggccgcccgggtagcgcggcacggcgcgcgggtcgccggccacgtccggccacgccgcgccggccgccttgccgtcccaccccagcatgccgaagtggaactccggcgggaggtcgtagaggtacaccctcagcagcgcgctctccgcgtcgcacgtcgccgccaacgccgccgtcgtcgtcgtctctcccgacgacggctgccgggtgatcatcgccgccggagtacccacacccacctcgacggcgccgcgcgacgtcgcgttcccgcctctcgctggcatctccgcttgggtgctgcttctaacaataatgccatcgtggtcgtcatgctcgccgccggcggtcgccgcgaggacggcgccgtcgatccgcgagctgacgagagcccagcaggagaaggcgaggagggagaccgcgaggaacaccacgtagcgcagcagcgcccgcctccggtgctccgccgccggcggcgccgccggcgatggctgcatcttcctctccgccaccatccacgacaccagcgcgcgcgagcagcgcaagaatccagccaaactcaccgctggaatgaaattcgcccaaaacaaaaataataaattcaaaccccgaattacttactgccaaagatcaaatcaaagaaacgagctgctgctccatttcaacaacacccctgctccctccctgcagatcgatcgattgagccgcggtcgtcagttaattcgtcatccaagaacggattaactcgatcatggcagggatcagaggaactaaatatatatatattctctaaccaacacaacaacattaataattataattaaatttataccttcatggagcactggtttcttcttgtgcgtggtggagaatttgccggcgttgaaaaggcggcgtcttgacgagagatcgatgaggaggcgcctcgtcagggccatcgtcttcttgaccggcctatgctgcgatgcatgccgctgtcttcgttctgttttttttttttgttctttttttcattttcttttccctgatgacatctactactagttcgctgtttctgttgaaagatttctgcagggctcgacgggaaaatcggatgggaatatggggatcgcaacggactttgtcaagataaaatcagtcagatactcgcggcacaactgtgagcccgtgtactctcctagtagtcgtcaaccgagttggaattcgcacatctaaaaaacaagcaaagtgtacttaggatatcgagacttcgagatcattttgatagagtacatgttaaggatcagtgttttgatattagacgtcagttcaaaactctagtattccgggaacacggcttcatgaagatttatttggttagtgcttctcaattaattaagtttggctcacccaactaatgttggctttgacatttctaataacgaactagtaccgaatattttgagaattctcttctttgttttggtcaggaattgagtttcgttgtggcatgtgatttgatggcgatgagtttctgttcactataaatttgttttaacaaacacatgctcacatactaaacaccacactcatattcatacacgcacgcgtgcatctcctaacacggctcaaagaaacatagaccaaccacatgcatctgtggggttttaaatttatcatgtggttttgatttagaaaaaaaagtctactacctccgtcacaaaataagtgcagttttacaatatttatatctaacgtttgaccgttcatcttatttaaaatgtttttatgattagtacttttattgttattagatgataaaacatgaatagtactttgtgtgactaattttttcataaatttttcaaataaaacggacggtcaaacgttggatacggattcccatggctgcacttattttgggacggaagtagtattttacttttccgaacaatttcaccgaaacttagtatatttgtctcttcccctcaacccatccctatccttctcaccaatcacctccactatacttattggcataataatgacctgtttggtagagctgtaactcctaaatttagctacaatagttgtgtctgaagtggagttgtaaaatagcttaaacccagctacatctctctagttcattttgtgagagcgcttcaccaagctccgctccgatgttaggtggagtgaaactatttggctgggctccagctctaggagagagagagagctggagctgtaccaaacaggtcctaaaccgtcaacatttcctttcgacgtgctaacacttatactatgtccaaagaggtgatgtttgtgcgaaaaaaaaactcatccgtcccattttaaagtgcagttgtgggttttcgtgtccaatgtttgtttgtcttatttaaaaactataaaaaaaattaaaaaataagtcacatataaattactatccatgttttattatctaataacaataaaaatatcataaaaattctaaataagacggacagtcttgtacataaaaaaatccatagtttaaaatagaacggacagagtatttaagtctgtcaagtccatctttgacgtaggcatcagcatcactatccacgtgaactggcacaatcatgtacactatggaaaaaaccaaatctatcgtgatttgcaagagattaacaaaagctagagcatgtggtacaaagaaattacatgagatattttatggtctcgagagataccaaaatttttaatataaattttaagaaatagtaaatcttacataaaaaatatgatacctactttttcaatgactgtaattcactcaagaaacaaattaaacaaactagacaatcacagagtaactggtcatagtgttttggaagatagtactaggaccgaaggagacacatgctgtccggattcgtaggattacaacgcgtcatattatgtattaggtttattttttaatgagacgaaggaagtaaggtgctaagagcacccgtaatggtaaagtaaggtgctatctataaaacatttacatctcagcaatagactagattaatagtaaaccacttcaatggtatgtctacatggatatctatagctctctaatgcattgcctcgtttttctctatagactatctccaggttagtagatagctttactctctctcttcatttaatctcttccaagtaggaaaatatgctgacatgtatctcttgtagagagcctatagataaccattgtgggtgccctaataaaatgttcatttggtactttgacttgaccgatagcttcttcctccttcctcttcctcttgacctatgcaagttggggagaatggcgttaatgcctcaccgccctcgtagctgacgacgtcggccttcccgctgcttccttgtttggcatgagtaggccggcgaggtcccatgccatgccctcgtcgatgaaagtggcggcaacattaggcttcctcgtcgacgcgtctgaagagaggagaaacagaagtgaggagagggaagggagggaggtgaggtggagggatgaaggttgtcacttacacgtgggttctagtgtaatttttctttgtttttgttgctgactgtgagcgccacgttcgtcttctttttccctgctgattggattgctatgtactcccttcatattaaaatatgtatgacgccgttgactttttgataaacatttgacatttcgtattattcaagaaaattatgtaattataatttattttattgtgacttgatttatcatcaaatattctttaagcatgacctaagtatttttatatttacataaaaattttgaataaaacgagtagtcaaacgttagttataaagtcaacgacgtcatacattaaaatacggagggagtgcatggaaccgctgttgaaacccgttcagggagataatatgaggcggattgtcgagggagtaaatatggatgtctttttttcctttgccatttgagccagtgtacacaaaagttgaaaacggcccaacacggcccagtaaaaggaacgggtgccgtgggcaatgggccgaatatcgttgggcttgtagtaaaacgttgcagcagacgagaagcgaaagaaaaagaatcgcccgcgcagatgagcacgccgcccagggtttgcaaaaccgtcggtaagcgcgcggttacagtgaaaaaaaaccacggtcacttgcttaaattcgaataaatttaaaaataatttaaaattttgataaattttacacggtttcgtacaatttgtcacggttgggccgcttggagtagtggagtagtagcagagatgaaaaaacacggcgcgttttcataggggaaggaagcaagacgtgcttagcttcgatttgtttgtaattgtacgccgaggctcgtcacagcctcacaggtcgcggttgcggagtggaccgagtacccgatctgaggacagtagtagtcgtctcgtcactgcaaggaagtgatgaaccgtgtgcaacaagtgcagcgtgctgcttcccccctttccgttccactgggaccaaaccaaaccaaaccaaaccacaacacgtgcgtccgtcccgtagtccggcccactcgtgttggtgtgtctcctccgcgtcaaccactacacctgaccaggcaaagccgtacgtaacgtaccatcgcatggcatcacatgcggcgcga

SEQ ID NO: 28912 - DNA, 17827 bp, Oryza sativa
aggccccacgccgccgcggccgccatggggccccccgcctcggccggggcgccgcgaagtcggcgtcgaggaagcggttccggaccgagttcagcccggagcagaagcagcggatgcaggcgctgtcggagcggctcgggtggcgcctccagaagcgcgacgaggccgtcgtcgacgagtgctgccgcgagatcggcgtcggcaagggcgtcttcaaggtctggatgcacaacaacaagcacaacttcctcggcggccacagcgcccgccgctccgccgccgccgccgccgccgcgccactcgccccaccaccagtgctcactgacttcagcatcaacggctcatccacgcatgccgccgccgccgaccacgccgcggcaacggcgagtggcggcggcggcggctcgccgcagtcgacttaatcaagactagtagcacagtcgaatcaaggttgtctctttcttttcttttcttttttttttcctctttttttgtagcctttttcctgtctaattaaccaaccctaatggctaatgaaatgactcatcagtcaacctagcaagtagtagtagtagcagcagcaaattagcttttgctctaatggtgaggcccaagcaaagattagattcataaacaaaaatgtggcctttttttttggatctgatgaagagatgtcaatggatgatgcagggacaattagtactaccactaagtacagtgattactagctttgttcttgagctaatctgggtgtgcatggataatgatgatgatgatgtgctaatcggagtcctaggtggggtagtgttctagtaggatcttatgctgtccttgagtgaatataattttttttgacggtttcttgctctgtgtctgccttaatccctgtttggttctgtcctgttcttatctgtgtgtaatgactgattggtggtgggggatgaatccccttttttgatgttgcaggtcaaattcaattgtttcattagatctcgtagtgttgtcatagtcaatgagacatgctttttgaccactaattgcataacggaaaccataaaaaatgtaacgttgccaaagatatttgttgtcacaaatggctacgcagtacttcatccgttctatagaaaatcaacaccaatttctaactacgaactttaacacatttaagtccatcttcagtcaccaccaaatgccacaaattgttggaatttggactggaaagcaagtagtaaattggatggttaacgcgtggataatggaggggtagtacatgaaggttgtgttgttgaataacgagtgatttgtgataattattgagtaaagtacatcaccggtccctaaacttgtaccgctgtgtcatcccggtctctaaactcgtaaattgaccgttcaggtactcaaacttgttcgactacgtcatcccggtccataaacttgcagatcactcgtttaggtcctctaacttgttcagttgtgtcaccccggtccctaaataggacggtctaaaaactttatatcaaaaaaaattcataactttttcatgtaaactctaatgaagacaaactttatatcaaaattgtagccctcgactcaacctacaactttgtagttgaaaagttttttaattaaaactgtttagggtcccaaaatattattacatgtttatagattttgaaattttaattttaaaattacattttgggataaaaaatgacttgaaataaaaaaaattcaactacaaagttgtagaccgcgtcgagggctacaaatttgatataaaatttgtcttcattagagttcacatgaaaaagttatgaattatttttaaatataaagtctttagaccgtcctatttgacccagatgatattcaaatccaagtttagggaccggggtgacacaactgaacaagttggaggacctacacaagtgatctgcaagtttagggatcgagatgacacagtcgaacaagtttaaggacctgaactgtcgatttgcgagtttagggaccgagatgacacagcggtataagtttagggaccggtgatgtactttactcacaattatttaatggtgcagacgatcagattaattaggggtactattacaaagttggaaaaattgattggaaactcatacataaagagttaatgaaaaaacacacggtttataagcacaaaaattatatgcgttaatccattgttccattccttagaaaataaacagtgccagaaataaaatagtaaaataataacgttggaataagatttttcatgttggcttacaagaataagacatttatatttatatttttagcttaaaagaaaataaaaaaaagaaaactaagaaaaagccttaaattagttctatttaagatgtaaaagtcaaaatagattgtgttttatatgccatgaatgctcgaaacaaataatccgtggtaataatctatctttttttaaaaaaataaaattttccaacttgttttgaattttaaattatttgatttttctcccaaacacttgattgtctgaaaatgtatttattggaatgcaaattttgctataggacactttgacttcgtggttttagccgtaggatattgcctgacgtactccataaacgtgataatttatcaatggaaaccgcgccgattaaaataataatttacggttgaagaggagagagaaatcgtgtgaaatgtcaaacaactacccttggacccacatgtcagctcttctatgtctcttcccttctctctctagttggcaataagacaacacttcgttctactcttaatcaggaatagtagaaaatatagtagaattttagttttatcaaatggtaacacaattattttctactaacttaaattgttctttaattttacactcttaattaggatttaaaaaactgtatggttaacatgtgtgataaccttctcaaattttaaaaccacagtataccctggcggtaaccacgcgtttaccataataaccctcgaacagtaaaagatagcggtaaacagtaagtagtaagtactcacaatataggtaaacggtgagtagttatagtagttatagattttaactattacagcattcacaatataggtagcaagtagtaggagaataagagaggaaatatagacaaatgacattttattatatatgggcaacccatatgtttattgatgacttttgctatttcttctatgaactacttttaacatgtgattctgaatgtattattttatgggttaatcaactacgaactggttttgaagtacattgtagataccctagatgactccaatacaataacaactctcatgacaccaatacaataacaactcctagctgcagtaggcagaagtactgcacgactactccaggagaggactagtgcatgatgggacggggtaatgagtccctcggacgcttttgaagtttttgtctcgctgtgttggtggaaagcgcgcattgacgccggaaagggagccgctgtgctgcactacagcagctatcgggtcagatcatggcactgctcccagtataaccctgctgtgtgcctgtgtggttgatgcttgatggaactgaaggtgcacgcacgattctgtccaaagttccggttttatgatcaacagcttgaattattatgatgtccatggttacggcccatgcaccatgagtataaattttgaatgcatgaattttactctatatgtttctataaatttggttttaagtctggttaaagcgaccggtttttgtaaaatcgttgactgtcggcttgtaaggattactcggttttagctagaatgtgtacggagttgactgaaagtcatcctttttagtaaaggctgtgtttaggtccacattaaaattgaaagtttaaagaaattaaaacgatgtgacggaaaaattagaaatttgtgtgtagaaaagtttgatgtgatggaaaatttaaaagtttaaagaaaaatattagaatctaggccaaaatcgatcaggagcgattttcacctaaaaaacgagaatgtaatccctgcttttaacctcgtctcttgaaacaaatgtcatagaggctcattagtggctacatggtgcacatttgttttttcttccaaaaaaataataatgtaataaaggattatattcttgatgcacactagtcacgtgccagtgcattgcaaatataggatttggtgaatgtggtttttttttctcttctcacgtattttctctagattgggcaatttgtttggtacacccagcagttttttaatacatgggattacatatttttctcttggttggttgattttttgggtagacattggaggagggaagggagggataacgatctttttttaaaagagaaaatccaaaaatgccaatgataaaaactcgatttcaagaaatatcattgttgagtacgagtttcataaaataccattgtacaagcacttttgtcttagaaatatcatcgtcgttagggttccaaacaacatttcgttaagtgctataggatgaacagtgcacttaatggtacataatggacaaaatcctaatagtgatgatatttttgagacaagatcgtttgtacagtggtattttatgaaacttgctatttcttaaatttaggtgtttgtcaatcatatttcttgaaatattttgtcttgttttgaggtagtgtagatacgcagcgcagtggtgtgtcttttgtgtaattgcaaagaagaaaaattaaagttggactccttttggctactgggttggactattgaaagttcagattggtgtttaagcttattataactaagcttagatgcatgcatgatcttgctttaatttaacaactgcccttgataggtctgcaattccccacaagatttggttgcttggttggtagggttcatgggatcctaagcccctaacaaataatagcattgtccactgtcatggcatgatggcaatattatactccctccgtttcgaaatatttgtcaccattgactttttagcacatgtttgaccgttcgtcttattaaaaaaattataaaatatataaaactatatgtgtacatgaaagtatatttaacaataaatcaaatgatatgaaaaaaataaataattacttaaattttttgaataagacgaatggtcaaacaagtactaaaaagttaacggtgtcaaatattttgaaacggagggagtacaaaccaactcagatatcagttcctcctcatctctactcttgtagtttctccacctttaccacattgtatatattttaacacctaccgtaagcatgatgctaagattcctcctttcccgatttgatcacttaagcatgaatcattgagtaatcacaacggtttccaccacaagtagtagtagtagtataattgtttagcgttgcaagagacaacatgcatctgctctaagtactccagcttttactaacctcttatctaatctttgggctagtttggttagttgtttttgactttacaaatgctgccttcttgtgagcaactctaaactgtaaacttccttattttttatttggcaaaatttgctacaagacaatgaaagattttggcatttgctgtgagacactcgaagattgtgaatcttttcatggacactgtaaaaagtgataattagccgccggacacttctcccattattttattatttccgaccaaaacggagaaagaaagagtggtgtaagtaccaaaatgcccctggacactatttctcttttccttccagccgagtaacagaggagagggagagagtagggcgtcaatgctccggtggccagggatcggcgacgttggtggcggataatgttcccgggcgacgcgcatccggggagggtggtgtcaagcaaagggggagaaggagatggccggaacggcaacacaaagagctcagctccggccggctatggtggtggcgctggtggcctgactcagaggtggagggaaaggggaaaggggaaaaatgaactctcctcggtgaggcaaagcctatggtgaaagggaataagaaggggagaaacggaggaggagatcggccgacggtagatggtggctagtcatggcaaggagagagaaatttggccgacggcgacgagcaccaggtcggcacccttgaccagccggccggagacgccgagcaccaggttggcgcccttgggcaacctgaggtcctcccggaacgcgcggcccaacgccgcgtccggctcgaactgtgcctcgtcgacaccgttgaggatgacgtgcacgcggcggttggggatctggtacacgtcgcgcagcatctcccccgtggtgtcgctgatggccacgtggtgcacgtagctccggaagaagtgcacctcggacagcacccggtacaccgactgggccaggctgtggttggacgccggcgacatgcgctcgtcctcgccgcgggtgaggtcctggtatatcctcgagtgcagcgcctcgagggatatgccgtgccacgacacaaccaggttgggcacgtcgcgcgcccagcagtggaacatggccacgctctccgagtgtatgacgtcgaacgggtcattctcggcctcagcctctgtacagcttccacgcctcgttgcagcgccacaccccgggggtgcaggaggaagaagatgaacagagaaagagagaaagagggattgacaagtggggcccatgggtaaacttgtctttaaccaatgtttctctctccgttttggccggaaataatacaataatgtgaggagtgtccagcagctaattactacttttttacagtgtccacgaaaagattaacgatcttcgggtgtcttacagcaaaagccgtaatctttcagtgtcctgtagcaaattttgtctttttattataatattttttgaactgcaaaacaatgttttttttagagaaattgatatataccaaagttctttataaaaatcaaataaattcaattttcaagtttataattgatattcaattaattataccctaatatcttgtctagttttacctaccaacaaaaaaaactcaagcaagatgaacatatgaacgcagcctaagcctaattgacatgtaagctttctttagttatgataagcccaatcggttggcctaataagctgaaataaaagttaaaatttaaattttcaaacttaattttaaggttgattataagatatttttaacgtaatttttttacactggctttttaagtcactatgaacaaatatataaaatttttacctataaattaacttttattctctaataaaccgttttgtcttagtagggaatataggcaaccaataaggctcgatgccataaagttatatataactctattttgggaaaccaaagattctaagaaacatcttatgagtaactatctagtgaaaaactaggtaatctcaccttcaagattctaaggcattgcttttttttttttctgattatggatttaggatttttcacttgcatacctccaaattcttaaatggcgtaattcgtgcaaacttttcttaaaatactttttttctagaataacttttcaactttgtatgaattctatgtctatttatattatataaaagttagtgtattttgagatgaaggtgtatcatttatcatagttgaatctcttagaagtactgaatatggcttactaagatttaggatccgtactaaagaacaatttgacatagctttttatcacacttaaaataagaaatatcattagtaggtgcctaattaaatattaactactccctccgtcccccggatacgttccatccaccctaaaattgttaaattttagaacagagggagtaataaaaaaatagaaaatcatatttatttatttatttttagaaaagacttttatagaattattttaagaaagtaggtgtatgaccttttcttttcgcttatacttatacttatcagctaaattttcaatttttactcttaaatttagagccgatttcgaggtttttttaatcgtagtttattttttaacatttgcttttagatcgttaaaaatacatacataaaagttttgaaaacaaattattttttgtttgtagatatatcatttggtttatttctggaatgtcccaaaggacccaaacgataggctgttaggtggtgtttgggaaggtttagtccctttgacaaaaattttagtccctacaggagggacttatgcttttgtgagccctccttcccaaataccaccttagaaagctttcaaaccgaggctttttcttcggtttatgaattattatgactgaccagggtttacgattacgacgaaatctagttggattttgcgaaattttaatgtttcgacgaggctcgaaagtagaaaccgcctgagatttcgagaagtttcatgcaaattcaaatttgaattgataaaaaaagaaaaaaaatcaaaaaaaaatcttataaatactatgatattcatagaacctattgtgatataaatttttgaaaaaaatgatgtattatgtgtatttactcaaacttacatcaggaaaaaaatttcagcaaattacctctattacaaattactgattgaaatttttcgatcggaatttcgccaaaaccgatcggttttcgagaacttgtcggcaaacttagggaatttgtattcaaattttggtttatgaaatttattcataatttatcggtttttcaccggatttcatgaaatcccgaattctgtccgtgcccgaaatagaaggggctctcggctatcaaaagacaaattcgttttttcttgcctactgctaacatcgttggcaatttggaagcgggtagtactgccaaggatgcagtactgtacaggatttgggtgacctgcagaagcaacgcgtcttctcagccgcagcgtggcagagagtgagtgaccagtgtcacagtgtgtgatggcctctagtttgttggcttctgggatttggtttcgagctggctgtcagctggatgctgacctccgataattataatcaccaaaccccgggccacgcgattaaaagtagattcccttaggcacaaataaagcccaaccacttttcagccatcagccctctttgacatggcaaaatttcccttctcaaatcttcctcaaataaaatcatctcatatttggctacaatattgtaagtattgggacaaatttattgtaaaggttcttggttcatgaacttgtgctttcaaagggtatttggagatatgccgtactatttgtagagcttatttatgtgttaaaattcaacgtacatggatagattttgtagaactacgagattcttttggtcaatatatctctactattataaaaattaaagatgtttttgccggtattttgatacgtcatttgtgtttgagtcggtttttaaggtcgttcgcttttggaaatacagatccgtgtttaagtcggtttttaagttcgttcatttttagaaatacatattcatgtttgagtttaattttaagcatgttcgcttttaaaaatacaaaaggaatcgtataagaaatctcttaatttaaaaaaaaaactttgcatgctaagttgagatgaaagtcagactcctaattgcaactcatgattttctaaaaaaaatatattcaagcgaattcccacagaattttaccctaactaaaccgtataacaataataaaattaaaatagcattcacctgttgtaacgcacgggcattttctagtttagtataaaattggatttgagtacatcatatatatcgtactatgataaatacgttattgatattagagtctgttgatgctatgttaaattacatcataatttttgttgtagatttgtgttcatttggaaatgtggtgaacaacgagtatctttatctcgatattttacgtgcaatacctaattttttttattttggactaaattttatggcacttttttgagttattattcaattgtctcgttgctatgtgtgaaaccactatgcaaagcattactttatggtccctgaggaacacaaataattacatttttttaatactgtgttcgcatgtgggaggcagaaaacctggtactatcgctgcccatggaccatccaaaaacccagtgtccaaatagttttaattctccaatggagtttgttgtccccattgattgtcatcacccatttgcaagccagatgagatgaaactccatggaaactgtcatatgcccgtttggactgactgaggctactctggtgcctcaaacgtggcatgtcttgagaggtaggggtcgctaggaataattaccatattatcacgctcatgtgccattcgattaagaaaccaacgtcaatgatgtctgaaataatggtatgattgttagagcagatacaatagcggactattagccagctataaacatatctaagagcaagttcaatagtagagttaactgccggctccaaaattcaccacatcatttaagagataactaaacaacggtagatacagcaattggctacacacatgctttaaccaaggcattctgtcaggtgttggtaacttctgcatgttcaagttctaattttcgattggttgtcccgagctgcagggggtaggcccccggtgttaattttggtaattaatgacaagcgctaattgtggactaaccgttgtctttgagctatacattttaagttagggccacgtcgaatgtgcgcatggatgattatcgatggattaaaattgacggcgcaaagcaaagggaaagaagacggtaaaactagcgctttaatttagaattgatcgaggtgtagggcgatcaaatttgctagtttatttttagtttcgccgtactattaagaggagtaatgacctagcaaagagatgattttaattgccacattaggtcattatgcatttagacttgtgctcacatttcacacacacacttcactgggttcggcctgaccaggggcggtcagaccggccacatagtggcggtctgaccggccgcaagaaggcggtctgaccggcgcataaggccggtctgaccggaggcacatgcgcggtcagaccggccccctggaggccgggatggtgctgctcgggatggccgatacagagtcaacggagccgtattcggtcagaccgagccgatagcggtctgaccgagccgaggccggtctgaccggccaccccatgtcggtctgaccggctaggccgatggggccctctgacagggctacaacgactagttttctagccgttgcagagtagcacggtctgaccggctgcatacctccggtcagactggcagagcacagagttgggggatttcgtccccaacggctagttttggtgagtgggagtataaatactcccctactagcagcaaggggactctcttggcaccctattcaattgcatacaccccttgcacctctctcacactcacttgagctttgtgttcatccatctagtgtgttagagggttgattagccaagagtcaagtgcatttgcttccattgtagagctagtgtggcacttgatcatctccacgccgggttattgcttgttactcttggaggttgccgcctcctagacggcttgtggaggagttgcccggtgacttctccgagaagattgtggaggaggcccggagccggtttgtgagtggtttggagttcaccaccttcggagtgaaggaagaactaccccgagtgatcgaggcttgggtagtcctctccgtgggccggctcccgtcttgtccatcccttgacgaagggggcgtgcggtggcttcgtggttgagcgatggagttgggctcgcctcaacggggagtaggaaaccgacgagtttctgaacctcggtgaaaaatctcttgtcgcattgtctcatttgattgtcgcatttacttttgtgcaatttacatttctagagacatacttgagatcatatcaccctaggattgctaaacattaacataggagtgtgatttactttcctagagatatgattgagccactatcaccctaggtttgcaaaacataacttagttgcttagttagagttgaccctcaccaatcctagcaacttaggttagttttgattaggtgtcatttaattttaaatcgcctattcaccccccctctagtcgacatctcgatcctacagggggccagagcgcctaggcgctcgtgcttgagccggcgactggattgtcgtccgctttgctctctctgctttccctctctctcatatatgttaaaatattaggtaagcaggctattagtctgctattgtacctgctctaatgagataaaagataagagagaagagcagcatgctatagatctgtagccagctgcagtacggactttaagacgtaatgtgtgtatgacaggtgggaccatatattaatagtatagtaaatagctattgtatgaattagctattagattggctatagatgaattggagctagtagtgagctatactattaaacttgctcttagtactactctacttgctccattagtctcaaaataaaccaacttctaaattttaaaatttgtcttaaaataaaccaactcttacattcttactactacccactatcaatcaacaaatcgagaaattttattacttcaatacccctcatctacccattaaccaatacccctcatctacccacggtacaacaatccagtgcaagaacttgaaaattgaacatccgagtacaacaacttgacaagtgggtgtgttctagtacaagaacacgagaaatgagcgttctagtgcaacaacttggcaagaaggtgtaacttagtataggaactttatgagtgatcatataaatgcaacaacttgcaatgtaggtacgattttgatacagttagttaagaagttattgttaacagtgaaatttggtaagctcggagtagtcatcggcttagagtcagcatcggcttcgaagtcctgagattcgccgacgagagttgtcaagtcgtcagttgtcggattcttgctatattcggttaaggaaattgatctactaaatgaagcttatacataagagaccgagttcaaagagaatacgacatggcaagttatctattaattaggaatagtttgttagtttccttttatctttaggaaagtgtgtttagtgtcctataaggactttatcttttccttttatctttagtaaactttctttcttatccgacaaggacttgtatcagcccatgggtataaatatgtacacccggggtctatgtaatctatcttcacgatcaatacaattcggcgcatcgccacccttttttacttctacttttgtttttacgttccggcggaacttggcacccgacgcggggctgcatcgtcttcgatctccggcgaagggataagtccaatgttccgccggtccaggcaattgtatcgtctacgtcggcgttgttcaaggctgcatcagtacattcgacctcttagattgctctggtttggatgatatatttgcctacctatttatcatgtctctgttaatctagtcttagcatatcaatttagctctatcggctgcttctcgttttagggtttctgccggtatcggctaaatcgcgttgctagattagattagcttagacatctaccaccctgaaaacttagtcaacggcttgattgtctagatattatgtttcttttcatacttagtgttgcatcagttaagtttgatctactaagtcgtgcttagaaccataatctctagcctgcttcttgattgccaataagggtttcatcggggtttcagccggtgagttatctggatgttgcatcggctcataaggattgcatatacatataagttggatttagccgatgacaacaaaggtttcactgtttaatctaatcttgtggatttcatgacatcggacctccagccgatgtgtgctttaaccttcggattgatgcttatttattatatcttgtttctagccaattggtttctactcgactatattgttattacatcatcaacagccgattgcctttatatcattatctacattggatatatagccgattgcttacactctatcgctatcggctggtatcggcatcggctattattggctatcggctggaactactccatcggctgtcagccgatcgactgttttgatctactatttacatatcttgtcagttgcaggatcaaaccgactggcacgcccgcatatcaacaacctttggacctgcactggagctaagcagatctcccaggccggtgtgttcgattttttagtcaacagttatacaacaacttaattacttggagcatattttatacaaattcatttttaagtacttattttgacaatatactagcatggttttgtataagcatatttatatttttattctattaactaataactgaaagtcaatataattggatgtagaaatagttatatttcggttgatatttgagaaggtaaagaaaaaaaattcttaaaggtaattggatgtgcaatataattcttaaagattaaatttaatattataagttaatatccataggattgctatataatggcatactgacatcgtgagaaaaaaaacttacttagcatatgcttagctaagttgatacaccaaaatactaaattgtcaagttcttgtaatataacgcacccacttgtcaagttgttgcactcaaacgttcaattctcacgttcttgcactggctcgcatccatctgtcaagttgttgtaccgtgggtgcaatttactctaaatacattatggccttctgtttctcttcttaaaatctccttgggatgctagggtttgagggttttttttaatagagggagcaaccctggaatatgacataaatctgaacatagtttatatctagattcacgtgtaaaatttgatttattttgaagtagacggaatagtgtattattaaatctagataactgttgttcacttgtttgtataaataatataaccatacaaattatataatatcttgttgtttggcatatgcttatgggataaccattgcaatttcagattccagcatgctagtgatgtcaaacatccccaaatgatgtttgagccttttggagccttttgaagcatctactgatgttgatgcatatcaagttaaactactctggtaaggcagtatcaccattgtaggcttgtagtagctgctttttttttccactggtaagcttggaaataaaagcttatcctggccaatcaatgtgggctacttgctactaacttgctatcattatttgctttctcatgaagtattagtactttggttgtttggtgtcatcagctactccattcagcttcttcaatacctaaccctgatgagtggtatagaattctaggagctgaattactccatcattcctaaaatataaaggtttttaagtgaataagacacatcctaacaatacaaatttgaacaatcatagtagtatgaatctgggcaagagtctatccagattcatagtattaagatgtgtcctatctacccagaaactcttattttttaggaccgagggagtatgctttaggcccatttgaacaattatttttctctatcttgtaggatttgaactactgttttcatgttgttgtttaaaacatgttctactaatttccaaaaaataatgtctctttcatagtatgatgtacagtactctattatctttcttccttttctgccaaaggatgctgtacatgagctcatctgcctacaggatactgtcaggatgtgacatgctgataaccctttttttccttttgtattttcatggtctacttttccctcttgctcaaaacatcaaatacggcaccttccgtccaaaatcatctttggcacaccactgctgatggtaacctataaacaaagcaaacaccaaattatactacggggtgtttagatactggggtataaagttttgatgtgtcacatcggatattatatagggtgtcgtatagggtgttcgggcactaataaaaaaactaagtacaatatccgtcagtaaaccgcaagatgaatttattaagcctaattaatccgtcactagcatatatttattgtagcaccatattgttaaatcatggagcgattaaacttaaaagattcgtctctcaaagtagttgtactctgtgcaattagttatgatttagcatatatttaatactttatgtaggtgttcaaacatttgatatgatatggtgtaaaattttagggtgggatctaaatagaccctatatgaccttgggtccgtttgagagcttaatattttgagaagcatttggttggtagctatcttctaagaatctagaatagctaggtttcccagattctggctgccagtttattttctggattctacatctataacttcgtagaatatgtaccaaaagctgatctgttgaataagcttttgattctgagagaagtagcaacaactttaagctccccaaacagacctattggttggttaaaaataaactaaccaacgtaaagaaaaaaaaaactgagagggtactgcactactaaaactatgtatagtagaatcaacatagtagtgttacattatacatgtaaaattcctatgaaattttcatgggtcaaacgaagtgtaagtgttgagaactgccagtgtacatttcaattggtcttattttctctcaggcaacttaattgaacacaaccaaattggcaatcacggatacatattttttttttaagaaaaacatataagatacacagatcattatgcacacacatacatggaagtacaactatgaacacacatgtttcaaataaccagaggttcacgataaattcctgcagatcccattaaatccaaaattatatatgaacacatgttcaaatagctagagactaacggtaaattcttgatctcattgaaccctgttgattcctattaaaagtacagcaatatttgtatacactaggatttagacatcaataaatgaagggtgtgtttagttccacgctaaaattggaagtttgactaaaattagaagtttgaagaaaaaaaattagaagttacagggtgtgtttagtttacgttaaaattggaagtttgattgaaattgaaacgatgtgacggaaaagttggaagtttgtgtgtagaaaagttttgatgtgatggaaaagttgaaaatttaaagaaaaagttgggaactaaaccaggcctgcgtagaaaagttttaatgtgatggaaaagttaaaaatttgaagaaaaatttgtgaactagacaaggccgaagtcatgcacatacaatgtcaccgctatacctcccgtgctttcaccataacaactgggagtatcactttggttgtgttcttaccaaggtttcccaactcatttccctcgtttttcgcaggcacgcttttcaaactgttaaacgatatgttttttttgcaaaaagtttctctacgaaagttgcttaaaaaatcatattgatccatttttgaaaaaaaaaatagctaatactttattaatcgcgtgctaatagactgttccgttttccgtgcgcactgttccagttgggaacatatgctccacttaacacaatggcatgttactagggacaacactagtggttggcccattcgagttcaaacacatgaattaaagttcaccttagagctataaaattaaaatttagtttatttaatcgaattagaacagaccaacttatgcctatccctagatgggggaa

SEQ ID NO: 28913 - DNA, 3284 bp, Oryza sativa
tttccccctagatggtgcttgtcaccgtatatgaaaatatccaagttggcaaagcaagatcaaatagagtttatatttctctaggatacgaaaaattgacaataggttgtcttcgggaataattgcacatgttggaaaggtgtgccataccaaaaagggaaaaaaaatgtcaacagactaaagtctggacttagaaagtcaaaagtttcatgcgtataaactgtgtcttaatgagcagaaatactgttcttttatgcagccattcgcaaatgatattcttcctgtgggaactccatgcttgaccgcgtagtttaacataaacattttaaagttccgctattttgataatccttgtcataattcgacttttgaaaaagaaaatctgaatcataattcaaaataccaggttcgtgcgctagctaggagccagacgcataaagcaagcgaatcctcatatctcctcaataaccgtaaaatcactttcgaagaatatatcaaacacaatgatatggtcaagtacatttgcttagcaatcatttagattagtctacagagggatccaagattgatagtacaagaatctgtttaatgcaagattgatattacaagaatctgcttagcaatcatttagaatatatatatagtctgtttggcacagctccagctccagcttcacctctcgtggaactggagctcagccaaacagtttcagtttcaccaaaaataggagtggagctaggtaaagctctctcacaaaatgaactagagttgtgtaactgggtttaggcagttccacaactccactccagacttaattcctgaagctaaatttaagagttggagctgtaccaaataggccctgtcttacagtgaccgaacgcataatcagcatccacattcgactgattttactggggaaagaaaaaaaaatgctctgatgagatatggctggcatcggcacaaaatcagaagcatgatttccactcaattgtgtgtgcacctgacattgccatcgagtaaaaaaaaaaagcaataatctttcgatgaaagttggagccgagggagaaaatccatatgcctcttgtgcagacaattatgtgcaaacaaacttccaaacagtccacattcccgggcaccaagtggagcacaaacatcattgatacttgtgtgtgtgcgtgtgtgcgcaattgacagcatgggtggcactcaatatctcctctctttagcaataatagctttaatgccatgtcctccacaaagattccctgtggataattgaaaagctgatcgcctaattctgacagtgattctcatggcttttgtagaccatgtccatttgttaaaccttgtgatccagagaggatgttgcatatattgatccctgttcactttgccgaacttgcataatcttttatggtatttcttgttgaaccatagttaagcttaaatagcagggtacacacaggtagcaacatgtctccttcagtggggcgtggctagcttaagctttaggttgcgttctttctcatgggttgggaacccaaccctccgcaatctgaattttttaagcaacttttgtatagaaactttttgcaaaaatcgcaccgtttagcagtttgaaaagcgtatgcgtggaaaacgaggaagataggttgggaaccttgagtatagaacacagccttagtagtgctagtatcataaaaaagaactagatataagggagaaaatatcacgaaaacattgcactaaagatcgagaaaaggcatctgatagccggctcatacccatatgaggacccgtaacccaaacgccggttcttaactcacattttttataacacatacctactaaggagcttttatttttaagccagagttcgagtcttggccggtagcctcacaacccaatacttcactatcatacttcactatcgctattatcatcttttctgaaaccatgcgcacgcttacactcctagtagcctgggaatatagaatgaaaggaaccgtagaacatttcagcaaaagaagctctcgacaggaaaccttttggctaaaatcaaggaggaggccaagtcgtcaatactacttcctctatttcataatgaaagattttctagcattgctcatatttatatagatgttaataaatttaggcacatacatatgtatgcaggtaatgctacattgtaaaacggagggagtagtatcttaacctgaagtgtttttggatttttaaagtttgacttcttagatcttttatccatcgtcttagcaaccatgaaaagagacttgggcatcgaaagtgacgaataaaaccaattatttctaacctcaaattctaaaatgcaaaattataatccaaagcattgtcaaccaagtcttaaaaagtgcctcctcaaggaaaattggcaaagtagctgttatgcccatcttgtattccggataatcttgatacatacaccgggtccatggtagaccaaagatgatgcatctcataatcgagaaaggtataatgtgtgagcgaaacattaggtgatggccattgagatgaggatcttatctctgaaaacccaatcaaagatagccgaaagtgtcatcaggttgtaacttttccatcattttctctctttattccgagatatgataactaaaccattattaacaagttggtaatagaccggtcaagaaatagtagcagtggtgggcaaaagaaatgacaggttgcgttggcatacgttactctcaattaattatctttggtctttgcatattggtcagtgggggttggcatttccaatttagatttttgtggacatggattagtgacacagatcgatcggtttgcttggcttatcaacagctaactaatcatgcatgctgctgtttgcaagtcatccaagagtggcattactgattgggatcacaaagattagattagagactatggctctatctgcattgacatttctttagagaacatgtacattggcctaattggtgtaaactatttcggataacttcgaatagtttggcctaagcgtgaataaccctttagctcatgtttcatgttttatttttcaattttattgtagtaaaaccatttctccatccatttcatattataatccatttaataagtttgagtaagtttgtaaaaaaaatattagtacttttaatataaaacaagcatgttattaaaatatattcaatgctaaatttaataaaactaatttggtattgtgaatgttgctaatttattctataaacttgatcaaatataaa

SEQ ID NO: 28914 - DNA, 24460 bp, Oryza sativa
tattcaaatgctaaatttaattaaaactaatttggtattgtgaatgttgctaatttattctataaacttgatcaaatataaaaaaataattataaaaaaagtcaaacaacttataatataaaacgagaatgttcggtgccggtcgcccgacgctccaccaaattatcggacgcactcccccagacgcgcgcgcatgtgctcctgggccccagcgcatgtctctgcctccacttactacgtatctctaccacatactccgttgcaataaatcacccacatattttggaaaccctctattaagggaattcgtttcattttttgttccaccaaaaaatgtttcacctagtgtactcataatgtttcactatgtttagatccaatgttgcagtgaactgaaatattcttttgcaacaaatcacccatatattttggaaaccctttattaagggaattcattttattttttgttctattaaaaatgtttcatctaatgtactcacaatgtttcactatatatagatctaatgttgcagtgaactgaaacattctttcgctatttgctgaaatattatttttatataaggtgaaacaacgcccaatttaaatgtttgaaacatttttgatctacttagtgaaacaattccgatatacttggtggaacatcgttcacatttaaaaataattcgataataagctaaaaaaatttcatcggaatatatccatgtgtggtcttgttttgaaattttaaatgcaacgaatttaatggtacaatcagatcataatttggataaacaatttaagagaaaaattagtttaaagtggttttccacgcatacgtggcgctgacatcatgctgacatcagcgcccgattttcggacgccaagatcgggcgcccgattctaagtctcaatataaaacagagaaaaatattgcattacatagaagcgttgctcacgcgcacgtagatacaacactatacacgcataccatgctaaaaaaagatgaagatcagcgataatacctgacttcataaacaaaagagagaatccattatatgccactccaaattaactggttctcttatatgccacttcaaattgacttctcctttctatgccaccggttcaagtttgtcctcccttttatgccattaccatcgctccaccgccagttgactgttaacttcatagtaagaagacacatttgcccttgagatttagtacacaatcaatgataggtattttagtactaatatagctactggatacaacatatgaaaattgatttttttttcatcacatgcaattttagccatcaccatcacaaataatttttcaatataagcacgaaacatgcagttttccaacaatatttttaatacaaagagcatttttcactggttctgacaaaattttgttcactcaaaaagaatttaaaataaattagttttgatttttttgaaatttacccatttttagttgagagggcatattggtcatttacaaaaaaaaaaaagtaacatttgactaacagtcaactaacgctatagtgctaggagtggcataaaagggtggaaaaacttgaaccaatgacatataagggagaagccaattttaagtggcatataagagaactggccaatttctggtggcatatagggattctctctaaacaaaattatatgaaccaagatttaaactcagttcacatcatcggatcaagtaggcctaggcctgcttaaacaacaggctgggctagacccagaaaacccaaccaaaaagctgcggcctaaccgccaaagcctcgcgctaagacaaaaggagaagcccaagccatccaaacctcggcctagtgttgggccagcattgggccaggcctgggtccggtggcccatgaacaggtctacacaggtttgtccgagcaggcccacggttggtgctagttcggcccatcgaaacaggcccacggtttggtctgttggaaaaagtacaccgaaggtccctcaacttgtcatcgagttatgaattcgtccccaaaccgcaaaaccggatatatataacatctctcaacttacaaaaccgttcactttaggtcatttggtggttttgacctcggttttatctgacgtggcggctgagtcagtgtaggaccaacgtaggccccacatgtcaggctgccacatcacacccccctctctctctttcccctcttctcccttcctcccctctctctcaattttctcctaaatgggcagccggctgacgggtggggagagggtcgtcgggttgaggcgggagaggaggtccggtggtgggcgatgaggcgacggaggtggggctgggcgacgcgacggacgctgcggcggtgggcgacgaggtggcggaggcagggccgggcgacgtgacggtgggcgtcgacgggcgccgtggtgggcgcataggcaaagccggggcggggcgtggcggcggtaggtgcgaagccgggcaccgcggcggttggcacggaggcgggcgtctcggcggtggatgcgaaggcgggcgtctctgcggtggatgttgaggttggcgtctcggcgtcgcaacgatgggtgtggaggtagagcgggcactgtggaggcggcatggctacggggacgatggcttctccgttttcttcatcgagaccaagtgcatgttgacgccgacgtggtcctagcactcctcggtgggttcctcttcgccgctgcaccgacgggcttcgcttcgacccttcgctcctccaccactctcgaccgccgcgtccccgaccttggtggctcacggcgtggccggtggccggcaagggagaagaacggcagcggcgctcggtggtgaagacaggctgaggtcggggagacaagaggtcactgccgccgccgtgctccccctgtcctcttcgatctccccccgtgctcccgccgccgctgctttccccttctcccgcgtcgtcggccgccggacatcctctccatccttgcccagcgaccgtctccccacccgtcggctggctgcccattgaagtgaaaagtgagagaggaaggaggacgaagggagaggaggggagagagagagggggtgtgtggcatcctgacatgcgggtcccacgctgacttagccgccacgttagataaaaccggagccaaaaccaccgaaggacctaaagtgaacggttttataagttgagggacgtgatatatctggttttatggtttggggacgatttcgtagctcgatgacaagttgagggaccttcggtgtactttttccttggtctgttcgtgaagtttcaaaacaggcctgtctccttgttattgagtgcacatcacggcccactaggcctctacggcccataccgatgtgcattgccgagattgtcctcagggctattgtttggctaaccggcgaccgacgacgacgcggcggccgccagcgcgatgacccgagcaaggagggcaagctcgcgaatacgttgaaaaccgcctgaaactcgtggttgagccggcttgaaaccggtaggattcggttgaaatcgataaaactagggcaaaaacaccgatttcgagccgttttcggtgattcgatgggggagggggggggggggggcgcaaaccactaatgttggacttattttatatgggctgaatttgagggcttgtttggtttagtgccctaccaaagtattggtagtgccaaaacttaagcatattttggtagggtagcattttaggtgaatggatttagattgataccaattgaaagccaaaatttatattatacttaagaaagttatagaattatgtcgaattaatcatgggcattaaccattcacttggcttcaaaccaagccattacattcactattcaaactaccaaacagattggtagggctcattttggcatcaatttaaaatggccctgaattcctctctctctcggcctcgatctgtcgctgttgcagactaattaaacgaccaacagatcaagaatgccaatcagaatatagtggcaacgaagatttattaaccatttaatcgcaataacgcgcacggcgatttctctgggaattaatgttattattgttgttgccgtgctattcttttatgctcctgtcgaggtgagtacgtactacgtattgatccatcagaggtccaaggacacatatgcatgcaatgtacatgtacacacacacgcctatctatctatctatctatctatctagctatctatctatctaactaacttttcctaccacataaatgtcaaaataaaaatgtggttcgtgtccacgaacagcgccatgaattgcatgcacacatcccactatttattggcgccaaaaactttactagcactgaatgaaatgctgcttgcaggcactagctacagtagttatagtgcaacagggtcctagtagtagtacacggcccgttccatgttagtacaagttagtattttcgtttatcctaagttaaactttggtaagtttaattaaccacatttgtagaaaaatgtatgtatgagcatctccaacaaaaaataaatgttctatgctgtatataaaagtatatttagtgatagatttaataaaactaatttggtgttgtatagcatgtcactacatttttctataaatttaatcaaatttaagaatgtttaacttaattagtacaaacttataatatgagatagggggaacagcagtagtacgtggcgagggattaaatctgaacagaacagtgtaaggtcgcggctgttctagctagtaattcagtgtactccatgcccattcatggatatatgcgctaaagctgttcatcagcatgaaaacatgcatgcatattctttgcatattaaatgtgtgtttcgatgtttatgcaccaaagcaatatctgcccaatttggaattaatgtagtacaagttccagtttcccgcggaactaaaacttgccatgtggtatgaaatagaatttccctcatctatgtcaattttgagaatttggagtgcatgcatcaattgacagaaaaattcaggcaggcagcagaaatattagagaccacagtagccagacagtctgttaaccaaatcttccatgaaaaataaaatgtgttctaaacatagcctcattataccacactagctagattaattagtagtagattgccagtagaactctaccggcatataactaaaataaaaatcaacgacaaaatgaagtctaatacaatactatctctttggagatatgtccgtactcgtgtcgtgaagtaagtcgtttaggataatgtttaagttaaatcttgagaatataaatcatcactaattcttaaattgttgaattgttgagtttgaaaatataaaaattataagaatagatttatcttaaaaaatactttaacaaaagtataaatatatcactttgcaataaatatttccataaaagtacgttgtagtgcttcggctgactattcaaattgttgaccttcccttaaatttgggaatttggagtgtgtgcatcagttgactgagaatttaattaaccaagggtccatctaatacgttaacacgcaaagcttttgagtttgaaagaacaaaattcaaccatatgggtagcagaaattaagatccaacaaaaaaataaacatacagatcaacacagagcgagagagatgacttgataatagggagtagttacgtacaattaaatcaatataaccagtagcagtagactaaattatgagaaacaataataataagtaaggatgtaatcatacgctcatcactcactagctagcccagtcagagaagaacacaagaggcggcagtaacaaattcagcgtgcaaaaggagatcgacgatcgaggagacaacaagtttcatggatggatatgaatatgatgcagtcgaacacctggtgatgatcgagagatctcgccatggacgaagcgtgacatgctggtcgccgccgccgccgccgccgcgccgcacgaattgatctctttcttgctagctggccgtggtgctggacgccgaggaggacgactccggcgagcagtcccgccactcccatcccccggctgccgccgccgccgccgcggtgtcgcaggcgcagcattgctgcaccaccaccacccggcggtggaagctgcggtggcatccgcacgcggcgcaccggagcgcgccgccggtgccctcctccccctcggcgaggaactcgcggcacccgtccaccgcgtggccgcccatcctcgccgcgtggttccgcctgcactcgccgtacctcaccctcccgcagcaacctcccatcgccgccaccaccgccgccgcaggctgcggcggcggcggctcgcaccgcctcaagattaccatcctcttcatcatctcccgaacaactaacaaccaaagaaattttcgtggcaagatcaatcagtttagctcgaactatctatctatcgatcgagctggaggagaagacgatgagatcatgcacacacacagtgtgcagggagatcgagatttatagccgggatagacgataattatagctcattcgacgttggcgcgactacaccaacgtacctaatagcaatggcaatggcgaggtttgatggcgtgtgtgcatggatggatggatgcataaagctctcacatggcaagagcctttcatacattcacgccctgtggattgggagatcgaccgatggaagacctaagaggggctagctaatgttctggctggccgaattgatggtccagccaattccacctcactgttgcaacacagccaaacatgcaccactactatacccactgtacacttcgttcctctcctcttgcactatacacatgttcctttctttaattcttgggccatatatgcaattaccacacattatattgggttttatgacacatacagacacacctattacatactactactccactagttattattattgaatttactctacatttatgtatatatcatctctactcctcctataggtagctatctcatatctgcaactagctagattttggtatagtactctagcatgcatgcacccatttggtattttctttgggagcgatactccggtgctctctactggtggtatattaagggtaaatcagtaatttactaatacaatgattagggtaacagtgttatatatgttttttttggctagatcaatgtgtggtcatggtattgttcatattccataaaaaaacaaaaaagaagaaataatagtttagtcactactaaataatgattatacttctccgcatatattttttttggataataatggcctccacgtttgtaataactagggtggtagtataaaaatatctgaacccttcaatcaaatgagattaatggttcaaattaatttctactaccaatagatatcaccgtagtgaggctctttctttgattgatttcttggtgtgagaaaaatgaaataatggaccaaccaaagctagggttcatgaggtgaaacttagctagctaacaagagaaggtaggtaggtcaaaaggctaagctaagcctatgagtacatgtgggggcaggagctggtgattgggaatgaaggagaggagagagtacgggagcgccaggctagcgagatactgaaggttggcagctgggttgcattgcattttgcatgcttagctcttggcccttgctccattatcttggctaggttagcttgcttgaccagttcccgatcgatctgcgacgacgatggccggcaccggcacgtagtagctaccaaaccgggccctcactgtgcacgtgttctagcctaactataggccgtgttctatactactcccaggttggatgaaatatattttagtagtatgggcagagcatatccagattcgtaatgttaggatatatatcaacaaaccaaaactcattatattttgggatagtgcaagtatttttttcaacttatcctctcttgtttttccgcgctcatactcatcaaattattaaatggtgtgttttttttctcaaaaagctttgctttttaaaatcttattaatttatttagctaatacttaattaatcatgtgttattcccttgttctgttttgcgtgtttagaaggaaaggtttccaaccttccccaaagaacatagccttctcactgtctacgtctgtttgttggcttatgagccacaatcaaaacttaaattttggaccataatttcagagttgatcagtttggggttttttcattgcatgtagtatattcttgatccagatttgattttaaaccgctaataatacaaatataaaagctttacttataaattattttgtttgcttttcaatcatttatattatcttactcgtagctcaatcaatcatagccttaattagctagcggtgcaattgcattgccggctccactgttgcataggtttcaccctactgttgcagcatgtgcagggttagaggtgaggagggagtacgcagcgatgcacctggttgcaaaaattggtgtgtatacagtcgcaacgtaccgcattgatggagccagaacgcccagattcctggacaaacgttgttgtgtgttttctcttttattagtttttgttcgtgttattattaattagtttcctgctgcttaatttgcttcagtgtatatatagtatgctgtcatggaagaacagggtcgcgagcatgacaggatggagccagcttgatgaatactagtaatcaactgtgtaggtctgtagctagctagctgagatatgagcagtttgtgctgtttctgtgcaatgcaatgtggctgcttgtctcgcttccatccatgtgtgtactgttttgtggtccggtctgcgctttggatgtgcggtggtatatatgtatcttcggtgcaagctagggatatgtgttaatttactgatgttatatactctctccgtattttaatgtatgacgctgttaattttttgacaaacgtttgacctatcgtattattagtttttatgtaattgtcatttattttattgtgacttgatttatcatcaaatgttctttaagcatgatatatataagtatttttatacttatataaaaaatttgaataagacgaatggtcaaatgttggttaaaaaatcaatagcgtcgtacattaaaatccggagagagtacttgttagttggaactagtttagttctctcaactctcaagcagaatgctaaactaaggggaaaaaaagcactgcatagaccgctcatcaccgatgggtcaagattaaattgtacgagatataatggtttgccgaatatgtgataccattgtatgtaatgcatggttttgatccattacgaatatatcctcattcgtagtggctcggttgcacaggttgttactcacgttaaaatttggcaaaaaaaaaaaaaaatccagccccagcccatttccgtagtggtgttgtcgtcaaggctagatccagcacccgtcattgttgttgaggcctgcactgtcatcgtggttggatatcgtcctctccattgtcgccatggctggatccattacccgccattttcaccattgtcgaatccattgtcgctgataaagctcgagcatctgagttgtcatcatcgaggccatgggagcacgacaaaggaataagagctgctcaccgcctcttccaaggtcagatccactatggactatcatcgtcgttgaggccgaatctagaggtggagacggtgaaaaccgtcccgagctccaagatgggcagtcaaggaggccactcgctatgacattggtgcttcgcgggatgagccacctctggatcttgaggcagagtggatccctagcgcaacaatagtaggagtggagcatgagggcatgacaacgtctactctggatggggaagtgaaggcgacgattgatgctggggtcataaaggaagcaacattggccagcgctggggatgaggagggaacgcggtggctacgattgtgttggcatcatggagtccaggtccgacatagtgaagaggagtagtccatcgcactcctcgttatcttagagaggagacgtgtcgacgttggatgtcgcaactacggtatttggacagtatgaggatcgttggtgctaggatatacgtgagactaaggtaaaagagatggggacgaagatttttatacaggttcgggcccctgagtggtcaggtaatagccctacatcctgttggccggagccgatgttgctttttattcaccataatctcaccagtacaatatgtagggtagcctatctaactgttgtcgacatgatggtttgaaggtctgacttgtagtcgacaacagggtagtcttcctcctcgaatccgtgcccggcgagatcagagatagcgctttcatatctcctgacggtatccggagacaccgtaggagaatagccatgcctatccctgaagtcgatattcgacggcgtgtcttggcgtatgtaggcttctatgttgattgtgttgggtgttgatcatgtcgggtgttgatcgtgtcgatcttctgtcgattgtcttgtgtcatggtgggtgtgtcctcttgtcctcctaggggggcttgtatttatacccataggtgtccccttgtccaagtagaactagggaaaccaatatggatacaatccgagtagtccttgtcgtttccatgtagaactctggttgtctttccttatccggaactccctcgaggtcagtttccatataagacatggtatgtggtggatcctgccgagatttagtcaactactattaggtatgtggtatccataaccatgacagtagcccccgacttcaatgcaaatgaacgagttcatattctcagccgcgcgcagacattggagtaactgttatcgagctcatgcgaccgttctcggtgagtttagagaaaacgttggacttcctttgtcggcctcgtgcgggcaccgaaagggtttgtctaagtcaatctctgatgtcgaccgagaaagtacagagcgtacaactaagtctcacgtcttgttgtaatcgagaatttggattgaagtcaagaaattttatctcggcgggtacaccatcttttcattccgtattccttgtcgagatccaccaaccgttctcgagtgatcgagaaggcgtagagtctgcgacggagccttgtcgacattggtcgtactcgccttagttgatcttggtgtagaaccatagagacatagagccctcgtcaatgtcgaatagaattttcctgaaatcaatactcagaaaagaatattagatagaaatagcccccaagcgaatgctcaaagggtgacatgttataatatgtatggtaaactgaaaatgaatcaaatttacccaccaatgttttgtgtaagagtgtcttctcagttcacgactttggtcagtcgtttgagttgtacactctccctagcccccagccttgtcgtcggagaatcgttctcggaggagaaggctcttggacccttgacctgtcttggttgaataagcactgatcctagcccccagccgtgaagttggaaagctcagtttctgattacacggcttggttaatacgcacggcgagaactcttacacgaccagatcttacctggtctttcgtctctgaaggatccgacaaggccttatcggctctgggcgtccccagacgaagatcccttaggttccttggaggccttgtcaggacggcgtaaagggacaacaggataggtttcaacgctaggtgtcgtcgtggtaagggatctctgggtaaaacacttggcgatattgtgtacctgctatcaactttgttgaaatagaggtagtgagagagacgctacgtcgctggtcgacgaccaggcagtagtcgtaacttgaccacttggagtggaaatagtgggagagacgctacgtcgctggtcgaggaccaggcagtagtcgtaactcgaccactagaagtggaaatagtggaagaaacgctacatcgctggtcgaggaccaggcagtagtcgtaactcgaccacttgaagtggaaatagtgggagaaacgctacatcgctggtcgaggaccaggcagtagtcgtaactcgaccacttgaagtggaaagtgggagaaacgctacatcgctggtcaaggaccaggcagtagtcataacttgaccacttaaagtggaaagtgggagaaacgctacatcgctggtcgaggaccagacagtagtcgtaattcgaccacttaaagtggaaagtgggagaaacgctacatcgctggtcgaggaccagacagtagtcgtaactcgaccacttaaaatggaaatagtgggagaaacgccacatcgctggtcgaggaccaggcagtagtcgtaacttgaccactaaaagtggtaatagtgggagaaacaccacatcgctggtcgaggactaggcagtagtcgtaactcgaccactagaagtggaaatagtgggagaaacgctacatcgctggtcgaggaccaggcagtagtcgtaactcgaccacttaaaatggaaagtgggagaaacactacatcactggtcgaggaccaggcaatagtcgtaactcgaccacttaaagttaaggtgcgagagattgctacatactggtgcgagaaccagtgaacgagcagaattatctctcgaacaccaatggaagttgcggtgtgagagattgctgcgtactggtgcgagaaccaatgagcgagcggaattatctctcgaacaccaatggacgctgcggtgtgagagattgctgcgtactggtgcgagaacgagtgagcgagcagaattatttctcgaacaccaatggaagttgcggtgtgagtgattgctgcgtactggtgcgagaaccagtgagcgagcggaattatctctcgaacaccaatggaagtgctagagttggtctattgcaagtatatctcatgtggccagcatgactcacgtacccaacttatagcatatccggatgtccgttcgcaatcatgtcgggtgatcaagccgacgacgttcgcgaggaattatccgttaacaaccttttctcgagtagtccagccatggccggtgctatgagataagtcgtcggtcttcgttggcaggttgggtgcgataactccgcatttgtggagaatgttctcgataatggagtgtactcgaccataacctactcgagtgctcagttgttcctgaaaaatattttctagaaggcaagatatatagcagagaatatcgaatatgtattcaaaaaactgcatggatcttctagtattatcaggatataacgagcagatgtaaatatcatgcattatgtaaaccgtaaacaagcatgatttatacagaagagaacggagcgagccccagcgttggaccgtagttggcctaacatcggggatgcttgcacaacgtatattgtataagaaacatgctctaggtaaacataataaattatagatctgacaatgctgtatgatctgaataggtacgataaattgcatataaaatattacgtacctttgtagatacatgccggatgtatctacgaaattagtagatcaatttgaaaaaccaaattaccttattgcgtactcgttcgacatcatatgatctgacatcttttggtacgccgcgtatcttgaggcttggatgatctcgatagaccaagttgtcgatgacgatgatggttccgatctggtcggaagatgtatttcagttaggttagatctcctcacatccgaagtcaccgagtagcttgttatcggagagtccatctcttaaacccatctcgtcgaaatcctagagcaccaaaatccccctacctggtgcgccactgtcgacgttggatgtcgcaactacggtatttggacagtatggggatcgttggtgctaggatatacgcgagactgaggtaaaagagatggggacgaagatttttatacaggttcaggcccctgagtggtcaggtaatagccctatatcctgttggccggagccgatgttgctttttattcaccataatcacaccagtacaatatgtagggtagcctatctaactgttgtcgacatgacggtctgaaggtctgacttgtagtcgacaacagggtagtcttcctcctcgaatccgtgcccggcgagatcagagatagcgctttcgtatctcatgacggtatccagagacaccgtaggagaatagccatgcttatccctgaagtcgatatccggcggcgtgtcttggcgtatgtaggcttctatgttgattgtgttgggtgttgattgtgttgggtgttgatcatgtcgggtgttgatcgtgtcgatcttctgtcgattgtcttgtgtcatggtgggtgtgtgtccccctgtcctcctaggggggcttgtatttatacccataggtgtccccttgtccaagtagaactagggaaaccaatatagatacaatccgagtaatccttgtcgtttccatgtagaactctggttgtctttccttatccggaactccctcgaggtcagtttccgtataagacatggtatgtggtgcatcctgccgagatttagtcaactactattaggtatgtggtatctataaccatgacaagacggtccaaacagcagcggtgcaggttaggagaaggtagagaagatagtcaaggaggagatctggatggccggcccgatttggtgtctggtgcccggtctagacgtagagagataaggatcgtactagatggatactactatctataattgttgcagaaaaaataacccattatagattacttatgttttctttaacaggttttaaataagtaaccatagcaaataatttgacatatgtaaaaactgcatattaagagtggttgtatatgaccaacaccacatctatataactgctcctttttttagaccattaattatagatacgtagtcattatcgatggtacgtgatggtccctatatatatagatctttaacggtttatttaaacaattgtatgggtataataatttgtgataggtctctttagccgtcatatatgaaccgtcagagtgaaagaatacttacatggcacgtaatatgttactacctcttttgattcacttatcagcacataccttaattgtcgaaaaattaatattctcctgtcccaaaatataacaacttttagctctcaggatttgtctcgaaatataacaacttctccaacaacattctcttcttaaccattcataaccctccaccattcactttttccacctactttcactattcatccaatcacaactcttcaccattcacttttatatatttttttaataaccgcgtctaacgataaaactacttacaacccttcttatattatgggaggagacgtagtaacaaccttctcacctcgatgtgaggcgaatatgaagttcgctccatcgtgtgcattaattgaaaggactacctgcctgtcacctctgcacaaaccgtgtacgcagaactagaatcctccagtaatgagacatcttcagttaattgccatgatttgatcgagcaaggacaattgctgaaatatccagaatagtagcagaagtagagaatccatacaacatgcaatgctttcaattcgatcgtccaaaaaaaaaaaagcattgtagtgcagtactgcacaaagtaaataccacaccactgctacaagcattgcatgcagaggcaggcaggcaggctatagcttgcaagaacggatcgatctgatgagcgatctactacacttatgccctgtatagtttccaaacaacaactttttaccttatcatatcaaatatttggacacatgcatcatagagtattaaatatagacatagaaagaactatttatacatattacatgtaaattatgagataaatctctaaacctaattacgccatgatttatttgacaaagtaatcatttgctaataaagtattgattaggcttaataaattcatctcgcagtttacaagcggaatctataatttgttttgttattagactatatttaatattttaaatatatatttgtatatccgatgtgacacggaaaaccttttcacctctggactagagagggtcttagaccctgtttagatcagacatttaagttcctatcacatcggatgtttggacactaattataaatattaaacgtagactattaataaaactcatccataatcttggactaattcgcgagacgaatctactgagcctaattaatccatgattagcctatgtgatgttacagtaaacattctctaattatggattaattaggcttaaaaaaattatctcgcgaattagttttcatttatataattagctttgtaagtagtctatatttaatactctaaattaaaattagtgtctaaatacagaactaaagttaagtcactgaatccaaacaccaacttaagctacctagctgaaacctaattacgacaacgatatgtacatccatccgttcatcccctgatcgatctggtcccgttccagcactgtaccaggcgtaacgaaacttggctggtttctgcacccagccacgtacacatcgcattctgtgatttgcctgtctctctgcagtgcatcactgtgcccacgcgtcgctcgcgcgcgcaacgtactcctgctctcgctgctcaccgctgatattttaaaaaaaatctaatattatttattctgactatataaggtttaatcgttttggattggattcctaaaacttaatttctattagtgtcattcggtttgtagaattgaagtatatataggaaaatcaaagggaaattctctttcctacaagttgtatagagaaaacatagaaatttttccatccacttataaaacctcttgaaaaaattcctatggattgatgtgtgcaaacattgttatttctttacatttcctattcctatgcatcaaattcatccaaatcaaataagccctaaaagtaacagtatgaaagaatctaagagtttataagatcgagaaaaaaatcactctttaataaactttatgtctcgtgcagaatacaatacgatttcatctttcgtttcatcagaaaaaatggctattcattacatatcatagtccgagatggatgtataaagagaaagggccacattatttccctacaacgtatataataataccaaaatttgaatcttaaaacttaattttagagttaattttaaagtttttttcatcatagtttatttttaaacgttggcatttaagtcattaagaatacgtaggtaaaagtttaatcataaattattttttatcgctaataccgtttaactattatccgtaattggccaacaaatggcagtcaaaactaattggagcatttattttgacaccagagtactataatgatatcaataagttttgatcattttttaacaaagttttaaaatatctgaaataattttgtattactccctccgtcccactcgctaagacgtggtcaaatttggtacagtcttaaaatcataatcatataaaagtaaatttaaatgataatacaatgatatcatttcataaaataaattttaatatatagtaaaatatttattgatcaaatatttaaagagctaaattttaaaatacgtgcgcatcttagtgagtgggacggagagagtatcaaagtttttttcatctttcctctctccttccatccgtttgcaaatattagtcaccggagtaccgttcatctgtacgttttgatcactcatttttctcccagaagttttaaaatataaaaattgatgacatattatatattaaactttgttgtatccaaagcatgaaagtttcatctatcatggtttaaccatttaaaagttactgatggttaatactgaaacagtagaaagcccgtttcggaaaaggagtagaaagttaaaatttgataagtaaatgtaaaacggaggtagtatagtgtatctgaattttctgcatgcatgcagttctggctttgctagctatatatagctgatcgatgctggtccaggccggcttatcaattgtatctcatttcctccggcattaattactgccgtgctgcttaccaccagtacactaacactgtaagtctgtaatataccactgtatatacttcttctgtccgtgtatgtacgtagccatgattcacgtgtatacactccctccattttttaatatatgacgcgttgaccttttaatatatatttaattattcgtcttattaaaaaaaatataattattatttattttattgtgacttgatttattgttaaatgttatttaagtgtgaattaaatatttttaaacttacacaaaaaatttgaataagatgaatgattaaacttttatcaaaaaaagtcaacgatattgcatattaaaaatggaagaaagtaagttttactctgtaaagactgcgaaatattgggatagatagggatgaattaagctgcctgcaagcaagcaagggtacgggagggggatgagcgacgattcaactgaaacagtcgccgctgcagggaaacggccgcgacatggtgggagcgagacgccgtgcgtttcgctgaattctgcgtgcccccggcctgatcgacgtggaaaacactggaaaaagacgcgaaccgcacgagagcagcttagcttttagcctctcgcgccggccgccggccggacgtcgagcgaggcgaaagcgacgacggaatctcagcgcacggccgccaaatagggagaacatccgtatccccatgtaggacgtcggggcgcgcgcgtgtcggcaacggaagaggaatcctctctgacggaattacctatcgtgacgtagtcgctgacatgtgagacccattatttttcccgagtccatatgtcaagcgatcatgtttcttttgagttttgttacgatgcggttttctttttcagttttgtgttagatattaacagtttaattaaaacaaatgcatataacatcatgataagtattttttcctccaagggaaaaagatcgagagagaagttaattgcataatttaaagctacctaaaactgaagagaacatgaaggtggaaaatggatatatacatagcaaaggcctagtttctaagtttgtggtaactctagcagattcatgaagccaaacacaatcacgtgattcacaccacctcagcagccagaccagacgtccgatcgaccagccgacgagaaaagatatctcaatagttccctgcagatctgcaactgctaacttgccgtactatactttcagatgaaatatatatacttataccgtgtttagttccgaactttttttttcaaacttccaattttttcatcacatcaaaactttcttatacgcataaacttctaacttttccgtcaaatgattttaattttaactaaacttctaattttggtatgaagcactgacaggatagcattgacaggataagctgatactggtatcagataaaagatcacaagaaggagagccttttgcctttgctggatttgattcactcgtcgacactggattttgacaaagatagtcgcatctagggatggcaatcgggcgcgacggacacgggtagtacctacccatacccatgtccgtaagattatttgtgcccgtgggtatacccattactacatgacgggtaaggatggttgcccatgcccattgcccgcgggtgtcttatgcccgggggcgtgcccgtttacccgccacaacaaaagcagtggaacaaaaagtctacaagctactaagttcgaatcgaacttaaaacatcaaatattctccgcctcggtgtcgtgtctctcctctggtggcgatagagtaagaggagagaaataataagggaaataaaagggaaaccgtagaaaacaaagaacgtggcttatgtattctagtggattttgctcctagcctacatgtaagttagatttcgcgggtaaacgggcaaagcgggcatgggtagtgattacccatacccatgcccatttacccatcgggcatagcttttgacccaataagatacccatgggtataaaatggagaacaaacccaaccctaatagggtttttacccgcgggtaaacgggcaaacgggcacaattaccatccctagtcgcatcctcgctctgtccaatttcctcacgataacgccaccagaccaccaagcccgtatccaaaggcccaccaatccacgaaattgaagcccatataatggcccacgcgtaggaaaggaatcggcccatcgcggactcgcggcccacagcgggattatctggttgcgttttccaccctcccgcgcgcgctgccggtgacgaaatacgatgatggaaattcccgatcgactgaccatcgttcatataaaaatgatatcgtttcagaccgatggacgattgtttctgtagaaatgatatcgttttcgaccgttttcatgtgtgatggctggcggattcgccggccgccgcgtgataacgtacacggccctcagctcgtgcgtgcgagaggacgcgtgcatgggcgctcatcaatggagaccggtcggtgatcgatatcgccatcatctcatcgatatatcgccacagccaaggcgttcaacgtttaatcgttgcgaacgcgcgtgcgcgcacgcgtgcttcgaccgcatatgtatgcaccacgcgcatgtggcttatgcgccgcatgcatacggcagatgatctcgtgtagtccccatatacgggagtaatttgcattgtcatttactcccttcgtccataaacattggacgccgttgatttttttaaacatttttgaccgttcgtcttataaaaaaatcaagtaattattaattgtttttctatcatttgattcattgttgaacatatttttaggtgtacatatagttttacatatttcacaaaagttttttaaaaaagataaacggtcaaacatatttaaaaatgccaatgacgacaaatatttagggatgggggagtacaagtttagtcttacgcatcatatatatcttattttgggatggaagtagtagctatagctaccgtacatattgcctcttttttctgttgggctagctatctctcgatctcgatcacatcatagttagaatgattttagaattcttgagaagatattgaaaggtactatataagtttagtaccagctcttggaccttcgatactgtaaaatatcaaatttgtattaaaaattttaatatctcttaagacagaacatctcaaagatgctatggtaactaggggtggataggaagcttgtgactagttagctcgctcggcacgtgacaagctcggctcggctcgttgattttcctaacgagccgagctgacattttatagctcgttagagataacaagccagctcgagctggctcgcaagccttaacgagctagctcaacaggccacaggccacaccaccacaggtccacagaccatagcccaccacatggaaggcccactggcccaatagagtgcatcacaaaaccctaaccgctcgtctgttgatccgtgcacacctgcatctaaccgccgcatcggcgccgctcccatcgccatcgcccatcagcgccgctccccgccgccgccaccaacccgcatcgctgccgctgcgggaacgcgaccgcgccaagccgccaccgccgccaatccccatcgccatcgcccatcggcgccgctccccaccgccgccgccgccgccaaccctcatcgccattggctccgccgccgcgataacgcgaccgcgccaagccgctgccaccgcccgccactgccgcaggaatgcgatcgcgccaagccgcctacccgtcaatctccgccaccgccgccccccattctccgcgcggccaccacccgccatctctcccctcagcggctagttcgccagtcgccactctccgccgccgccgcccaccactagctctctgccacactcgtcccatccattgtgactctgtgagcttctcctgtggtcgccggcaagcctcatccccatggtcaccggcaagctcctctccgtggtcgcggtgccggtgaggttgagctcctccctatggtcgccgaatgccaagtaaatgaattcctttctctcttgtccccaaagctcgcgagctaaacgagctggctcgagcttgcagacgagccgagccgagccgagccaggtttctagcttgttaggataacgagtcgagccgagctggctcgttatcttaacgagtcagaccgagccgagccgagccgacatccacctctaatggaaactaaacagatacagatatagaatctatcgactctagagacgaagtcatggagagtaaaaggccaatcaagcactatatgatactttccggaaatgtggttatatattctggtacatttttactgtatatgatacgcccaacaaattaagtgggattccgtaacgggataaatcgtcaataattaattcagctgggggagacaaacgtatcgatctccccaaatgtacataagcgaaataacttcagtaccgtatagtgcatgctttatgagttattctcacgtacgtactccctctatttcaaattgatctacatattttacaggtacaccaagaccaagaaaagctaataactttctcatactatatttactctagcaacaaactcaatgcatgcaccatccccactatttcctaaccaatagcaaatcaagattttgcatgtgagttataaatacttgtgatgcatgcatcaatgttcatttactccaatgcacaaataacgaataaagacttaataaatgaacacaaatatttagatcatttaagaataaccaaaaaaaactatatgtagatcaatttaaaatggagggagtattacgtagtatatatatcctatcgatgatcggcatgcacgcttgccgcaacatgctcgctcgccaatgtacgtacgcgatcgtgtttgagatcttctacaagtacggtgttatatatgtgcggtgtcatatcctggtacttctcgtacccctactactaccactaccggatcattcaatatatatatacacacacacatacacacatatacacacatatacatacatatatacatatatacatatacatatatacatatatatatatatatacatatatatatatacatatacatacatatacatatacatatacgtacatgtatatatatatatatatacatattgggcgtggaagaagaataaacgaagatttcagaagactactcaagaaggaatccagaaggacaccctataaagcataaaggaacaatatagggtgcggtgaatgacagcggtgaatgacatatccctgtgaagaataaaactttcggcaggaaaggcctcaactttagcctgctctcgtgaatccacagtagcgaagagataagtaggaggcacaggcgacgccacccctgacctctataaaaggaggggcctgcccagctgaggagaacacaacaacaaaaaaagacaccattcagagcaaagcttccaagcgcgctctcaccctccattccaccgttcttagtagtagtgactttagcctatcttgcatagtatattgaagcaagaagttgtgttataacgctgtgtaaggtaagaacagcttgcttgtacctaccttcgggtttcccgaaagggaaaaccgtatgtaagcttatctgtttaatatgaagtaattttccttaagtattcctgcacgtttgttttagacaagtgtttatgctaaggaccctataggagaaacctcttcggtttgttctcgtttttagcctgcatcttgcataggcgtctggagaatcggtatccgtagagaagtgttcccttcgggtggaactgcctggggagacgataaactcttagctagaacaagtgtgacttggaatatctttttaagttgcttctaaaaagacagataggtgaggcatacggtgagtaccgagtagaactttacatcatctgaaacaagcttctgaggctgtctaagtaggattcgccaccctgcaaagatcctaaagttaaaatatctctcgaagtgaacagtattgaacagtaaactgaatagtaatcagccgaataaacagtaaactgaatagtagattcttgaaatattgtatattgtctgaagtataggtggtatgagagccagtcatcatagagaaatcaaattcagaagctaatattggaaaggtaattactaccaaagataatctgaatataaggtgtagactaaatcacattgaagaccatagttggcactctaacaatagtcaattaaatttaattgttgatctgatatataatttttatataaattgggataaaaagcaggaagatttagagcgaaggattgaagatttgtttaaagaa

SEQ ID NO: 28915 - DNA, 705 bp, Oryza sativa
gtataaatatattcaccaaggtatgtatataataggaatcaaaggtatgacaagaaagaaattaggaggtaaagttttaataactctgttagataaaaggtgggacacaatagataaagcagcattaggatttttagaaggtgatatgaatgagaatatgttgataacatatatagccccagatctaatgatgcctataaaagaatttatagataaaatgagttttggttttcaaataaagggatacgaagaatttaaaggaacaaatttgctagtaagcatagaatttataggaagattaactaatagaagtgcctccaaatacaaaataaatgtaaatgatgtgattgaaaatatgcactttaagagaataactttcatgagccctttaaaaataagttctgaagaaagggcaggagaagaatggaaaattagtgatttaattgaaagcaaaactttgagtcggcctgaaaattatataagttatcaaaacagtaaaggaaatagcagcattagatttataaattacaaacccagaaccacagatgacttagaaacagaagcatctgatagaaatataatagataatagaagacatagtgtttcagagtttatggaaaaattagatcaagaaagtgagataaaatattacgaaaataaattaaaggaaataaatgaagaatataataactctatgaagagtga

SEQ ID NO: 28916 - DNA, 123 bp, Oryza sativa
actatggttgctttgacgagcacgtataacgtgctttcctcggtagaatcagagcgggagctaaacaggaggccgcttaaagggattttagacaagaacggtccgccagaatcctgagaagtg

SEQ ID NO: 28917 - DNA, 1075 bp, Oryza sativa
  unsure (1)..(1075): unsure at all n locations
caaaaatacaaaaaagctaaaggaaagaagactccagaaatacccattaaaacgactataaaagaagaagggtattctaaaaaacccacatacaaggaatgcctaacaaaaggagtggatccattagatggggaatatattgattggaaaataatagaaaaatttgaagaagcctccccacaattaaagaacgaattaaaggaagaaatacttaaagaattaaaacaagaaatggatcagaaatttgaacaaataaaaaaggcagtagatgagaaattagaagtttctttttctgatctggacactatggatcttggtggtcatgggcaaccagatgaatagaattctttaagctaaatatgtttttcaatatatattgataatagaatatcaacaatttgggcgtggaagaagaataaacgaagatttcagaagactactcaagaaggaatccagaagaaggaatccagaaggacaccctataaagcataaaggaacaatatagggtgcggtgaatgacatatccctgtgaagattataattttcggcaactttcggcagtgaatgacatatccctgtgaagaataaaactttcggcaggaaaggcctcaactttagcctgctctcgtgaatccacagtagcgaagagataagcaggaggcacaggcgacgccacccctcacctttataaaaggaggggcctgcccagctgaggagaacacaacaacaaaaaaagacaccattcagagcanagcttccaagcgcgctctcaccctccattccaccgttcttagtagtagtgactttagcctaccttgcatagtatattgaagcaagaagttgtgttataacgctgtgtaaggtaagaacagcttgcttgtacctaccttcggatttcccgaaagggaaaaccgtaagtaagcttatctgtttaatatgaagtaattttccttaagtattcctgcacgtttgttatagacaagtgtttatgctaaggaccctataggagaaacatcttcggtttgttctcgtttttagcctgcatcttgcataggcgtctggagaatcggtatcc

SEQ ID NO: 28918 - DNA, 20983 bp, Oryza sativa
  unsure (1)..(20983): unsure at all n locations
ttaacgtcaaattcattatattttagccgtaacaaaaaaaaaacaaaaaatctgacagttttaaggttgcaattttgtcagaattttatcttttttgttattctctatgtagaatgaatttgaagatgcgactttgcacgtagatgcaatactattgaaagtacatgtatgaattttcctagaattttttgtgataatttttagttggtgtacacggtgtacacacgagggcctgtgtgcataggatacgctacctacatatatatacatatacatatatatatacatatacatatatatatatatatacatatatatatatatcatgattagggaaatttggcaagataaaattggaatgaaagtttaagatgttgtttctgcataaaaaatgagaccatacaacatctttttcttgactgtcattatgcaagatttgttggagaatagtacaattctcttttggtttaaaccttccaagtaccatatctaatatatttgatgggtggcttataagagttaataagaagaagtgtaatcttatacttgtaggagcatctgccatatgttaggccctgtggttgagtagaaatgatttagcttttaacaaatcaccatatactccatatatgcaggtaatattcaagataacatattggctccggttttaggcaaagctgcaaaagtgtgaagaggatggtgaacttatgaagtttgtatgccgtaaactcgagacgacggtgatgcaactctttgcaaattatggatggagattcacaaatagacttgaataaatgtgtactacttatcttggtttgccttttattctgttgagtgtgtttgattacatttgaactacactctttgtatgagtgatactttgtaataattggctgtaactctgttgagtcaaggccgggatataaattccattatctaagaaatcatgattagagaattttggaattaattgagctgtacatgaggtatatatatcccatccgcacatctttatgtaattccttcttgcattgtgttttactcctccattttattacacacgcccccccccccccacacacacactaccacgttcactcttctatttaaactatttttttaacttacaagggatgcttcatatagacgaggcatttcccgcgcacccgaaccgccactcaggtacattttttttttaaaaaaaaactaatacgtgtaggtgccagtttattaacaaaactgacattgctgagaatgaagccaagctgactcgacaaaccaagcaggtctatgcacctgctcaccctcacctctactaccttttgctcctttgccaccactgcccctccccctctcctccaccgccgccgccacaacccatactgctttttatatctttcccttttcatttgttgatctaaaacttatgtcgttcatgactatgagctgaagattttctcagcccatccttagctcttactccgatcccgttctcaagttcgagcctactgtccttattgacctcaagccacgccgatattctcgatctcaagcacacagtgctactcgccctcgatcgggtttgagctcgagtagatccggaggggcacgcttaaaggcaacctcgtcccgagcttgagctggccaccgcaacaatgggcaacgcggtgaggtggtggtcccattgaaagggagcccaagtggcatagctagctcatgtggtgtcgattgtcgccaacaaggccaatagtcaacgatggagggtgaggtggcaatgcatacatggctcttgggagccaacgaggatgacgacgatgaacgaattagggtagctatattttcaatttagtaggccaataaacggcccaaatcgttcactggttttcgaagagaaagctaaccacacgtgagcaaccaatttattgtgttcgggcgagaggtgagagagtatgacagctgggccatcattttttaaagaaaattactgacatgattgccacataggcatcacgtgtatgtcacgtaggacaaaactgctccggattggataatgtggtaattcatccagtattaattcatctagttttcaggtttatgggagtaattcgtactcaccctaataattaggactttttctccatcaatacctctttcaatgttgcaattcaacttttcaaaatgatatgctatttcgaggaaaaaaagaactttccaaaaaaaatttaaaaaacaaaattgttaaaatttcccccttcttatagattttattcaaataattaacaatcaaactagagtatattatcatgaccattccctgttctttcttattctctccatatatctccatggtcgaattaatcaataactaatctcggccacacacttgttccttcaattcccacttggggtagctagcttaatccaacccaatcgccatcgacatctcaacatcgccatcaccatgatcactgtcgcaccattatttcatcaacccctgtgtacggggcacgatcgagaaggtagtatcatgcattatcatctctgcatggcttgctggttaagctttttttacccattcgttcgatcctcctctactcctctcacacggtcgcattcgatcccctgcacgtcatcgtcgatagatcgacggcgtccacaatagcggcggcgcgcggccggccaagtcaaaatccgcgagtaaatgttaatcgctctcacggccgtagattcaggccatgtttagtttccacataaaaattttatactatatcacatcgaatatttgagcacctacataaaatattaaatataaactaaaaaattaactaattacacagattgcgactaatttaggagataaatcttttaagcccaattacttcatgatttgataatgtgacgctacagtaaatatttgctaatgatggattaattaggcttaataaattcgtttcgctgtttactgacggattctttaattagctttttcattagtgtccgaacaccccatgcgacaccctatataatagccgatgtgacaccccaaaattttacacccgtgaatctaaacacccctttaacgttaatcgctctcacactactacaatagctatttttgcgtgcgattttttcgcccatctggagcggggtgtctggtaaaatcgcgattttctcgcgcgggtggcgcacctgcacgcaaaaatgggtgcttatgccacccgcatgggaaaataaaaatccaaaaaaaaaaatcaaaaaatggaaaccataaccctagatccgggcaccccatcgccaccgccgcgtcggccaccgccaccgccggatccgagcaggggactaccgccgccgccagattctgggtgtggggagggcggtgccgctcccggctgcctcgcgcgagcgtcgggaggagggggataaggtcgagcggcggcggcggcgccgctcccagccgccgcctcctccttgtcatcgtcggcagcggcccccatctgcctgccgtcgcctccccaccgaccgcccgtcgccaccgagcacgccgctcccggtcgccgcgcacacaccgctcgctgtcgcgtgcacgccgctcccggtcgccgagccctgctgctcccgtccgttgccgccgcgagtccgccgctttcgccaaccaccgctgagagccgcccggaggaggagaaggaggcgcgcggcgccactgcacatgaggagaaggagaaggtgagagagagagaggaaagtgagagaggagaggaaagtgaggagaagaaaaaggggagagagaggagagaaggtaccgggggagagtaagaagaaatttaaaattttttgaataggatgggaggaaacgaaaatagaaaaatagacttattttcgcgtgcggtagattaggaggcccgcacgtgaaaatagacttattttcgcgtgcgggcctgttaagtgacccgcacacgaaaatgattttcatgtgcgggtgacgacctggcttcggtccctctatttttccgtgcggtccaacttacggaccacataaaaataaaatggggtggcgtccagaaaaatcactcatttagtagtgtcatggccgtaagggattcacttgcagtgagtctgtgtgacgaaatgtcgtcgtcgtcatcgcatttaacgccacggcgccaccgtgtgatctcctgtgtctcgcacgtatgacgaccctcttcggccggtgccaggcggcggcggcggcggtggcgactccggtgatcgtcggccgacttgccggacggatggatggatggatgaatggtagaggaaatatcttgcgatgattcttgatcagaaggcgatgatgtgatatgcaggggtgagaagaagatgcattcatgggttagagtaggtccagttgcagggcagggagacaccggagtaatggctatggacgacatgcatggggctgactctttctcctgcaacacagtagtgccatgcaatcatggagcagatcagcagactgatatttttttagttggatatataaaagacaatagacatatactcctagcatatgtttggtttggggactatgtgggatgcgatgaaaccatatctgattttagggatggagtgatccaacttacttgtttgatttatagaatgagctgataccagtttttttagtagaagggatgaggatagggatgggatgaacaatgtttggagacattagcaccacgtctactcccagtgaggaaggagcggcggaaggaggagcggcacgggcgcgagcggcgaccggcagtgcggatggaaggaggagcagcgtgcgagcgagtaggcacgggcgtgagtggtgaacggcggaatgaggagcggcgtgggcgagcgagcacgtgtagggaaggaggagcttcgcaagcgggcggaggatggacgggcgtcgggggaggatggagcgacaccaggggagggagcaggtggaggaggaagaagaagtgcctgtgaagagagcggcgccaggtgagggagggaggaggaggagggacaggtgctggggcagggtgtaggtggaggaggagggacgggcgacccatggcagcgccgcggcgggagctgtatatggggtgaaaagttttggcgtgccacatcggatatacggacacacatttaaagtattaaacgtggactaataataaaataaattacatattccgcctataaattacgtgacgaatttattaagcctaattaatccgtcattagcaaatgtttactgtccactttgtcaaataatgtagcaattcggcggcttaaaagattcgtctcgtaatttacacaccacatgtgtaattagtttttttttatatattaatactccatacatgtatccaaatattcgatgtaactgcgtgaaaagtttttgcgtgggagcgctgacaaaggcacgatgttttaaagacaggacgtcaatcccgttgattctacgtacagtcacgctgcacagatgtaaattaacaaacgcaggcgctgaactgcatacatgacaaacgccgggttgacttccaccggcttaatttcctgttgcatttatgagagtcgatcgatcgatcgatcgaccgaggtgatgatcgtccatcttctccatattggattgccattactgcgttcctagtctcatatatatagaacagattcttgatgagtagctaaggtctcaattataaagcacgcacagttccaaggagagcgaggcgagacgaccggtttccaacttaatttccccattattcatgtatatatgcactagccagcaagctagcagccacgcaacagtatgcatgcaacagtacgattcctcctactcctacaacgattgtacttgtactctctgccagtcttatgtactctctctgtgtaaaataaatcaaccttatacaccgatatgatacatcatactaccgtataaatctaaatataaatttcagatttacggtattagaatataacatatcgtgtacgagattgatttacctaccacttcaatttgatccatgaacatatgatcatctcgctctcgatcgatcgatcgatcgatcaaatgctgctttacagctacacgacacacacacacaaacgcgaagagatcgatgaaaatggaagagctgaccaatgtcaataataagtcatctcacatgtggggagtcgtatagtggtggattaccctactgtgtcgagtaggggaggcgtacgcatttaagccgcacggagctttcccttttctgctcggcactgcaggctgctgcattcaagtcccctacgtatactcccagttcttcacacttcttctgcatgcactcgcgcacacgtacgcacactgctcaatcccctttccttgtctttctagtaggagtagtatactccatacatccataaaaattacgcctatttcacatttaagtttttccaaataaattatttctatttatagtttttatatatttaatacttaaatgaagagataaattaaatgttttattagaacccaaggagtcatctaaatactcattggtagcatgattgtattcactccttaatttcatattccctccgtactcgtaaaggaagtcgttttggacagcgatacggtctctaaaacacaactttgactttcttttctataaaaatatttattaaaaagtgatatatgtatactttcatgaaattatttttcaagataaatctattcatataatttttttattttcaaactgaacaacttgagagttattcatgatttatattcccaaggtttgacttaaacattgtcctaaacgacttcctttataagtatggagggagtaacatccaagatgatttaatttcttcttaatcttggtgtcaatagtaatatgtgtaacttttgtagatggagagagaatatgattacctcaagctacatgctacctctgtttttttaatatatatgacacttataatttttttataaacatttaaccatttttcttatttaactgttttgtaaatataaaaatatttaagtcatatttaacgataaatcaaatcatgataaaataaatatgtattatcaaatgtatcttaaaaaatcaacggcgtcgtatattaaaaaacggagagagtaattaattttgtcttcttggaggttcatgtatatatatgctgatctgatgacaaatgacaatgtactgatgttacatggctcaaaataaataaagggcacacagtgcaaaagcagcaagctagctctccccgcacacaagaacagcactcacagtcacaggcctaaagcatatatgcatctgcaaagaaggtgagaaagaacacagtgttttagttataactacaaccttgcatggtcatgtcattcatgagagctgctgtactgttctttttcatttcattttttttacagcttcaaggaaagaaagaaaggtgcagcaagcaggtgcaaatgcatgcctttgagcaaaataaaaaaagaagaggaaaaggtcaaagctggccagctttaaagatctactactactagtgtgggcatttaaggcttgcctgcatatttccaagggcagtagtagtgtatgacatgcatagacccccttctctcttgttcccttgctctttaatccttccctgatgagcctcagccctgggccgctgaatccatgggactgccagttcagtaccgcgctgtcgcacaccatggcatgcgcgtaggatcagcagttcagcttactacacttttgtttttcttttacaagagaaattctttttaggcttttagcactcttgtaaaactatgtactcccctcctcccggttcaaaataattgtcgttccgagtgacgatacgatctaaaaatactttggtcactattttctatcgtaatatataaatattaataaatgtatgatggaaagtacattttaatgttacctatatatatgggttccatatttttgagcaaatatttcacaagttattcatagccaaagtttatgaataattttctgcaacatgttgtacaccatgatatttgttttttttattacatgatactacttttcacaagcatcatcatttaggactcattttggaatgcaagattcagaaatcatgggaatagaaaaaacatacaagtaggttgtcatgcctcgttgaatcttccagaagttgatccatcgaattttttttcagaaaaatattgtttggtagcactataggaaaaacataggaatttttagagagaagaagagaaacacatgagatcttgcctctttctaaatttgctcaacaattcctatcaaatgacctattccacacatgattacatgaattttaaaggattttgtaatggtcattattttatttccaaattaaagtaccataaagaaatttcttccaacgaattccagtcctctaaaattcctccattttttcttttgctcctcaagtgtttagagtggcccactcgatcactccgatccgagacaatatcccatttgctaaggtggatatatatagtccggtgaaaccgacaagcgaacatgatatgtcaatttggcaattactattaaaatgtttggtagattattatagactccttgaggttccacgagaacccacaatttagcttgcacttgctacattattaaaggatgaaagtagaaaaaccactgcacgcttcatttaattccttattaaattatggcaaaaccaggctttcgagtaacagttccatacaccaaacttatcttatgacattcactgtatcaagatttaagtatacttacatcatatatatatctagtgaaatagacccactcaatgctcaatctctaaagtcaagatcctatcacattttcatcttgctatagtgtttgtgagacacagagaccgcgagtttaatttactattagaaaaagcattttcgtagacttgggtttttttttctaagcgggtatgagcctcggagccaaataaccgcatacgaaaaatataaactagaagtggatcagcgtcggctgcggctcggacgagcggtgggagcggcgtcggctgcggctcggagcggctgaggcggcggatctgacgaggtgcgggagcggcggagacgcctcccctcccctctctcccagatccgaccggaggggagagagggcggtggtgtggtgtcgatcttggacaaggggagctcctcctcccagatctggcggagggaggagctcgggcgccggcagcggcggaggtgcctcccctcccctcccctccctctctcccaaatccaaccggaggagggcggcggcgcaagtgacgctggtgtggcgtcgccatctcgatagggagagggcggcggcggtgctatgttgggcagctggcaacggcggcagcacagacggatggggatttattttatctacgacgtatattttttttaggcaggtggttctactgcctgtaaagatggatttaccgcctatgaaaatgattttcgtaggcgggcttttgcctacagtaggtccttttccccacttggaaaaactattttcggctacctagatggaaaaacgatttttctagtagtgattgctccggccgtcaaatgggcagagatgtatactatgcttgaaggtgttcggtgaattgttataccataaggccaagctttttagtcgctatctttccatttctttcatattttccggcaatatttgtcctttagttcaaaataattattaaatccacgtgaagcggcacgtggacaagtcaactcagcaaaggtcagccatgatgcaacttcccttattgctactactataccttataaatgagtaacagggcttctcaaaattaatctaatgtttaaacctcattttgtgatatctagtttaagattttatgaaatttactctctcttcaaacggaactgattaatttgagcaagcatataatccatcgtacttgatttgacttggatttatgataaaaaaagtccaactctggatgatattactatatcattgttaataagcatgccgacaaagtatgccatcactattttcttgtgcttaacaatgaatgaatggatgaatgcgcatacttctcgaactcctaagctgtatgatttatttgcagtactattttaaatttatttttaactctataatagttcattcatccatttatgtacctagtaccctcgaacaattatcacaaataattcatctatcaaccatttagcagaaaagagattataattaacatggaaacatgtcagctctaagagcaagtttaatagtatagccaactattagctccaattcatctcattcatacaatagttacatagtgcactattaatacatggtcccacctgtcacacatacactgcgtcttgaagtccgtgctacagctggctacaaatttgtagcccgctactcttctctctcctcatttatcttcttaaaatatgtttacagctggcttatagcctgttattgtatatgctctaaagaggtcaaatgtggaaaacacacacacaagaggtgcaattaattaatttattctcaattcgttttcttgactgtgatcttgtttataaccttttcgtctacaagaaagctgatgtgtgatagatagaacaaaaccaattacatgagaaaatataacaaatccaggtctcgtttgagacatgggattgtagcaagaaaacatgcatgcaaaaattatatactcgtcttttcaatttctttagttaggtaaccccaacaaaaacatttattaaattaacttgctttgaagaaaaacggaaattaaagcagcaattaactgttgagactagctatactgaaggacgacctagaaactttgggtgcacaaaaagatgtaggtaggtagcaatatacccttaggtcgatcgatatattattgtattcaagcgatatttataacagagatgtgtactcctccatcgatcaaggctgtgtttagtcctttcaaattttcaaaaattccgtcacatcaaatgtttagatacatacatagagtattaaatatggatgaaaaaacacccaattacatagtttgcatgtaaattgcgagacgaatcttttgagcctaattacgccatggtttgacaatgtggtgctgcagtaaatatttactaatgatagattaattagacttaataaattcgtctcgtagtttacatgcggaatatgtaatttgttttgttattattctacgtttaatattttaaatgtgtgtccgtaaacttaaaaatttttggctggggaactaaacacggcccaagttaacatcaaatgttaactgcagaggcaaaggtgcttaaatgcaatgtcagattctatggccgtgccctccagtggtcgccatcagcatggacaaattaggttaagtgtcctattaattagtcatagcagcgaggcaaagccagttgcaaccctgaggtttgtccaagttgagtattataggggatctgcattagctagtgagagacaagggcatgacacattgccctgcacattaattcgaatccctttctacacatatatatctatacaccatatttatatggatgcatctctatacacaaattgaatttaaatcgaggagggattagtcgcgtatttatggagaaaaaaacaaagtgtttccttcaattggagaggatgaagggtacatttctaatgctactttttgttgctaatctgaggcaacaaactaattaattgatgattactgacatttctaattttccctccataatagtgtcatgcttacaacgagattgtaattatgagattagttttctcttttcccggtttttcaggttagtttttatgtgaaaaaaaaaactgattttcttttttttttggtggggtggtggtttttatatggagaagggaggagaaggacaactcagtttttaaggtaataaaaagatactgacgagtatcaatttgctccttttgtaagttcacttattattcaacatgcaaacattaagagatggtactagcaaatttttcattgttgcaagtatataggagaatattacagtagtagtgtcatgaataaaattcagaaaattaagatacacatgggacatgcatggttagctgagatagagtatatacacatcaagtactcactactcagtacgtactagaagcaagcattagatgcatcacaataccatatgattctcatgaattagtgcgcatcaaatcaatgcgtgagaccacgctatatcaatgtgtacgactcttacatttaagactcgctattattttttgcgattttccatttaatacttgatcatctctagctatagtatcaaacgtatcatatccttgtagaaaattaactgtgaataataccgatgagtacatttcctagtacatttcactcgaagatgtatcatagcactcgtccgtgaattgcaaaaattactcgcaataacccagcttgaagtagtaccactggtaagttaaactctcttgcacctagtattaattaattaattaattacaacaaatcgaacacaaatatatatgtaccaaggatatattataacatttactggtactactgatatatatataagatttatgttattaaagaagatgtacatttctattgtttgccaacctccatttcatgactggctcatctcacaatggatccaagtcatgcatccaccatggattagtatagactactatatagaaacttacaaattaagatgatcagttccaaaccctaacaacgaattaaaactcaaaaagaagaagagagaatataactagatttaactatgctagatcaacaccagctttgtgcttttgatgatctaaatcaccaaggattgattggctttgttcttcaaggctagtcacatttattgtcaccttttttttgtcccctcatttttttttccttttttcacttgcactaaaagaactcactcgggtcccccaatggcaccaccacgtccatgagccccacctcgccgtggcccatgccgtcgtcgagcagccagctctccagcatggagaacgccggcggcggcgacgacgacggcgcgccggcggtctcctcgtccttcgtcttgctggtgaccgtcgagccgtcgggcgtcggcgccgtggcgccgccgctgtggctggcctccccgtacagcaccgacgccgccgacgacctcgacccggaggacggcgtcgtcgtcgtcttgccgccgccgccgccggggcgcatccagccctccaggagccgcgcgatgttctcggcgctggatgcgtacgacgtcgccgcctgcgacgacggcggcgccgtggcgcccgacgacgagtccagcggcttggccggcggcgaggggtccagcgagagcgcgtcgcggagcgcctggcgcgcggtgtggatgtccgtctgcaggcgccgctcccactgccccttcggcgcagccgccctggtcttcacctcgccggcgccacctccctcgccgtagtcgccgccgccgccggtggcgctcatcttcttgagcttcttcttgaggtgcgtgttccagtagttcttgatgtcgttgtccgtcctctccggcaagtaggacgcgatcgccgcccacctaaccaaaaatcaagaaccgccaaaaaaaaaaaacgcaagcgcgcactttaattagggctccaaaaaccaacccatccatcaatcactcaacctcgatcgccaagaatttcatcttccgattcacgaaacgacgtaaattaaaccaaaaaaaaaattacctgttgccgaggagggcctggaggtggacgatgagcttctcctcctggtcggtgaagttcccccgcttgatccccggccggaggtagttggtccaccggagccggcagctcttgctgcaccgcatcagccctgcacacacgcacaaccatcgccggccggtcgatcagaacaccgcccaccgccggcgacaaaaaccaaaggggatcggtggtggtggtggctcaccggtgttggtgggcacggcgcgccagttgcccgggccgtgctcctggacgtaggcgacgagcataggtcctcctccggcgtccacggccccttcttcacctccgccttcacgcagcacggcggcctccccatcaatccccaccacggcaccacctcctccaactccaacgacgatgaacaagaagaagaagaagaagaagaagaagaagaagaagaagatactctccactccactccacttcaccacctccgcctagagaccgacctagcaatcaaggggaggaggaggaaggagaaggtagggaagcaagagagagacaggagtccaaccgagacggcaatggggggggggggggggcggggtcggcggtgagtctccggcggaatatataggcggccccgcggcgtcgcacagctgggtttgggtttgacctactagccgccaaggcgagtgaggtggacgacccaacaacctgctcctgctcgatcgacgagtccacatacacggccacggccacggcgactctactgacctgtgacgtggcagtggagtttgtagtagtagtaactttttttttgtttaggagaggagtaatttatttgctagggacaaaaagaagtgagctcactgggtcattaaggagtaactgaaacgtggttgagtgggcctggtgggctttctgggccggcccgttagaccgggtgggtagaattgttctggttcgggagatatgctctttgtcgtgatttttactatcagactctcctcaaaattaaacaagggactagctacggagttgtcgacagtttttgaggtccaaaactttcaaattttttaactacagaatttatcatcaatggttataaggaaacaatccacactagtacaaaccatgaattttagtgtccaagctgattgaacaacaagaaattggcctacatgtagaatggaaaaaaaactttcaaattcaaaagtaatatgcgctcctaaaaaaattgcaaatcataattttatacaatataactaccctataactatcgtgtaactactctgtaactagtgtgtaagtactatgtaattagggtgtaagtgttatgtaactactctataattaaggtaagtgatatataactagggtgtaagtgatatataataaaaaagagttattactaataagaaggtgcatggcttagcttaacgtgtgcatcatgttcgatgactgccttgcccatgcgatcttttttattctgggtgtatatgttgcacgaatcctagagcgcatctaatggctagaaaatcaaaagttttccaaacaaaaaaactgtcaacagttttttagcaaaaccgattaaacaaaaataaatatattatatgggactatctatataactgttgacagaaaatccctccatccatcttttaaattttagaccatcggatatgctttaagccgtgttgaggcattaaccctatctttcctcctccagttcccctcccatcacacattccgccgccaccactcccatcgctcattcctccatccgatcccccgccgccactgccccaccgcgccgctacccgcctcgccagttggaatagcgtgccggcgagaacccccccccttcttcatcctcgagccgttggcggttagatgcccccgccaccaagccggcccactaccctcctctagccccgcagctccgacgctgccgctgacgcctcgccacccgttcaatccgccgcccaccgccaggctaccgcctcccccggccatccctctagagccgggaaactcctcctgtcggtgatatgggcatgggggtatcaggtttagagggaggaggctgccaccaatgccacatggccctcccccgaggggagtcaggcccgaggtggggtggcggccactccttccctaaagactagtcggaggagactgccctccgatgccacgtggccctcccccgaggggagtcaggcccgaggtaggacggcggccactcctttccagagactggatggaggacgctgccctccaatgccacgtggccctcccccgaggggggttgggcccgaggtagggcgacggccactccctggccgagactagagggagaaggccgctccaggcgccacgtcgctccctcccgaggggggatcgggcccgaggtcgggcagcggctgctccctgccatgactagggtcaggctcccctgaccccctttctaggtcaccacgtacggtgggttaggtgtctgcctccaggtgcccatctacccgcatttatggcgtcccgagcggtcgcgccacgccgcatttaatacagcgtgcagtgcactcaaccggtctgtgaccagtcgaatgaccgatgggactggctagtgagactgtgcgctgctcgtgtgtcaggcagcatgcagcctgacatgtcccatcaaatagtgatggtgagaggttctcatcctcttatcccagccggagtcggtccttccgctctggtcaaagcaaggctcccgtttcacggtgtaataggagcccagaagtcttcacccattaaatggtgattgacaggggcaccccccgtgtcaggcggcaatatttgacaggccccatcatcaagacgacgtgtgcttggctttccaagtcaagagacaagacatgcatttaatgcaaaggttataatgcatttgttggaaccttgaggtataaaaggaggtccaggcctagtgatggagggggggacttccgagcgaactggcgcttgggtctcgcaaccccaagcactggtgttctacattcaatcaatcatgcacaggagtagggtattacgcttcatagcggcccgaacctgtataaacctctttggtctgattgtcttggaggggcctaaccccctcaagaccacacagcttcgctcaccaaatcctcgaatctcacccgctgcccccggccgaactcacaaagggtggcctcacggttccctggtggaggagttcattctccgacacctccccttccccttccccctcccacccacaccccactccgggaccctaaactgtagggtcctctgtcatagtctagtgagtcgctggcaccggagaagaagatcgataggtcgccggagttggaggagaaggtctggagcatgaatctcgaagcttatctagtggctcaaaatctgcaagatttgtggatacaatttatgtctcagaaggttagcaattccgatatattatgatcgtaatgtcactatattgtatcttatatgtaaccataatacaacttgtaagtaacttttaaatatcgtatgataatacactatttccacgaagcggatgtctcatgacgaaatcctctcacatatacgcgcgctgttatttcttccttcctcgcttgcacaaatcttaaagcaaaatctaatgattcaaaaagtatgtgaaagttacgtacaagttatattatattgtaattatatgcaagttacaatgtaattatattacgattatactatatttacatccgtgattttttttaaacatttcgagacaaatatatggtaaaatcgtttttccattaattttgtgaaatttaaagcatgtgaaataaggtttttattcgtgccctgagctactaccttcgtcacaaaataatttcatatctaacatatatgattgccccaaaaggatttcactttaatattcctcttataccaatgtcaataggatagctaactattacctataaaaattaacgttatctctagccgatttaataagagcaagtttaatagtatagtccactactaactccaaatcatttatagccaatgtaatagccaattcatacaatagttgcttactatattattaatacctagtcccacttgtcatacacacattacgtcttggagtctgtgctacaggtggcaacagatctgtagcccttctctctctttttttatctctttaaaatatgtttatagctggtttataacctgctgttgtacctgctctaacccactcgtatggagtaataattaactatcgatatgcactacaacataaatatttcatccacctctttctctcataaagtatgttggagttcgtgctacagctcatcactgcttataaatttgtagtccacttcttttcgtacttatcttcttttgctcccacctcaacagaaatatgatgtgatagctgcttacatcatcggctcctacctaccctcgatccacacatcgatgagtttcgtttctccaatactcttttacttatcaacccataaatagtactcgttttattaatgagttgcaatttaatttgtttcatataccttgttttgaaccggagaccaaatataaagttgttttagacatacatccatccctagaatataaaaagttttaggattagatacaattattaagaaagtaggtaaaattaaatgaagaatgttgtgattggttgagaagttattaaatgaaaaatgttgtgattggttgagaagttaaggtaggtggaaaaattgaaatcgtgaagagttgtgattggttgagaaaaatattttattttaggataaattatgagggttagaagtcgttttattttggaacgaaggaaatatgcacgaatgtggccgaaaccatctgaccacatcgtccaaaagttccacatctacaactaaaactatgacacattttttaattttatttaaaagaaagtttcacaattaaaaaaaatcggaaaaacgacggttgcagttataggtatgactagtgccacaaacattacacacgagttcgctactacctctgtttccgttttaggttggatgactttctagcattgcccacatttatatatatgttaatgaatctagatgtataagctgaaacggaggaagaagcttttaatagaaatttaatggagctaagaatttaccaccagtatgcttagtatatgttggggttacactcgtgggtacgtacgtgtgtgaatgtggcataccgcacacgtgcgtgttgctgcccgtgcaaaaaaattaaagaaagaaagaaagaaagaaagaaagaaagaagaaaactggccgctttcgtcatggctgactcgccgctgttgatcgctctcgtcatcgtcgtcggctacaggaggagcggcgcgccgcagccgcaggaggcggctgccggccggaaaagcaaattccggcggctgcagcgcgtaattaatggccgcggttatatatattgccggttgttttgccccttctctgacgatcgagacgttttcggtcgattgtttttcccgagcccgttgaagaaaaaaaaagtgtacgcatgcatgtgcagttcatctgtgtgcgaatgtgtgatcagtgagtcagtgacatgtattgtagtagtatatacgtgacatctcttcatgtccgcgcgtgccatggtcgacacaatatagccacgtactcattccgtttctaaatatttgacagtgttgacttcttagtaaatatttgaccgtgagtcttattcaaaaacttttgttaaatatttaaaactatacgtatgcataaaagtatatttaacaatgaatcaaatgatataaaaataattaataattacttaaattttttgaataagacgaactgtcatgcatatttaaaaagtcaacgacgtcaaatatttagaaactgagggagtaacttgtaccataagccccattctttaattcgctgtgaaattcgtaccatttatcactactattataaaaattaaaaatgtttttactagtattttgatatatagtctgtatttgagtaggtttttacgttcatttgcttctggaaatatagatccgtgtttgagtcagtttttaaagttgttcgcttttgaaaatataggagtcctataaagaaatctatttaaaaaaaacttagcatggtaacttgaaattgaaacaatcgaactcttacttacagctcatgatttaataaaaaaatttcaagcaaaatctcaaagtaaacttttatcttagctaaaccgtataacaataataagattaaaaatagcttcacatgttttttctaatattagtaaaaatataacttataagttaaacttgtatatatgtacatatccttaacaactaaaaacaaataatgtaaaataaaatatggtgagaaaaaaacacaaaatcaattttaatttttagcttataagtataaatataaacgaaacaataaggctgtatatctatgttacttaaaaaagtggggtcatctttcttctcctcgctatcgtagtttctccatataaaaaccatatctatgaaaaagtactccactcaacaaccgatgtttccacataaaaatcaactcaaaaacctcgtatgaaaaaactaaactctataattttaatctccttagaacacacgaatatggaactagtatatactgaaaatttcctatcatagtccgtgccatcaaacgttattcttggaagttatacggtcctgtttgaaatgtattttttataaactattgaggtgaattgtttacttgattaacgcaaataaattatagtattgtaagaaataaactttacaactttctaggtttattaatcaatgcagcagaattttttttacttgagaaatcgtgtatttagaagcgtgaagcaaataaccattggcaaaaaaaaattaaaaaatgaaaagaactggttctatatataacggatttgctatcaaacattcgacaggaattttgagaaaaaacctatcaaatatcaggtcatcgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 28919 - DNA, 1117 bp, Oryza sativa
aaccccagagtccgcacatcctcaaatacaaagcacttccctagttagatgtaggttagacttcccgttcgagaaactctacctttatacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcc

SEQ ID NO: 28920 - DNA, 732 bp, Oryza sativa
atatgataacctacttagaaacatttttaggtgaatctgctaaggttctatgggaacaatgggttgaaaagaatcctaataattatgaagaattgaaaagagctggtagcaatccgtataatttttcaaatgttatatctaacattattatagctgaagattcggaattaggttatacaactttgcagaatgaaaggttaaaagaaatagaaaaattaacgttaacaagtttgaaaggcataaaagaattctcccaacattatttatataatgctacaactgctaaacaaggatataacaggggaatagttgaacgttatttcaataaattacctgacccactaggaagtatgatatttgaagaatataaaaaggaaactgaaggagctgaaatcaacatctcgcaagccataacttttgtgtttaagcaactaaaaaaaatatgcacgggtatccaagcccaaagatctatgaaacactctgattacaatttttgcaataaaatagttcaaatacccttgacatatggagaagacaagcctagaagtaaaaggatttataaacatcaaaatagaaacaacaataatattagaacaaagaaaaggtatttcttaagaagatcagataatagagcacccttcttacataaaagaaatgtaagaagatataatccaaagaaaacctatgacaaaacatgcagatgttttatatgcaactcgccagatcatttaa

SEQ ID NO: 28921 - DNA, 334 bp, Oryza sativa
tccacataggtctgcagcgttcatagtaagaaatcatgcagaagaagttagaggtaaatctaggatggtcataaattataaaagactaaatgataatactatagaagatgcctataatatcccaaataagcaagaatggattaatagaatacaaggtagtaaatatttctcaaaatttgacttgaaagttggattctggcaagtaaagatggcagaagaatctatagaatggactgcatttacatgtcctcaaggacattatgaatggcttgttatgccattaggattaaaaaatgcaccagcaattttccaaaggaaaatgcagaatatattt

SEQ ID NO: 28922 - DNA, 103 bp, Oryza sativa
tatatgaaaattcttctctatcagggggccattttcctgctgccctagctggtctttctctttctccttcgtttttcacagtaccttctccatatctttttct

SEQ ID NO: 28923 - DNA, 2390 bp, Oryza sativa
aggtaaaagagatggagacaacgatttttatacaggttcgggccccttatctgacaggtaatagccctactcctgttggccgaagccgttgttgttcttattcatctgaatctcacaagtacaataattatgataatctatctagctgtcatcgacttggcggctagataaccaactcgtagtcgacgacaacatagtcttccttcttgaatatgaactcgtcgggatcagagatgacgctagatccctcttgccagcctccgtagacaccggatagggtatgtctaggcttatctctaacatcgatctctggcggcgtattggcttgtgtgtatgttgtgtcttgtggcttcgtagactgtggtggatgtctctcctctcctctagagggacttgtatttataccatagatgcccccttgtccaagtaaactagggagaccagtatggatataatctgattagttcttatcgtttccatatagaactttactcgtccttcattatccggaactccttcaatatacgaggattgtttccgtataagacttggtatgtggtgggccccgccgagtttagtcgattactattaggtatgtggtatccataaccctgacatatatatcttgttagttgtaggatcaaactaactaacatgccctgaaccctgattgacagaacatgtactacagctaaccaaatctctcaggcctctatgtgtacgataaattttgtgtcaataaatttgtatatgaatacagactgtttgagaaactgaaaattctgttgaaaaatacaactgctagctagaaacttcccccagcataaacttttattctgttccagttaatgcgcaacgtaatgccgatgctgacagccggacaccgaagcgctcatgtcgatcaccaacgcatatcgcagcacaccgaagcccgccgcctcgccgccggtgcccagccgccgcccagtcatcggcatgcatgaacaagctagctttggtcgtaaaccagctgtgccaaattgatcaatcaagcacgaacgctcaatgatcgatcgattgctcgatcttggacggactgtccctaatttttttttcacgaacgtataaaagaattgcaagttaatatatcaggaactgcccctaatttaatcatgctaatgaaattatttgatcccggtcaattaatctgtagttaattttcagatcgatcatccgtcattttacttctccttccgtgcagtcaaatcctacgggggtatttggtacttgtaactgtcaagctaaccaagtagagatggaattgaatttggtgatcattaaagttgatggagcaactaattgcatgtatgcttgtcggttaaactttccattcctcttgcgacgggagctttcgacgcgtgcatatgactggaaggatggcggcgccggcgccgccgctccccggcggctctcctgctataggctaggttgtaacgagttaattattgaggaactgtactttttccggattatctttttgattatataagaataaattagatactataataaataaagttaataaataatctaacagaagtggctaagcaatacaataggacttaacaagaaagtttattgggaaaatatattttctgaagcatatgaagcaataatctacctatctatctatctatctatctatctatctatctatctatctatctatctattatatattaaaagtccatgaaacatcctaaaaaagcttctacgtcgacacatgacacttctagaaacgttcccaagctatcaagtgatactctaataaattggataagcatgtaactattgattttcacttaattcggtggacccatcaattttgaccattagattaaattctcatctctccaccctaatatatgatggttaaatgctttggtcccaccaaaataattaactacgagtaaacatatgtagagaatcagttgttttctctcccgaaaaaaataccgcagaattaattcttggaaagaaaaccgacgttgtggatttatcatttaatgcaggagcctgggtgtgtgcttccatcatccaaaaataaataaaacaacgaacactttttaagtgaatatcacctttgcgtcaaaaaagtgaatatcactaactgttctaaactatttacagatttaggttccgattcatgaatattgccctcggtagttagtttctgaatttttcctgtatctgtttgattacaaaagtgaatatcactgactgttctaaactatttatacagatttagggtcagattcatgaatattgccctcagggcctgatgaatttctcactaaaataaattatcttctctcctccctaatatatgatggttgcatgctttggtccca

SEQ ID NO: 28924 - DNA, 1841 bp, Oryza sativa
  unsure (1)..(1841): unsure at all n locations
gttattctgccggaatgtgtactagtacgatatagacgggagattgagttgcccatggtttgcccctttatgaatgaagctgatcgacttcgaatcactgtcgctattgcatttcggcatatcatcctggggccaactataggaagaagtagaataaattaagacatgtcatttggagtcaagtagagcttagggtgtgtttagatctataggtgtaaagttttgacgtgtcacattagatattatatagggtatcgcatggggtgttggggcactaataaaaaaactaattatagaatccgatagtaaaccgtgagacgaatttattaagcctaattaaaccgtcattagcgtatgtttactgtacaattagttatttttttagcctatatttaatacttcatacaggtgctcaaacgttcgatgtgacagggtataaaattttagggtagaatctaaacacccccttactatttaatattattgccaatgtctatttcgagcaaagttggagatagggactcataaggaacacacgcgcctactgccttctctataattgacttgattttgctggacaatgacatgcatggctactcatttgaatagcaaattctcaacggggccatctatatcattgtagggcttagttgcatcatattttggtatcatctttgctcggcaattagatctataactatatgggctctagagtctagactagtagggcatggctcgtcagtaccgtataattgtaacggtcaaacaaacactaaactagtaaattctcaacggggccatctatgtcactcatatttttaaatgtgtatataatatggaataaactgcactagtattatctggatgtcctactttcaactcaccttgctgntatatttccttgtatcatatccctggggcggaagaatggaacaaggcagcttcagtgggacttttttttccgcatgtatcagtgggttatgcccctctggcgacgtaatttggagtaaagctaaagaaaatgtccctcctacaatatatacaacttgaattctttaacttctgaggaagtggcacactaatacataattatctttgcagacctaccctgtttatttttacaaacagactataagaaaacctgcatgcaaaaacatttcagggttgtctagtaagacccgcatgtgaaaatcaatttttataaacaggtctctaaacatagccgctagtgtaaatacgtttatttttacaagcgactatattaagatgccgcatgcaggtatacgcctcgattttcacccgcgttagaaaatcacatctcaattttctctcaccctcagcttaaaagtcaatgtccatcatcctctcatctactcccatctcttctcctccacacatccactccctctctgtcccctatctcttttcctaccggtcggtgacgaccagcgttagcaagggagcagcgccagtgacaagagtgcatgcgcattcctcggctcctccttctcctctctctcctctctccctccctctcactcctatccgaccaactcgggcttaggctggacagagggttgaggcgtatgtaatactgttgtttgataacaataagtcaagttggagataccttggtctcagaatatggtttctttgtttgattcatgtgtaggtgacttgatgcctcgggagagtattccggtgatggatcgggagtcgacttggggataaggcgacgtccgtgacggtcagatatcatgcgggatacttaagctagagttcaatgcacgtggttggtaaagattacatatggcatacgatggaggtattgtgtgcatatg

SEQ ID NO: 28925 - DNA, 960 bp, Oryza sativa
ttcaaagttttggaagaaactttaggaagagatgggttccaagttgaacttcagtaccgcttaccatccgcagacagacggacaaactgaaagggtaaatcagattttggaagacatgttgagagcttgtgctttagacttcggtggatgttgggataagaatctgctttacgcggaattctcgtacaacaacagttatcaagctagtcttcaaatggctccttatgaagcactgtatggtcggaagtgccgcactccgcttttgtgggatcaaatgggagaacgtcaggtttttgggactgatatcctaagggaagcagaagagaaggtaaagatcattcaagaaagattgcgtgtggctcattctcgtcataagagttatgccaacaatcgccgcagagatttaagttttgaggaaggagatcatgtgtaccttcgtgtcacgcctcttcaaggggttcatcgttttcacactaaaggaaaattggcaccgcgttttgtgggaccttataagattgtcagtagaagaggagaggtcgcttatcagttggagttacctcaatccttggcaggtgtccataatgttttccatgtgtcacagttgaaaaagtgtttaagggtacccaccgaagaagctaatctggaacagatagtggtccaagaggatctgacatatattgagaaccaatccgtatcttagagacagatgagagaagaaccaagaatcgagttatccgtttctataaggttcaatggagtaatcactcagaggaagaatctacttgggaacgagaagatgaattaaagtcagctcatccgcatcttttcgctagttcttccaaatctcgaggacgagattctgtttaagggggtaggtttgtcacaccctaaaaatcttaaatatataaattgttgtttaattggaatcattagaaatgaattttaaaagcctagaagaga

SEQ ID NO: 28926 - DNA, 2336 bp, Oryza sativa
  unsure (1)..(2336): unsure at all n locations
tatgagagcaaaattagttgaagaggacaatagtcactactagtcataaaatatgagaatcaaatgaaatgtgagaatcaaaaatcagttgatcccagaatcaactgaaattgtatcagaaaaataaaattcactagcagtcactactggttcccccaaaaattatgtagaacaaagcaaaatctgtataagttgattgcttatgagtgctgatgaggtggcagacatatgcatatccacagtgagaaaaaaaagagttaagctaacatgaacccacaaatggcaaatagtgagggcatatatgacaataaggcaaaaagatccccattcagtgctagtggtcaaaaatgccaaaaagtgcagatgggccagtcaatcacaacaatatatgctcatgaaaatttttacaaaaatcatcaaaacttcgtgactacctgcaaccagactgaacttaactcagtataagaggataatgagttgatgactgcaggaatacaaacttagaaatgcagaggtgtataaatctgcagtatgtaatcaaacacaacacaagcggctgctaggttttctcagttctggatggtttaatcgtttatatttaccagcacacagtttagacaaaaaagtgcacccattgcactataaaaaacagagcgaaacactgaaactttactgaatatctaatcctacaaatacaaaaacaaaatcagttgatgaggacacctagaatcaactgaaaaaatcgagtcagaaaacaaaattcaaaaccagcccctattgggttctcccaaaaatttgtctagaacaaagcaaatctgcgcacaatcgtttcaggggaaaaaactaactgcatatggaggaacgcaaaatagtacatttctgacaaaaaactcagtacaccaagttaatgcacaaagatgtttttgctcctattaaatcctctgtagttttttctctgaaaatctcactcaagtatgaatgttattagaaagcaacaactatatgatgacacctacaaaatcagattgcagcaatccatgcatcatgtgaaagcctcatgataataccaggtcaagcagggcatggagatagaaaaatttctctgtgaataacttgaatcatgctggcaaaataacttgagatatgtagtatttcaggagccaaatatgctccaagattgcagctggatattgctctggattgaaaatcacattgcaaaaaaatgcagtcatcagttgtgcagcaatatgcagtcaaaaatagcattcatttacagcaatctgcccaaatattccagctatatcaatgcattgattcagcaatatgcagcaatctacccaaattgtccactcactccaggatacacatggaaaatatccagcaaatatgcagccacaaatattcccatttgcaatactcctgcttacagtagttcattgcaatactccagcttacagagattcaagcaatggcgttttgggtttagatccatgattttgctagggttaggccctaaccctagcagcgacgggcggcggtgacggtgtctactgcgggggcggcggccgcagcgttaaccgcggcggcgacgacgtcaaccgcggcagcgacgacgtctacgcggcgacgacgtctacggcggcgtctacagcgtggtgcatgtggtttcacggcatgattttgtgacggacaaacccaaaacgccatggatctaaacccaaaaaaccaaggaactaaaacaaaaaaaatcaccaatcaaatcaagctagctcgggggaacagaaaatcacttccaaaaattaaaccctaactacaataaccgagaaatagcaggaggaatcgattccaaggatgctcgaggagatcagagacgaaccacgttgcgttggagaaaaatcgtcggagaatcacaggagatatcgaaatcgccaggagaggaagaagagggtactgttcaaaattgcaacggcatccgcttccgcttctggtaagggcgataaaaaaaagccaaaaacggttccgtgctgtggatgggctctcgtgggccaagcccaataggaaagaggctgagaaaagccagaaaaggcaagtggtggcggcaagtggcggaaagggaaatcgatcgctgctcctgtcgcccaacgattgatcgcgcattaggagtttcgttccatttaggtataaagtacactgacttccctagcatttctggtaattcacgacgctatgttacaatgcttgattactaccgctaccgactccattaccggttgaatannnnnnnnnnnnnnnnnnnnnnnnnnnnnnnnnnnnnnnnnnnnnnnnnnnnnnnnntt

SEQ ID NO: 28927 - DNA, 1192 bp, Oryza sativa
aactctaagaaattgcctttgttgtatgaatcacttgattcatcatggccccgaaaaggcaaacctagcttaacaacctcctagcaacattaattgatccatttaatcgaacaaaatatgcatttttagtagcttcgctttgcacttgcatatgtatatcgatgtgttgggctctttgcaacaaagcatcacaatttttcatggcttgattatgtaagctaccaacaccactaacatgctcttttagcctactttttctatgccaaccattccaaccatcaaccacaaaggctttatacccatcctctttcttattgcgatctctaaaacaacattctctgtcttttgccttgtatattcaagccaacttccaaattcatcaaaccattcctcaataaactttctgtctttacctgagatctttgtaaccggaaaagtgaatagacatggttggcaaggccctttctgcaagtatttccttctgactatatccctcttactaggatggtaatcatcaatctcttttctcaagcctggatcatattcaatctcgttctcccaactaccatcatcgacttgttctggacaagaattccgtacagctgcattattggaactatcgagcgctttcctcaaggtacttgtctataacctgtcaattaaatagttttattatgttagactataagtgcactgcacaatagaataatgtacacccccaaaagacaaattatttagcaattatgatggtgtcacagtatgcttacaattttactaagtgatggttgatgccttgatggactgatgactacaggacaacagatgtccttgtcccttccagagaaactttcagttcttccctagcttatataaatcattaaatctggataattgaaaaggtgctattaacaagttagaaatcaaataataggattaaaaataagactagaactagaatagatgataaattgaaattctctggaactagttaaaagaaaaataagtacctatcttttactctttagtctcttgcttgtgcttgactgcttgtgcaatgcagtttgcttgctcggctgcaggttgctggttgcctgtaggctgtagtagtagtactccggctgcccgctgggcgctgccgccgtgccgttgcagacctgcagtgctgcggtgctgccggcggctagctagggcg

SEQ ID NO: 28928 - DNA, 2224 bp, Oryza sativa
atgatcttgctggagcattctcaaaggtttgttttttttttaaagcatagctttttaaccacataatatacacaaatgtgatctaacagaaacatggtgtattttatttttttttttggtagaaattgcagaatgtagattatagataaataaagttgcatattactgttgtatacctatttgtatgcttgcattgtgttgttcttttttaactgtgaacttatttgttgatttctccactttcagttgaccagaagcatcaatgaaccaacacaatcgggaataattagtcgtgggggttcaatttctagacaaagtgagtgggtatttgatttattccatttttcaaggatatatgtaagattcgttacatctggccaatgggatgaacatatccattaattttccattgttagaatgtgaatttcaatacatttttacagtctttgttctcttgtaggtttagggcccctttgatttgtaggaaaaatgtaggaattttggaggatttcaatcctatggaaaaaaaatcctatgaagggctttgaaacaaaggattgaatcatatccaatcctttaaaattcctatggaatgggtaatcctatgtatattttggaggaaagttagcaagaggtctaacctcttggaaaatttcctctgagtctatctctctcatctgattcctgcgtttttcctctggtccaatcaaatggtcattcctgtgtttttcctgtgtttcacaatcctctgttttacaattgtattcctgccagaatcctctgttttttcattcctacgattcaaaggggcccttatatatggtttctgatttattaacattgtattctaatgttaatgaattcaatttgtgtaggttctactctggactgggcacaagattcatattggcctacacagcctatatttggagctgaaccagggctgaataatgaaagccggtggtctcaaccacctcatttagcccgctttgctgattctagactgcacagaacatcctcatcgccgcagcaagatgctcaatacaatcctaatgaacatattcttggagcaatgccatctctgttgcatagaacttcatcatacccacaacaagagcctcaatacagtcacacagaaccaattccggtacctaaatcatcattcattccgtaccctccatctggtgcagtatcccattcttcgccaggtcaaccacataacatgaacatgccatctcctcccacttcattccaaatgcctgtatctgcacaaaatgagttacaccatccccagtttcctcgtggtggtatgcctccagggccacttggtcggagcatggctcatttggattcagcaggtttatcaactaataatttgcaacagaatgctctaaacagtgggccagttcgtccaaatggtgccatgcttacaccaggtttggtgcagcacaatctgcagcgtccaaatggattggtcccacctcaaatgctgtcacgccatccacaacatggaatggccccaattcaacactctccgccacaattctcacagttccatgctcagatgcttggtcctcggcatcctccaccaaaaggttgtcagatgtacaatcctcagcgtccatcacaaatgatgagtggatttgatgcaaatttggcaatgcctgacttgagtgatccgagagcaagagcaatgctgcaccatggagtgcatggccagcattatctcccccaaggttttgagcttgctggtatgaggatggataatgggtggccgcggttcagatccaagtacatgtccacgcctgaaattgagaacattgcaaggatgcagcaagctgctactcagatcaatgatccgtacattgatgattactatcatcaagcctgtttagctaaaaagtcagcaggaggtcaactcaagcaccacttctgtccgaccttgattagagatccatcatcccgtgcacggagtaaagatgagccacatgcgtatctccaggttgatgctcttggaaggttaccattttcttccatccgcaggcctcgtccgctcctcgatgttgaacaaacctctgaatcaagtgatgacgttactgaaaaatctgcttcaaaaacacttgaccaagaaccaatgctggctgctagaatcacaattgaagatggcctctgcctactgcttgatgtagatgatattgatcgcttgctgcaatttagccagcag

SEQ ID NO: 28929 - DNA, 960 bp, Oryza sativa
  unsure (1)..(960): unsure at all n locations
nnnnnnnnnnnnnnnnnnnnnnnnnnnnnnnnnnnnnnnnnnnnnnnnnnnnnnnnnnncatatttggaaatttgccatctgatagtagtgctgttgagacaacgacaaaacttgctactgctgtatcaacctgtgttgttcggttggagttgagtggactaagtgcttgccttgcagctattgtgtgttcttcgttgcaaccccctctgcgaccccttggacatgctgcaggtgatggggcttctttcatcataaagtctgtactggacacagcaacagagcttctcactgatcagcatgtggcctctacctacagcatgcaaaacagagctctatggcaagcatcatttgatgccttctttgggctgcttacagagtactgcatgagtaaattcgatagtgtgattcatgcattgcaaacacaacctgctgtggcagcagttataggcagggaaatgccagttgaattgttgcgtgctagccttccccacacaaatgagtatcagcggaagcagttgctcggttttgctcagcgcacggtgcctgttaacaaccatagttctcatgggtccagtaatggacccatgacatcagaatctatcccaagttcagaaagctggaaaatatgagtgaaagcatagtgtttttgcttctttgggtaatcagtatactagatacaatggctctttaaaatggagactcttccctcattttcccagtaaagaaaagtcaatagtaatatgaatccaggaaacaaagatcgagagggttggagcatcgataaacagtggtaatataaggcaccaagtttactattgttgcgacatgtctggtttattatgttttgtagggatgcaatctgttttgcatgtattatgcagatggatgtgtttttgttactgggaagtttcttcctgagttttgttgctcatgaaacctgcctggtatctatctctggc

SEQ ID NO: 28930 - DNA, 1362 bp, Oryza sativa
cgtgaatggctagctgtgtccgagctctagggtcggccgtggtgcaacttggggcttgatagaggagcgaatcgagcatggcgcggatgagctcgggggccggctgtggtgtgaattgaatcaacagcggatgagcttgtgacggctagtggtggcgcaaattgaagcagtgacgaacaagcttgcgacggcagagatatttcacccatgtgcgcaaattgcttgtgattggcagattgggaagcggtgctcttcactacacgtggagaacgagaatagcggaaaagggattttcaattctttgggatgttgattggagatctattggatctattttttttatacataactacaaaattttgagattgggaatagaattggacatctcttgggcatgctctaactattactcattagtctctcggtgcttagctaacgatggtgtaatgattgtttcatgcatgctatttatgcggagatagaaagtatgtgtttcaatgacagtaggtgacggagtgctcggttgtgcgactcagccaaacaaaaggattggcccagggcattgtttgttggtcgaaccaaacacacggctgattattgaatgaaatggattcatcatcacacttcattagtcaaaagcacatctagaaagagaccgaggaatgtagttatcatccataggccaacacatccggcaacaagttgtatttctttaaagtacaaattttattttggatagtcttttattaccgatgtttcgctttaaaccattttttaaccaatgtttttattctaaattgagtatttgtatctctatggttctttggatcttaactcttttatccatttacatccaacttgttatatcctaaagaaacaatctttcatatagttgtgaaacaatctttcatatagttgtgagagttctttgatgggtaggagccgacgtactcaagatctttcatatgcttgagagagtcaggtggttcaaaataaaacaaagccaagattaaccggtccaaagaaaaaatattagttaaagagtgattcaaaataaaacattggtaataaaatatgatcaaaagtgaaatttactccttttttttcatctcattggttttttaccagccaccgaaactatttatttaacacagttatgatccatattgatcacatttaattgtgtggatccactgaacttatgacattaacatattcttacatgaaaatttgttactccctccatttcatattataagtctattttacttctttttcctaagtcaaacttatttaggtttgattgagtttgtaaacaaattaacatctataatatcaaattagcttcattaaatataacat

SEQ ID NO: 28931 - DNA, 1379 bp, Oryza sativa
aaagcattgttgcaggggagaaactgtgagaccaagaaattaaaattttattttatgccaacctgctgcaaagagatctaatgaggattcgaattgtgaagaagacttgacgaaaaaaattgaagaataagtttcaaaaatttaatgtccttgggcatagatataccagatgactataagctcagctaattaaactgaaaatgacatgcataagaaccaacttagattaggtggaatgtaagacagactactgtgaccagatgagaaaatatgcactttcatggcaatagttacaagctaggaaaaaaggtgttatactacaagttcatagggcaaaattggcaaatatctatattagattccttgctgataaagctagctggagataactctcaagtagactgatgaaatgatcagataaatggcaatattttatcttaattttcagagatcgttttttttttcagaattcacttcagacagaagtaacagcagagacacaaaacttgagggtgtacagaagggattgttctaagaatgtctcggatttaattcaatgaaaggatccaaatcctcccacccaatcaggcttgaatgaacttgtgcaaaatcatgatttgacgaaaggtgcaaaatgggaagttcagggacaacaggctattggactgctaaacaaacagctccatgcaaataagccactatgttcatggatagattcgtaatttttaccttccatatgattgcggatttatcatttgatgctgaggctaaatactttccattgtttgaaaattgaagaaaccatacttcatcacggggtgcacgcagaacctgcaacaagaattttaatgtgcgattagtaccagtgaattttgagatatggagctgccagcaaagagaagtcttggcgaataacttaacgggaaaaaaaaaagcagttgatcacccaacggtaaaaaaaatgagtatatgacaaagcatggttatagaaaaccacaaagcaaatccaccttgcacattagggcctgtttggtagagctctaactcctaaatttagctccagaagtttggtctggagtggagttgtggagcagcctaaacccagctaaacctctctagttcattttgtgtgagtgctccacccagctccgctcccattttaggtggagctgaaactgtttagctaggctccagctccagaagatgtggagctggagctggagctggagctgtgccaaaaaggccctatgtttacatttctccatgcaaatttcccacaaaaacacaccaaagcccagccacctagccacaacacggattcaacttacacctcatgtttagcgtttagacaggcaaatttcccatagcaaaaagctagg

SEQ ID NO: 28932 - DNA, 701 bp, Oryza sativa
atatatcttgtcctgtcttctgcaacttccgtaacctcaaaatctggaataattttcctacttcagatctatatatggcatagagctactggagatcttattgaaactctgctggtcacaccggcacggtcaactgtgtgagctggaatcctgcgaatccgcacatgcttgcatctgcaagtgatgatcacacaattcgtatatggggtttaaagaaggccaatctgaagcgcaaggatgttggcagcagcaatgggatctatgcaaatggtaatacacccagcaatggtgtggtacaccagtgcaacgggaacagcagcaaatgaacatggcttgctaaccaatggatggatgactggcatttgtaaatccccttttccttccctttcctttagtttcctatccatcagggaggacgccatagtaaaacaaagctctgcagcacatagtgtggggaaacctgctgggtttcatgcacgatctctcatgtattccatcttactgtttgtcacatttatttcttaattcatgctgaaaagatatttcgatactatattgcaccttaaaggtctttctgttcccttcattcttagtgcttatggtaacaagtgttgtgatttaagtgctgattgatcaagcacagaacagattgtaactgggtaacctatggagaaaaggtcatctttaatgtaatgcaacat

SEQ ID NO: 28933 - DNA, 2068 bp, Oryza sativa
cgaaggcgagctttggacctgcactggagttaagcagatctcccaggccatgtgttttctgtcaacacgcttttggcacgccctgtgggacctgattagaagtcagacgtcagttcttcctcatggcttagaaacaaccaccaccaccatcaagcccaggttccgttaaaggcaaggcgtcgaagccgggattaactgacatcattgatgacaacgtcatgccaatcgatccagagaaattcacgcctgagcagaagcaggagtttgaagcgacgctgcagcaagcacgagatcagttcctgaactcgttcatgcaaacccgcaaggggacacttgttcagaagtataaaataaaattggttgctgataatcttgggaccggttcttctaaatatggagaggtgaaaaaagctccagaaggctcggctcagccgagcaacaaaggtgctactgatggttctctaggaaatcaaggcgacaaccctcaaggggtccatggagtacaaggtgatagagtgcatggagctcaaggtggtggtgctcaagggccgcaaggaggaaatcttaatcagagtaacgagctagcacaagattttttcaataacttccaagatcgggttgattacgctgtgcatcatgctctgatcaatcagtccggggtattagtcaatacattgtcaaacatgatgaagacaatagccgatggttcgatagtcgagcatcaggctacaggcccagtttacttgcaaggaggtgtcttcccgaattatcgatctttgatcacgaatgttcagccatctgttcaagcggttcgctccgttgcacccacaattcagccgacggcgccagcatcaactcccctgcatggtacatcagctatggcgccaggccagccaatgaaccttcggttgttaatgagggagcatccatagcctattgggcagattgcgaatcagccgacccaagatcaagttgctgccatgtttttgccacctccacctattgttgatccagtgcagcagcagccgattcagcagacaccaccaatccagccagttgtacagccaatccaacaacaggtcgtacaaccagctcagcaaacaccaccaaggcagcagcctctgcaaccaattcagcaaacgccaccaaggcagcagcttcagccgatccaacagactctggtgagacagcagatcattcagccaattcagcacccggggtcggcaaatgcatcgccggagtttgcaccacctggtgggcaacttgcgcagcaatttgtaaaccaagtcgtcctagaacatttggttcaccatgcacagccggcgggcatagtgatgcctcagatggttcctgagcacttggtgcgcaacatccagccgaatctccataattatcaagggggtaacttgaactatcaatatcagcctccttccccacaagcccaatatcagccagggggattggctcagcccagttcgcatctcagtttggtcaattcgagcccatgcagcaacagccgcaacgagcagctcagcaacgaccatgggccgatgtgattgctgatgtaatgaggaacaatttggactcaaaccaaaagaaactggaagtttgtatcggcaaccttaccctgagtggtttgaaagagttcctcttcccaatcagtttaaggttccaaatttctccaaatttttagggcaagagggcgtgtcaacttatgagcacatcagccgattccttgctcagtgtggtgaagcatcggctatagacactctgaaagttaggttgtttcggttatctctatctggatcagcttttacttggttttcctctttcccatatgggtcaatcaacagctgggccgatttggaaaagcaattccacagctacttctacagtggggttcatgagatgaagttgtctgacttgacagcgattaagcagtggcatgatgaacccgtgcacaagtatattcagaggttcagagagatgaggaacaagtgctttagcttgagtttgaccgatgctcagttagccgatttggcccttcaagggtatgattcctcaatca

SEQ ID NO: 28934 - DNA, 622 bp, Oryza sativa
  unsure (1)..(622): unsure at all n locations
ctagggaacagatcgaaaaatgcacctcagattgagatgccctgtaaaacctagtaaattcagtccctaacatacccaaccattttcctaattgccacggaccggggcagtatcgtaaatatttcgcatgcgaacttgctgcaccgtattaccaccaaggcaccactcaattcgaagttggtgagtaaaaaagctcctaaaacaaagttctaatctatgcaaggaaacaattcgattaataaaaagaaaaagaaataagcccccggtaacagcagcaccaatcacctcgtggcaagagccagccacggcacgcactgacagaccaggcaaatccacacaaagagaaagggaaccagataatacacgcacatgaagtagaagaaggcggtgggcggcttcttggggcggcgccggtcgacgaggggctgccccttcttccgggacggcggcggctgcggctgcggcggcggcggcttgggccgcggcttgacaggaggcagccgcaccgttttcagcggcttcggcgccgtctgcgacctcgtcttcatnnnnnnnnnnnnnnnnnnnnnnnnnnnnnnnnnnnnnnnnnnnnnnnnnnnnnnnnnnnnnnnnnnnnnnnnnn

SEQ ID NO: 28935 - DNA, 740 bp, Oryza sativa
  unsure (1)..(740): unsure at all n locations
nnnnnnnnnnnnnnnnnnnnnnnnnnnnnnnnnnnnnnnnnnnnnnnnnnatatcagataatgggtgccattactggaatactaaatggttctatctggtagactactaattatcagtataaagacagtaaattctgacgaaatatcccaacataataatgcatatttatttggattaaactttaaactcatctgtcacctctattctaaaaataaaatcagcagcagccgttccaagtcattagacttgataaaacagcaatcaatatttatgcattcataacattttggagaaaatgaggtggtcgatgcctagataacaagaaaacacagtgtaaatctgaagaacaggcctaaacattaatacatttgcggtactgtgcaaggttccaaaagtgaactagatgtagtgatgtttttgtatacagtgtaataatccaatgtattgaggatgtttacgtatgctatgactatattttccttacatactgaggaaatctagaatgcagaatgccaatcattagcacaagtaatagaagaacactgtaacaacgaaatttaacaacatccatatcattattttatagtgataggtggccatcaagcaaaatcaccatacctgtgaatcttcactaccactagcaataaaggcctgctcggatccaccaaaacaagaccttatcacaaaccggctgcgcttatgaccagcataccggttaactcgaatggggcaattcctt

SEQ ID NO: 28936 - DNA, 1579 bp, Oryza sativa
ataggtagtacaattctccgctcgctgggctcacatagtacatcctacctatcttttcgcatggtgttctaggatgccagctacatgagctgttatcccatgtccattcctttgggaaatcgcagtatgtcagtgttcttgcagcactatgttttttattggcctcaaaccattctgtcagcatcattttttgggctgcaggacttgtaagcagcgaattcaggtcagcaccttttttgtatcgaacaaagttctggtatggaagatgcacagttaggcgctcaaccgaaggcaccctatagtggatatcaaactcaaaagcatgccaaagggactcacaagtagaaaggaaccttgcatcaatgtactcttgtatctcattccgtggtgtgctgttactgtttggtgttttctttgatgtgtcattttgtggtgcactattattttcagataactgactcggtaacttactattaacctcatagtacgctttagatctgtcggttccttttgtgacatacttaaagaggtacttaatcatgttagatttattgcaccattcgacatttatatgtgcttggtattttttaagaagttccatgttgtaaggcacaacccattgattatcgatcttcactccatttttaagaacatatcggtcgttatctctacgtttgtaaatagtaaaaccaaactcgtccattattgtctcgtcctgaaaagacttagggaagtgcttagaacactccccttttttcatgcatgggcatgatttgttctggttgccacaagggccatgcatcatgaactcatcaaccaaagcataccccaatggatcagtgaaaatgtcagggatttcagcagaaatgaacccatcaacaataggagcactgaagtcaatagtggatgcaggcagccaaataaggcaatgtatatgagggggcccacgcttttgaaattctactgtgtagagcactatatgataagcacaaaatatcagaaccaaccaagggagcgcagaacaaactaaatagagcaaaaccaaaaagcctaccagcaaggactgggccaaatgtctttccttccttaatgtccgagataaactcgtctactttcatgttgaaaactctaacaatcatatcagaacggtcgcttggtacctggcctggttcaaacaacaatgcatcgtatatttcttgccacttagaattgcaagtaaaagtcacaaataggtcaggtgctccaaatacacggcatatggccattgcatcttggtaattctgtaccatataacgtctgccaccagtaaaactggtgggcagtacatacttctttcctacagaatccccagatgcaagaccatgatcaatggcatcacttatcccttgtacagattctgagcggagttcatgttggttgtcagcaatgtattttagtctagacccttctacagttgagtatgagtcaacacatattgcatcatttagatgaccacatcaagtatagggatttagtttattcaaccggtaatggagtcggtagcggtagtaatcaagcattgtaacatagcgtcgtgaat

SEQ ID NO: 28937 - DNA, 1503 bp, Oryza sativa
atgagaggatttgtttgagtttttcttgaatttttgatgatttgtggatgttgttgatttgtgaatatgtatgagaatgtttatgtgaataaatttgtgatgatgtgttgtgaatgaatttgtgatgatctgtatgaatgaatttgtgatgttgtggatgaatttgtgatatgtgttgtgaatcaatatgaatggagaaaaaaagggaaaaatcaaaggaggaaaaaaaagaaaaaaaaacatagatggttgtatctttagttccggttggtgactaaagatgcatctttactcccgggtatttcaaccgggactaaagatagcaatctttagtcccggattcatagtcccggtttgctacctaggattatagggggttataaaccgggactaaaaagggttagtgcaccagtgccattttatttctcccgctcaccacgaatctcaaaggacattggatggtcctaaataaacgggttattttaatgaaaccgatcatttaaaagataccaatcaacacgcatctcaaagccacatcagatatcttaaacatttttttagcaatatcgaatatttttaaaacacccaaatatattaactatcagattttattttggatggggataaaattattgtgtttgttttagcaaaaccaatcaatgaaaaaagtacgaaaatgctcattatcaagcgaccaacacaaggcgaaccgaccactcatttcctcatcctctctctctcttcttcttctctcttcgctctctctctctctcgcgcgcgcgcatccgtatttggcactcgcatctggtggcgccaccgcccttcttcctatccttcctctgcgtcattgccaaatcaccgcatctggcgccgccacccgtcgtagccacttctggcactgccacccgtcgtcctctcctctctccgtgctgctgccccatcgcctggaacttgggagctcgggagctgtggaacacgacgaccgagcttcattgtgatatcccagcccagggcttaataggattaatagaatactcatatcaacaagttgcaacttcttttctggaagccgatctctaaagaactctgaggttaagcatgcttggcctagagcaatttagggatgggtgaccgatcaggaaattctttccaggtgcgcactttcctaggaaagctaccagatgtagagagggcccggcctcggaaagtgtggggcgtcacattcatgcagcatcgatgatggtggatacgtggatgcggtggagctcgtcacgacatcgacgcggaagtggttgctaaccactggagtggaggaagaggtagatctaggttttcatcttgaattttttgatgtttcagtgcatgtactatgatgtttgattagttatatttgaaatgttgcagtgggtattcgatggtttttcattctatttctcgatctagaaatgaaacagttgggggccgaacaacgccagaaaatagcccaaacttccatcctttctt

SEQ ID NO: 28938 - DNA, 491 bp, Oryza sativa
catttttcttctcctttcggtaaattgctacatggtagatggtaggtagatggaataacaaatcatccaaaaaaaatatagctccggcctagttgattgcatgaaaaaattggcgttgagatgccatggccttaattacttggatttaaacttgagtatttagaatcgtttgcatagaatgtggtaacctccagtactagaaaaacattttcgccggtcgccgtccgcctgtagcccaacgactgcaaagatcgccgatcttcgcaggcgggttggcggtccgcctgggaagataattttcccaaacggagtgtagctagacccgtctgcaaaaatagataacggccgcctgcaaaaaataacaaattaccgcctgcgaaggtaggttaaaaattttaaaatttgatacaataataatttgcctataaattagttttcaattatttaattgaaattgatgcaggaataatattagtaaataacaagctttt

SEQ ID NO: 28939 - DNA, 682 bp, Oryza sativa
ctgcaattgtggaacccaaaagtaagaggtctcttgcataacatattaggcctagttgatggcactggaaggacagaaagaaagcgcaaatttaggacaaagatgtggactgtaaatctgaagcgtttgaccatagggcccaaaaaatattttggagcttgctatacctgccaccagcgccatcgtcaccatcgtctttgaacaacttcttagcagcgcctatgccaggagatggtctagtcctgttatttgtgatttgttattagcctgatgcagaattttctatctagcaatatttagaaggagcaaaatagagcttaccttttttttagcttttggaagcgctttgtttagtgccagatggaggagatttcttggcaggctggcatgatcagcgccctagtccatagaaaaagaagttcagtactcagttttgaaagatgtttgattaaaagaaaactgagaagcaaaataacctcatcctctacgtcctcttcatcctgaacatctgcatgggtctttgaaacacattctatgtccaactccttctttttcgatacagcagttgatgggctggttggtccagtctgtgcatcactaaggccaactgatggagttggtgctagagccatggaagctgggagagaagatgcttgagatgcagatggcgactgaagcaagg

SEQ ID NO: 28940 - DNA, 1341 bp, Oryza sativa
gagggtgggtgaagaggatgatgacgacgacgacggcggtgccgaggaggcgggggcactacacgccagtgggcgtcgaggtcgagctgcacggctcggcggcggcgggggccgatgaggagaagccgccgcggcggcggggagggtggctgcggcggatgatggtgccgcgggagtgcgtgcacgggcggcagcagcggtggtggaagctgcaggcgggcggcggcggcggcgggtcgtcgtcgaggctggcggcggggctgacgcggtcgctgtcgcggtggaagacggccgggagcggcggctgggcgacggcggtggccgacgccgtggcgttccgcgtgatgtacgtggtggaggccgtcgtgctcggcctcgcgctctcctgcttcttctgctgctgcggctgccagatttaaaccaattctgctcgccgcagctggccgcgttcgtaaccatcatgcatgtatgtaatttttttgcttgtggttaattagttcgatcgtgttgtaaatctgcgcccttaattaaatccgtacgatttaacggagatcatcttacattaaccgatcgatcgcctcttcagctgagataattgggttggtgttcgtcgatcgtgcgtacatccatacgtgttctcggtggacgcgactgctcaacagattgatgcctctagattgctctagaccttgccggctgtggcgtgcaccgtggtccctgtacgttcacgattagccatggcccatgggcgtctgcaccggtagacataagacatcgaggccgtgccccgtgcattcttcacccaggagcccttagggtttcctttttttgttggatcaaagaaattttgtagatacaatagtgaaattagattgaaagggaaaaatttctataacaaaatttgggtttttttagaaaaatatatatataagacttcttttctccatattttagaggagcctggtttagccgaatatttacgaaattcaacccctccgtagttgtaatacattcatcattgggtatgcagaaatttattggccaaatttcattaaaattaagaaaagagttacattttacaacacaacaaggtcgctgagttagggaacaacatcactttacaagtataatataatttgtgcctcacatatagcatcttgtactcgcactataataggcattgttgtccccacttccctattagcactatcctcaaaagataaggctcaattattttcttgcaagggtgagacggttattctcgcccttgagtaatagaaaaagggaccacctatacatttgtcgataaattttctcttgaaaatttgacaaatgtaatta

SEQ ID NO: 28941 - DNA, 620 bp, Oryza sativa
  unsure (1)..(620): unsure at all n locations
nnnnnnnnnnnnnnnnnnnnnnnnnnnnnnnnnnnnnnnnnnnnnnnnnnnnnnnnnnnnnnnnnnaaagagtaaacatacttagggaaatcttctagcacatcattgcattcttccagtgtggaccactttgtgaaagaaattgactgcatattgctcactggcctatactggctggtgcactgccttacacgatagaatgtcagatcatacaccttcccttcagtgatctgaggctggaaaagctcatctaatggtgggaaaatctgggctgcaatactggctccctgtttacacagtagtacaaagggaaaatatgtgtatgaactgtaagcaaagattccaaagaactaaccgtgcgatcaagcagaaccagcccaagatggtgcaaattactttcatcattttggtcacgaaaagcccagaaccttgacacacgaacacgaattgttgggttcccaagactaggttcaagcctattaattagcgtagcctccatttgtacagaaagtttgaaacggatagttcataacggaaattcctaggatatcataggtacggcaaatagtaaaggcatagataagagggatggggtaccgagctcgaattcgccctatagt

SEQ ID NO: 28942 - DNA, 1652 bp, Oryza sativa
cgaattcgagctcggtacccccttgagggccatggggaaataattcgccatgacccggtcatcgccccttgccgctacgatgatcgtggtgtagatctggaggaactcggagggattgatgctgccatcatacttctccgtaaggttggggcgaaacttcgggggccaccggacgttccgcagactcgccacgaaggccctacaacccgtccctccaggggtgagcgtggggggagggccgcctcgtgaggaggaacgtggcactccagatgaggaggcgccttcccccatgcgggcagctcagcgctcgtcccggcgtcgctcgatatggattcgagcatcctgctccctgtagagaccgtcgtgatgcctccggcttcccgaggcccccgacgatgttggagccgtggaccgcctcgagaccatggccgaccaacaggccctcctccttgctgacgaggagagggtaatgggggtatgcaacgtaccggtgacggcgggtcggccgcccgcggccaactgccgctgggcagtggtgaccaagttggccacgtcgtccaaccagcgctggacaggggtctctggctccgagttcacggggggatgccgcagaagggcacccgccgcctaaagcgcgcctcggggcgagccgccgtcaccgtaaggaggcggcgccgtgccccgatgcgtcgtggcctcccttcacctgggggcggggagagggccaaaccacccgaacgggtggggtcctccctccgcgagggttcacggcgggggggagttggagagttgcggcggcggtgacgagggccgcagctctcgctagcatcctcactcccagacggagtgggggtgaataccacctcctcctcctccaggacctcgaccatgatcgtcgagggcccagggaaacttgggacggaaggaaacgacttctctttaaagcgcgtgccctccccctacctggcgcgccagctgtcgagggatgatcctctctagcgggaggtcgtgagacccccctttcgtgagttcggccgggggaagaagctcgcttctagaaaccacgtatccgtccctaaggcccctagctagctcgcacacaatcaaattatacaaattcgggccgctgagaagcgtaataccctactcctgtgtttgggatttagattgagagttacaaaggttcctaaactcgggagaacactcttctcctagagcccaagttagttgagaatcgtccctttgctcggtgggcaaggtcctccttttatatctcaaggggataccacatgcaccgcctctacctactcttctttcgggtggggtcccaccctatcttgaccggaactcgacccgtgccttcgcctggaacctgaaccacagcttgtccttgaatggggcccagtgccgtccctcgcctgacacgggagacagccctgtcattccctcattaatgggtgaagacttgtggtggccgccgtccgaatgaccctccgatgggacgggtcatacctacctccactccgccggaagcaaatgcgacgtgggagcacggtcggtgtcaggccggtcacagaccggtcattcttgactatggcacgtcagtttagcacgccgcacgtctgtctcactgcattaaatgcgacaggggg

SEQ ID NO: 28943 - DNA, 4001 bp, Oryza sativa
  unsure (1)..(4001): unsure at all n locations
tctctccagatgatcatttttctttttataaaagaaaccagatagccatcttcataactgtcaaatattaaaaagaaataggggatcaaactttcaattgagttggtccacaagacatatatttactagtgaaaaataaatctagtgatgatcttaggatgaaccacgtcatctatctatcttctattatatactaaaagtctattaaacttcctataaacattctcaagccaccacgtggcgctctacaaacgctcctaagtcgccacgtggagctctaataaattagaaaaaaatcctagaaattttaagaaaaaaagaaaaacatctcaccattggttttcacttaaatgagtggatccattatttttaatcattagatcaattttaaaggaatatatactcaatccaacctatgggcctattagatcgatctcacggaatatgtagccttcccttcccctgctgtacatgccaccgtacgtaagtacgtatatatgtgatacgtattccatatgccctccccttttctcctattttctaaaaactcattacaaaatagtttaaattttaaatagctaaataatcatgattctcaatttatatacaacattaaattcatttgtactatttttatttgtaattaaataaatacattaagatcgatattgcatatattttgcgaggtaaagaaaaaactgaaatacgtttggacatagaccctagcgtggcagtcattaaacaaataaaaaaattgacaacaactataccatcttaaatcattctatatataaatatgtacattaaattaaatatcatgtaggacgcaaaccatcaaccgtcacatcctaaaaattaagaaatatcgttgaaattctatgagaaaaacaaaagcaaaacatcctactatcattttacacttaaatcggcaaatttattattttcagccattagatatatcattctactctcataagccactacgtatcacatcttaaaaattaataaaaatcacataaaatctaaaacaatgaagcatctgacctcgataaaatcattatttcagccattagatctatatttaaagaaaaactataaaaaaataaagtaccatcccattccccctccccctcacctggattaacaaagctccatctttatattatgaaattataaatatatagtaaatgaataaagatatcgttggagtatataagtataaaaaaaaacagggagtagctaaagaaaagccctaagtgcggaaatgctaatgggcgggtgatcgctccctcacccgcccagcgatcagacgcccgccccctcccctatactactagatacactcctccctcctctcctgctacagtacaccacacaaaaatttaaaaaaaaacaaaaagttagaaaaatttatgtatagaaatactatatataaaaaatttaaattcaaattcaaatttgaatcgggtatgtaaactttttgacttataaactttgggtctataaactttaggtgtataaactttagatgtatagaaatactatatatagaaaatatttgaattcaaatttaaatttgaatcggatataattcaaattcaaatttgaatcgggtatgtaaacttttgacttataaattttgggtctataaactttgggtctataaactttagttgtataaactttagatgcatagaaatactatatatagaaaatatttgaattcaaattcaaatttgaatcagatataattcaaattcaaatttgaatcgaatatataaacttttgacttataaacttttggtctataaactaactttaggtgtataaactttagatgtatagaaatactatatataaaaaaaatatttgaattcaaattcaaatttgaatcggatatataaacttttgacttataaactttgggtctctatactttagatgtgtaaacttgaggtgtataaatttactaaaataagaaagtaatgcggtggtaaaaaagnaaaccaggtgaagggggggcgtggggcgatcgctacccccatctccaggcgatcgatcgcccattaggatcgcccccctaagtgcttcaatcctactgcatcattagtcaactgctcagtagttttgctccctccgtttaaattatactattgactttccacattcgttttaaaatgttatatataaatgttatttattttgttgtgacatattttattattattaaagaaactataagtatgacttataatttagaatatttacactaatattttaaatagaacgaataatcaaacattattttaaaaattatggtattatctattaaagaaaatagcagaggtagtattactaggggtggaaacgagccgagccaagcctagctcggttcggcttgcaatggctcgtaacaagctaggcttggcttggctcggttcggttagggatacgagctaaacnatgagctcggctcggctcgtttcctggctcgagccagctcgcgctagcttgcgaaccttccgttgaagctatataatttataatcattaagaaaagcaataacaaattatcaacatgtaaattaaaataactttatatattcaattcattaaaatctagacgataaattatatattgacaaataataactcaactgcaaaataaaatcatccatacaaatatatgatggcctaggctcacgagccaaatcaagtggctcgtgagccagctcgggcttagctcgtttcagaaacgagctaaaaaggaggcttgggcttggcttgtttggcattcaagccgaccgagctaagtgagctcgagccaagcccgagctaagctcacgagcccaagctttttttccacccctaagtattactaattagattgatttagggtagaccgcgagaggtggcggcggtcattggggtcacgtacaatactcctatctgatttgatctccaagacttcaaaacttggaaaagaaatttggtgcagaactgcagaactgcagacctgctccagatgattgccatgtggacgacgtggtgatcagacggctatctcccctcggctcctatgcagcgcgatatatatggtaggatcgatcgatcacccttctccatatggtttcctattttaacaccgcattacttttctattttagtacatttatatacctaaggtttgtgcatcataagtttacacatgtaaagtttatgcacggtggcagacttcaagttacagattataaagtttatatattgttgacgagtgatactcgcaggcaggataagttgagtattggggtatgtttgaatgagggtttatgtagtacaacatctagctaacagaagacgaggattatactggttcaggcccgttatcaggtaatagccctagtttagtttatatgagattgatgatgatgagaacagattacaaagagagtagatgaagcaaacgacaccgacgagatcatagtcaatagattcgacggggccgacgagatcatagtcgatagattcgacgagatctcccggtgacttggctccgaatacttcggcttcgtaagctgtggtgggtgtgttggcgatgatatttgatgcccttcacctccctctaggggtccgttttataccgtggattatcttacccgaagtaagagttggagatatgtaaactagtacgatatagcagatattctatcccctccaagtaggactctgatagtttcttaactcgtagagatatttttcataattcgggacagattcctaacggtgtatacggaaacgacccgtgcacgtgaaggtataccttatcggtatatttcataagtcgtaggttagagggtatgccttatccataatcctaacatacacctcaagtttagagacccaaagtttacaagtcaaaagtttatatatccgattcaaatttgaatttgaattcaaatattttttatatatagtatttctatatatctaaagtttatacac

SEQ ID NO: 28944 - DNA, 631 bp, Oryza sativa
ccattagccacacccgaggatggaggagccatgctcggctgcattttttcacattttagtactttttaaaaacttatcctgcaaatagacctataaaagaacttattctagaaatgatccttgtcgcggcgccaatgtcgttggcgccatgtttcaacatgacggcgccaatgacattggcgccatcctctccgccctcgggtgaaagtttagtcacaaatgtgaagtgggacggcgccaacgacattggcaccgaggaccaatttgtaaaaaaattgaaaaggacctatttgtaaataaaaaatatttacaaataggtccacaaataggtccttggtatcagcgtcattggaactaaggacctatttttaaataatttttatttgcatataggtcctttttcagaaaaaaataatttggtcctcggcgccaatgacattggcgtcgtcccgttcacatttgtaacttacctttttcacctggggctaggaggatggcgccgacgtcattgacaccgtcatgttggaccacggttccaacgacattggtgccgtggaaaggatcatttattaaataagtttttttagagatttatttatagaataagttttctaaaaagatcaaaatgcga

SEQ ID NO: 28945 - DNA, 3444 bp, Oryza sativa
  unsure (1)..(3444): unsure at all n locations
gattcttattcctgattctggtgttcccgataacagcagaacttatgcctttctcatttcgatttatctttatgatgggggttctctatcttctctgcagaatatatacagaagagggaaaatcgctatacctgaaaggactgtaaatttggaaaaagaggatggtgttgaaaaaattgtagtccttcactcctttgtaatatgaaataatccctaaattgttgcaaggattgtagtccagtcgtccagattgtaacctgaacagccttttttttttgttcaaattgcaagaatactgagttatccctttgtaatctgtagactgtatttttctatctggaatacatatgagcgtttttggttgttctgaaatattcaatctgatggatgtgttacaaaaactgtgattgtttatctaattacgtgagtgaataaaatacggaatattgtataatctgaatttttgaagaaatttaataagaacaagtagcaactcacaaggtgagttcaggcaaggaaaagatgaggataattaagagcaactcaagaactggtcgccacaaagtcaagtttttacatgttaataagtcacaatctccgtattaacgtaactaataaatccatggtcgcaactaatatcatcaatgaaaattcagtaaatccattgctccttgtcgtcatgcgcagcgcaggtgaaaccagccggcacctgatgagacgaaggcagaagcccggcaggtcgatctgttcttctccaggcctcctcgtcctaccatcactatcgtcgacggcgtcggcgagaggtgattccggtccgattgaggtgagagggcgagggagcgatcgccgcagcgcgtccgcaaatcgtgctcgccgttcgatctcttttttatccacgcgtccaccatcggcgcccggggctgcagaggcttcgctttgcaccggtgtatgcaccaattttttttcaaatcaactcggactcggttagtcgctttgtactgccgcgcgcgcgcgtttcccatctccgactcggattacacgtaggcgcgccgcgcgcgcctatttatagccgctgtccgtctccttactccatgcattagcctgattgctagttgctgctagcgcgtggcacaagagcagcgagaccagcagtaagctaggcatggcggcgcgcgccggcgacaccggcctgagcaaggtcaggcgctactggcccgggagggcgccggactgggcgtgggcgggcgccgctgtcgctcacgacgaggacgacgcacgtctcgtctcgacgcttgacgagatcaagcacgtggaggaggaggtgctgaggtcgccgcgccgccgccgtgtgcggcgggctcccgagatcgcgtcggcggcaccggcggtagatgactggcacgagcccgatccgatcgaggaggaacaagacgaagatgatgatgatgatgcccgggaggagcgcagagcgaggataagggagagggcgctgctcctgaggcggcatgaggaggagcagcttcttcttcttcacccgcagcatcaggaggaggaagatgaggaggcgtctgagtctgaagagacngcggaatcggactccgacgtcggcgagcagatggccgtcgtctacatggccgtgccactgtttataccaaagccgcggcgtgacaccatccggctcaaggagaaagaacggcagcgatttgaggacgagctgcacggaagaggctcgaggacaggaaggctcagacgaggcagatcttgctccaagagatcatcaacgaagagctcctcgccgccaacacagcttcagatgaagccgccatcaacggcgtggacaccgacgacgaggtggaccaagccgaggagtacgagtcgtggcggcgccgggagatggcgaggatcaagaggatcagggaggagagcggcatcgacgacgacaagtcgatcatggaagacgagaacccggttgctgatcgtcccaagaagaagatgaagatcaagaagcagatgaggttcatgcaaagatactaccacaagggctgcttcttccaacaagacgccgacgatgcggcgcagacggcaggatcatgcgaaatctaccggcgagatttctccgggccgaccgggttggacaagatggacgtaagcgtcttgcccaaggtgttgcaggtgaagcactttgggcggcgtgggggaaggaagtggacgcatctagttaacgaggacaccacgtacaggacaccacgtacggtgagtgattttgtatctatccccacaattttgtaaaatttcaaaaaatgtgagcagcggcaagttatttttcacccccttgtgacgtactcatctgtattttaatgtatgacgccgtttactttttgaccaacgtttgatcatttgtcttattcaaaattattatgcaaatatataatcatgtgacaaaaaatttaattgtaataaataaagcggtataatcttatcttagatgaatagttttggagaaaaagtattcttacatggttgcataatgcatgctagtagatatcttcaaaactatagcccaatgcacaatatttggcaccatagatctttacttgaaatgatatctggaatggagacattagacattttcatagattgttcgggtgggactcagtcaaatccatatgtgacaaaacatttggagatagtgttaacttacctctacctgctcaagccttagatgaatttcagcagctacaagttgaattgaatgagttacaacttcaaatacaaagggagatccttagtctgtcatatggaacagccgtgtttgttcctcagaattttcacgggctgaattttgtgaatcattctccccctagtcaccatttggctctggaaaactaaatgtgtcgtcaagaacaaagtatttatgtggctgatgttgtatgatcgattgaataccggagacacgttggacaaaatcacaaaaaactattgtgctctagaatgcagatctaccttgtgttctttgcttactggttctagggagacaacaatgcatcccttcttcgatcatgtgtcgagaccgtattagagtaagatggaatgctaatcttgagtttttccaaatggtggtcttggcacgaccgaggtttaggcaaaagagtttcttggatataatgttcatagcttgctggcatatattgaagcaatgaaatgaaataatctttcaaaaattgttaccagaagaagacaatttgttccattcttttaacaatgaaattctcttgcatatgtgcaagatgaataagccccttaatttagtcatttttgactgattacaacatttacaataattattttgatgtgatactcttgcgtttaaatattttactgttttaaatatataactattaggcaaagcttgttagaatttttcataaaaaaggatcagggtac

SEQ ID NO: 28946 - DNA, 2980 bp, Oryza sativa
gtgcagtagcgagaagtctgttggcactatgtcggtaaagaatgcttcatttatatcttttgaggatattgagaaaagtatttctgactggaagattcctaaggttaatattaaggaaatatatcatgtaggtactttttcgttacttagtgactactatattaaaacaattgaaatattccaattagttctttgcatgaaaccctgcatcttctttctgaaagagaaatcaattctataagagctaaacatcaatatcactaccttcactttggtcttatacaagttgctatcagatccttgactagaaagggtttgaacgtctctgttctggcttgtctaagagattgcagaaataaaaggttcaaagattccttatatctctaattttaatgaagataagattcccactaaagcaaggcccattcagatgaatagtcgactttaagaaatttgcaagcaagaaataaaaaacctgctagataaaagcttaataaggaaacgttcctctcctttgagttgtgcagccttctatgtagaaaatgctgctgaaaaagaacgaggagttcctcggctagttattaattacaaacccctcaataaagttctacaatggataaggtatccaataccttataagcatgacttaatacaaaggattcagggttcaaagatatattctaaatttgatatgaagtctgggttttggcaagtccaaataaaagaagaggatagatataaaactgcttttactactccttttggtcattatgagtggaacgtaatgccgtttggtttaaaaaatgctccttctgagttccaaaaaatcatgaatgagattttccttccctttacatcctttattatagtttatatagatgatgttttaatattttcccaagatgttgaccaacattggaaacaccctaatatattttataaaatcatagttcaaaacggtttagtagtctctgctaagaaaatgaaacttttccaaactaatgttcagtttctcggttataaaattcaatatgatcgagtccaaccagtagcaagagtaatagaatttgcagaaaaatttccagatgagataaaagataaaacacagttgcaaagatttctagggtgtttaaactatgtctccgatttttataaagatcttgcaaaagacagaaagattttaaccgagaggttgaagaaaaagcctccagcttggacagctaaacatactcaagctgttaagaagatcaaaggtaaggtcaaaaccttgcactgtctttatatcctagatcaagatgccttcaaaattatcgaatcagatgcctcagatcatggttatggaggaattcttaaacaaaaaaaggattccagagagcagctggtcaggttcacctcatatagatactgcattcctatcctcatatctggtgactagacccctagtcactgccctgggttagagctggtatcagagccaagtgctcgtaacctccccaagccatcttctccgaaaggggggggggaagaggggtcggatagcgtgctgaagtcgcggtgatcccgaacggtgtggtggtgttctgaagtcgcgaagttcccgaacctttgatcggttgcctgaagtcgcgttgccttgttgagccgcagaaggcgtttgtcggcgtaattcgttgactgggcacttatcaaaggcaaaggttgaacttaattgtgggaaatattccctgccgttgactggaacacatcatatccaaatagcttgatcataattgtgggagatttccccgccgttgtctggtaactacctacctatcttcctatctttcgtataagatgtcttggttggttagatcacgaagagccactgatcgatctgtagcctcgtgcagtagcgagaagtctattggcactatgtcgataaagaatgcttcatctatatcttttgaggatattgagaaaagtatttccaactggaagattcctaaggttaatattaaggaaatatatcatgtaggtactttttcgttacttagtgactactatattaaaacaattgaaaaaactattccaattagttctttgcatgaaaccctgcatcttctttcagaaagagaaatcaattgtataagagctaaacatcaatatcactaccttcattttggtcttatacaagttgctatcagatccttaactagaaagggtttgaacgtctctgttctgccttgtctaagagattgcagaaataaaaggttcaaagattccttacttggcatggtggaagctagcctcagtaatggtcctgtttattttaacatctttcctgatttttctgtatccctctcagacacaaatatccataaagttctcactctcaacttacaaacatctggttatgaactagaaccagggagtgaaaacatctccgttacctacagagtttactacaaagccatgacaactttagcaccttgtgccaaacattatacaccaaaaggcctaaccactctccttcaaaccaatcctaataacagatgtactacccccaaaaccctgaaatgggatgagatcaccctgcctgagaaatgggttttatctcaagctgttgaacctaagtctatggatcaatcagaagtcgaatccttgattgaaacaccagacggagatgttgagataacatttacttcaaaacaaaaagcctttctccagtctagaccttctgtcagtctagattctaggcctaggacaaaacctcaaaatgttgtctatgctacctatgaagacaactccgacgaaccttcaatctcagacttcgatatcaatgttatcgagcttgatgttggctttgttattgccatagaagaagatgagtttgaaattgataaagatttgcttaaaaaagaactcaggcttcaaaagaaccgacccaagatgaaaagatactttgaaagggtcgatgaaccatttagactaaaaataagag

SEQ ID NO: 28947 - DNA, 921 bp, Oryza sativa
agattgaaggatctgatcgagggttgcatagatggaattcacaagaccatgatctataatggtttggagagatatttcttcatggttgtatgtgggtaggttccggaatctttggagatttatctcagctttgagaaccaggaatctataggatgggtcagagattgcctgatcatctagccttaagagagggagcatatatatgattactcgtatggctgggtttctttctcttccttctaagagatcaaagaaataatcttggagtccaaggaatattttcatttgtctctctttaaacttttgccaaacaagatcgaggatgtcttgcccaaagcaagataaagtttgctccgtcttgaagcttaatctaggttggagattttcgtatgtggtactcatgggattttggcttttaagtttcttttggcaagaatctttgtaggcacaagatctacatggtgcttttggctgggtccggagtatatattgtggaaggaatgaattgggatgattatgcagtatgtatggtgtttggggaatggtatcatgcctttttgtggatgatgatggtttattatgtggaaaagattgcaataggttattgatatttatgtggaaagcaaccatgctcgaagcaggatctgttgagatcaaaatcttatctgagaataccttggtattcttatctgttgccatagattgttcaacttccatgggaagtttatcttggccatcacgggatttctcctcgcgataatctagtaatctctcctcatgatgagggatatcttgtagtttagcccttttttctgttatcttttgatctgagggcacgaaatttttgaaataatatgccaggccatttaaggcatgagctttttcttttttgttttttgcctgccacaagtggtttaataa

SEQ ID NO: 28948 - DNA, 728 bp, Oryza sativa
aaagtcctccatctgcctcacgaattctgtgggcggctttacagaaatatttatgagggataataccttctcgaatgcaattgacatcagcaccagaatcaattaaagtgatatgctgaaagtaggatccgtctataaaacgatacataacttctgtgtaccatttttgcttcatatatttttgaatggttccaacaacctgatcatcttcttgaattggttcgtccttttcttccatatggaatccttcttttaattctaacatgtatagacgctttcttatttcttctaaatcttgtttcataattttttggtcttcgaataggctcatcaaatctggtttctcattcttctttttctgttcatctaatcttttgaacacttcatcaatagagaggaatttgctcttttgaatatccttttttagtttatccttatcagtcttgactcttgaaaggaatttttcgagaactcttcttttttcttctggatcttgaatggtttcaaaagtatcgagaacaaattcttctaaactggttaaaacgagtatattttcatcagactcttcttctgaattatctggctcataacaagagcaaccactgtcttggcaacaattaatctctgcatttttttcttcatctgaacatgagtcattgtctatattatttagtattgtttcaagtttttctttaacatcttctgattctgaatctaacaaggcttgg

SEQ ID NO: 28949 - DNA, 4802 bp, Oryza sativa
cgagttgcattacccgtcgacgccgacgaagaaggctgcgccgccatccgcggctagggttgccggttgcgccagaagatgtggggggacacacaggaccacgggcgcgccggcggaacggagcggcggcagggggcgccggagcggagcggatcggggagggagcgagctctagagaggagatggcggagaagacggcggaggcggaggaacgccgacgaggaggagagcccgctcgagagatagaatcaggattcagggcagaggggaattttctttttttttctttctttcttttttttttttttggctggcatatgtggggacacgccgagacagtcaattcgtcagagagctgcggactgcgggcaaaacgtgcgaacttttttggtttttttggaattattattacgtgcaagtttgattgtagcggtaaaaataactgaagcgtatgtgccgttctgatgatggtagaggtgaaaagtgcctgaggtgcaaatttcagaagctaagtggaagggggtgaatatgtaaaaatatgttttgacgagtttttaaatatttgaagatattttgttatgcaacgtttggattgtatttgatatctattatctattatctatctattatatatatatatagggaaattatttgatgctccatggagtatgggctccaaaatcatccaccattcagctgcttaggatttgtgcaaaccaaaaactcagtgttacaaaaattagcgggttttacccgataagaaagatctatacgtacattccattttttttatttgcatgcatgtatttccactggtggagaaaccatatttggtcggtcgaccaaaatccacaatagtcccggttccactaaaaaccgggactaaaaatcatctttagttccagttagtggctacagtgggcatatttaatctttagtcccggttggtaaagatcatctttagtcctggtttgtatgttgtcaggggctgtcaggccctcccgtgatctctagtcccggttggtaacaccatccgggactaaaaatcctaactgtctttactcccggttggtaacaccaaccgggactaaagttaggatttttagtcccggttgttaaacaaccggtaaaacaaagcctctatccacgcgcgcgcatgcaagtctcttattaattccatcattatctcctcctctcccatccagccattctctccatcttatcttcttctctcctcctctcctcccatccttctcttccttcttctctcaccccatctcctcctcccctcccttcccctccggcggggcggcgtgatggaggccggccatggcggccccggacggggcgacgggatggaggccgccgccggcggcctggcgcgaggcgacgagatggaggcggcggcgaccggctgtgtcgggcgggaggcggcggccgacgcaggtcgggagggcggcggccagctgcgtcgggcgcggggtggcgagataggggcggctggcgccggtcgagggggcagtggcgggcggcgggccgtgggcggcggcgggcgcctggccgcgggcggcagggagcgtggccgcagccggcccggcagggaacgtgtcggcgccgggagctcgtgaccggcggcaccctctcctctaccggaggggggaggcggcagcgaagcacaattttcttttttttcccaaatttgtgatacatttggatataagaacttgtgattcattggatctgtgatgtttggatctgtgatgtatatgatgtgtgatgtatttgatgtgtggatctgtaatgtatttctttaagaatttgagttgtatttttttgagaatttgtgatgtgaatgattcattgatttgggatgatactttgattttggaatatttggggagatttgggaaggagcaactctttggaaagaaacaataaaaataaaaaaaaagaaaaaaatggtgaccaaccaggactgcgctgctatctttagtcccggttggtgggactaaagatggatttttagtcccggttatttaaaccggaactaaagatagtgatttttagtcccggattcgtagtcccggttggaaaaccgggactacaaaggggttaccaaccgggactacaaaccatctctccgccagagttccaaataaagtatatatggattctgaacgtgattatgacaaaattatgcccgtcaattacgttatccgttgaattgatttctttccatgtatacagatttggacgttcattttttctgtgtatatatataccatccgattccgacggtattgcaaattgtagaatttagattagacacatatacatgcgttcgaaaagattagatacatacactcgatcaaggtacatacgtccttgtccgcttgtcgtcgctgcgagcttcgtcgccatgccgttacgtcgctgaacgtccgcgaggttagtcgtggccgccgtcgccggtcaactgtaatctttcgtggccactatcgatcatccatgaggatcgtgcggtcgtctgtgaggttcatcgtcgccgctgcggtcgtctgtgaggttcgtcatcgccgctgccggtcgtctgcgaagttcaccgccgccattgaaggttgctgcacatgctgagaacatatctactgcatagcaaccatatgaagcgcgtatacaggccggagcaactcagtaaagccggaagccacatcttggaaggtatatatggaagaaatgtaagccatcggagtactaagcatcacttgtttgatatttacgtgttacacttacagtgtaatctatcttgaaacagtgtgtattatactttagttagcacctcatttttgttatttcagtatccaatccgaataatatgtttgtatggctgcattatcaacaggatacccagaaattaaatcagttaaaatgttgatttgtcaatgtgtgtcattcgatcgttttctctaaatctctactgtgattactgattaagttattagtgacagcatatactcaaccatcactgattaagtccaaaggggacacacacccaacgacgcacaggatgaacataatccggattgaattctttacataagtatatccaatcggttttgctaatttgcacgtgtgaacgtatcggaatcgggagtatttatatgtcaaaaaatatttttaggcgtgataatttagtgtatatgggtatttacataagtattatatgattaatgtacacctcaaaatttcctgcggcggagacgtgagcttctccaaggtgtggcccaggtgccacgctgccacgtgctgtgcgcgccgccgtggtcttgccccgtgcgagcagcagccgcagcggccagtggcggcgtctctccgtctcaagcgaagccgggatatatccaggtacacgatggtcggcggtggcgtcttgtttgctctctcttggggtatcacgcctggtactcaggtaccaagttctgatatctagctaccaactcgatactagggtataaggtaccagctggtactgggtaccggatagcagttaggagtcacttaaagtaccctgtagtaacggttcccgttgtctagtctctctctatttctttacataccttgaatttttggcacagacactagttataatacgatttttgggtatatgacatgactgttgggcacatacactaaataaaataagacacatgatttttatgtatatgccttgaatatttggcacatgccctgaataaataatacacgtgatttttgtgtacatacgctacactaaatacataatacacatgaatttctagatacatacactaaatatatacataatgcaccgattttttgcatgtgccctaattttttttatcacatacactgaataaataatacacgtgatttgttgggtatatacctaattatttaaaaatgtgtatataccaaatatacctaatttttttaatgtgtatatccaaatatacatattttgttgggtatatgccttgaatgggtatataccaaatcgatgtttaaatgcgtatatatttaaatgtatatatacctaatcgatgtttaaatgtgtatatacctaatcggtgtttaaatgcgtatatacttaatacgtgtataaatccaaatctgggtatataattattttttccttaaatttgttcctcaaaattaaaaagtgatgggtaatacatacattttaccacatacccaaaaataaatctccaagaatttcttgccatatactctccaagaatttccagctatataccatgtgtcaatcacattccatataaaaaatactgcacaacactctttattttatatggttaattcctatcatatttgttgcctaaaaattggacatgacacgtacatccgtaaggaaattactaatcatagatggcaagtatagctatttatctaaacatgcatgcatatcgttactacccacaataatagggcaattgcatgcggtagtttttaatccatatataactcattccatatttaatgtacaaacgggtgtacccgttaaacccaacacctagagcgatcaaatagatatggatcagatccaacggcagctaggtttggagcctatacaccatgaagtcccatatggctgtcccatatatatatattccaagattgtatatagatactgcattcctatcctcatatctggtgtctagacccctagtcactgccctgggttagagctggtattagagccaattgcttcgtaacctccccaagccatcttctcccaaaggagggggggaaga

SEQ ID NO: 28950 - DNA, 627 bp, Oryza sativa
attgtaatttcggtgcccaaagatttagttatttcaagcactggtggtgtaccagcgaatactcgatccaaagctatcactttatcacaagacgatagttcactctagaatgagcaggaaactgactatatatagattccattacaaagctcagtgcctcagttctgtaatatacaattgattcgtccatccaattacttgggtgaaccatcggaacaactacccgacgttcacctctagtcgtaatctgattcctcggacaattcaccgctttcctgcattgaaaataaggtaagtatgattttttgcatggaaaaattgaatagacacgaaaaaaacacgtgcaatatatatgcagaaaatacacctttttcttgtcaaattcagccaccgccttctcatactctgcacgcttctcgggtgctatatcataatacttcactctttcctggggtaatgaacaaaagtgaaattgttgacataagtatgatatgagtttatgtctaaaatgcaatgcgcaaaaatgtgaaatgaagctggacatatctgatatgagatattgtattggctaaaccatttattttgacaatgaagtaaaatttctacatagtccactgtgtactaaac

SEQ ID NO: 28951 - DNA, 6027 bp, Oryza sativa
ctcaagcttctcgtggggcatatatcccttctgcgctgtactgtaattcggtgcatgcatatgcatagctaactcaaaagctggccaacgtcacgaccaaaatctcgttggttgtaggtgccaactttaaaatggtaccagtgcacaaccgagaggagaaagaagcaggttccatattctatattccttttgtttggatgaaagagaaccgctggtgttaaagaaaaccaaggataaaaagttcgctggcgctttctgtgattctttccaaatcggcacataaatttcttgggccgaactgcatttcatcccgcctcctctcctgcgagttgtgcgtattgttccctgcgtcactgcgtgctcttgaggccgaaaggaacgggatggccaagacggcgccggagcagaaagcagtgacgccggcgacgccggcggcggctgcggcgagcccgttcgagttccatgtgtatgggccacgcaacctgtcgtcgacgacatggagagacctccttcgatcgagctggtaagttactctcgcgcaaaagaaagatacgatttcaagatcaaagaaggctgcttggttaagttcaacgatctttgtgtgtgtgtgtgtgttgtgtgtgtgttgttgggggatcttcttttcaatgagtttttataggtttagatcattttggttgtgctacggtgcttgcggagttagcattgtttgagttatttgtttgatcttcttcaattcctttactgggatatagttcatgtcctcaatgaagaactaggattatttttcaggttgtaaatagtccgatcaacaattttggctttagtcggtttatgtgcctaatacaggactggtggtgaaagttttaaaatcatgttctaaacaagttgagagtatatttaaaaaaccacaactctcttgtcagaactataagtttgctacaaactttagatagatatttcacaaaactacaataacaataaaattgttttattatcaaataaactacaaatttaagtatcacatgtgagcccaacttgcaacaaagcagtaatatatttgtgtctgatgaggggggcctaatcggtcaaacaaaagtttacaattctacgataaaatcattaactattattgtagttctatgaaatggcgcaactaataaatcgataatttgatagcacaatacttgcagtctactccgtttcaaattataagtcgttttaactttagtcaaaatttaactattttaagtctaactaagtttatagacaaatataaaaatatttatagtatcaaattagttttattaaactaataattaaatatattttcataacatatttgtcttgggttgaaaatgttaatttttctataaacttcatcaaatttaaagcagtttgaagtaaaaacgacttgcaatataaaatagagggagcggcgaaatttacttcgaaaaaaaaaaggagtcacacctgcacagttgcgcaaaagcattcccctcttgcagccagctacagcctacagcggcttctcacgttgttggcgttgcgcggcgcatgcaggaagaacgccaactaccggcgaatggtgatcgcgtgcttcatccagggcgtctacctgctggagctcgaccggcaggagaggcgcgacgagcgcaccggcgccctggcgccgcagtggtggcgccccttcaagtacaggctcgcccaggcgctcgtcgacgagcgcgacggctccgtctacggcgccgtgctcgagtgggaccgccaggccgcgctctgcgactacatccccttccgccccgccggcgcgcccgccgccgtcgtggcgctgcggggcacgctcctcagggcgcccacgttccgccgcgacgtcaccgacgacctccggttcctcgcgtgggacagcctcagggctccgtccgcttcgccggcgcgctcgccgcgctgcgcgccgccacgggcaggctcggcgccgggagcgtgtgcgtcggcggccactcgctgggcgccgggttcgcgctgcaggtggggaaggcgctcgccaaggagggcgtcttcgtggagtgccacgtcttcaacccgccgtccgtgtcgctggccatgagcctcaggggtttcgccgagaccgccggcgagctgtgggggcgcgtgcggtcgtggatcccctactacggtggctcctcctcctcctcctcccaggccgcggacgccggcggcggcggcgagagcgaggaggcgaaggcgatgtgcaggtggctgccgcacctgtacatcaacaccaacgactacatctgctgctactacaacgacgcggcggccgggacggcgaccgtggcggccggaggaggaggaggcgggagcgcgagcggcaaggcggtggcggcggctgcggcggtgcgagggaccggcggcggcggcgcgcgcgtggcgaggatgctggtggcgtccaagggcccgaccaagttcttggaggcgcatgggctggagcagtggtgggccgacgacgtcgagctgcaggtggcgctcaaccacagcaagctcatcgaccggcagctcaggtcgctctacgccgccccgccggccgccgcaagctaggccgacgaaattgctctcaaccaatgacgttgattgtactgctttagtacccagattacattctacctggaggatttacttacgagtatctcaaaggtttatagaagagtggttaaaaaaattgcgtaaaaaaaattaagattaggatatctcaaaaacaaataaagcgagtttgattattcacatttcgagcaaacaaaagaaccattataactgaactggaaaaacttaaaatgagagagtgaaaaaaagagagacaaaagaacgactccgctggggatcgaacccagaatctctggttccgtagaccagcgccttatccattgggccacggagtcctggatgcttaatgtgacatactatttttctttagttaaaatgaatgaccaagagaattgtaatttcggtgcccaaagatttagttatttcaagcactggtggtgtaccagcgaatactcgatccaaagctatcactttatcacaagacgatagttcactctagaatgagcaggaaactgactatatatagattccattacaaagctcagtgcctcagttctgtaatatacaattgattcgtccatccaattacttgggtgaaccatcggaacaactacccgacgttcacctctagtcgtaatctgattcctcggacaattcaccgctttcctgcattgaaaataaggtaagtatgattttttgcatggaaaaattgaatagacacgaaaaaaacacgtgcaatatatatgcagaaaatacacctttttcttgtcaaattcagccaccgccttctcatactctgcacgcttctcggttgctatatcataatacttcactctttcctggtgtaatgaacaaaagtgaaattgttgacataagtatgatatgagtttatgtctaaaatgcaatgcgcaaaaatgtgaaatgaagctgtacatatctgatatgagatattgtattgcctagaccatttattttgacaatgagtcagaattcctacatagtccactgtgtactaaactgataatttgaaagcatagtattatttaagaacccaaaagaagagcctgaaaaaacaaaggaaatatatatttaccaatcaaaagttcaaaacaacacaaatagttcacccggccttttctggctttgattgcatgaatggtctttgagtgaacccaaactgctggagccaacaatttctatcttttcctggttcaactggcagtttggtccaaactatgatttctaaaaaggaaaattccaaactacatatctggtatttaaagctctaaggaatccacaggtgatcttgatatgcttcacagcagtagcaccttcttttgttttccctatgggttggtagcatgaaaaaaataggaaacatgggtatttggcagttggcaccaaatcctttgaaatgcgactatactaaacatacatggaatgaacctactgaacaaaagggggaaaaagtaaatatgcaatcatgtaccattatccaactgaacagtagatgtaacacctacaaagtacattcttgggcttctacagttacagtccatgtcaatgtattactttagctgtttgagcgtatcggctacaaagcttctacagttgcaatatatgtcaatccgatccttcagctatttcgttagaattactccctagaggcctagactcaatgatcactttttttgtaggctgtaccagttaattcaaggaagtttagaataaatagattagttatctagttttaacactaggcacataaacagtagacaaaaaagagcagatatggctcaaatatccctttttaaactttgaaattaaaccttactaatacaatacactgaagcaggaacttctgcttgatggtttaaaaaaaaagtgattttgaaacaaaagaataagtcaatatacatctcaactccgcatgtacagatttgtggtgccatcatgtttctatcaatcattttatgtgtttgttgggtttgctaccatgccaaaatgttggcaatgccaaaacataggcaagttttggcacttccagatttttggcaacttttgtgtggtgtaggtaaattttggtagcaaaccaaatggtgccaaattactatacaagaagccaacattttggtagggcaagttttggcttcaaaccaaaacagccatgcgttacaacttacagagaagcatggtttggtacttgagtgatagaaaatttacagcaactagagacctaattgaccacaaacatcactaaggtgaaatcacaaacctcaaatgtcattgtattccatttctcgccacatgccttccctacctgcagggtaagatatattactagatgactaagtagcttaaagcttcaacgttaactgatggaaacttacttcttgcattgattttacacttggattttcttccttgtaagttttccgaaaatcctcccttcagcagaccataacagtttttcagtaaaacttgactgagttgattcagtacaagatatgaaaataagaggcaaaaacaacagagtaacttttgtgttttggttacacctaaatggctaaatttatgtgaaacacctcaaggaagtaagcactatgtttaatgttgatgactggatgcggtataaagcatctagacaattatggtagcatgtaaatgttgccattactctctatcagtagctaaaacacttcgtaaccatcaaaagcatgaccaagtcaaaaacatatgcattcattttatatcagtaaccacacatctttcgatgcaattgtggacaaggagcatcagatatgcctgttcaattaggtaaaggctgtgcccttcgcatatgttgcaggggaagcacacactttggtactcaaaaaaaaagtggtgcatagtttcagttgccaactcccaagataggaccacaaaataacctgcctcactccgtctttaggaaaaacaatcaaattctaataaagaacagggcaatcctatataatatcgcaggataactcaaataggaatctaggatcccagccttccaaaatgagatgtaaacaatgccaatctacataaacttggggtgaaacctgattgcacaagctacaacaatgagtccatccatgactagggaacagatcgaaaaatgcacctcagattgagatgccctgtaaaacctagtaaattcagtccctaacatacccaaccattttcctaattgccacggaccggaggcagtatcgtaaatatttcgcatgcgaacttgctgcaccgtattaccaccaaggcaccactcaattcgaagttggtgagtaaaaaagctcctaaaacaaagttctaatctatgcaaggaaacaattcgattaataaaaagaaaaagaaataagcccccggtaacagcagcaccaatcacctcgtggcaagagccag

SEQ ID NO: 28952 - DNA, 7773 bp, Oryza sativa
atctctcgttgggccggccgtgcggcccagtggagctgggctttcggcccatgcagcctcggccgctgctggtacaagtggcgcggggcgttgtgcgtgctggttttgcgatggattagtaccacctcggtagatggaggagagggaggaggacgtgatgggtataagacgggggtggggggctagctagagaggcatctttgcgcttggggcaatgacgcagctagtgaggtaataccgaggcgcgtcaattgctggttgaaaactatttccaaaccccctctttggcccgtcagggccactgagaatttctggaagggctccttctcttcggggagggtaaagcccaacaaatcttgaatcccaaaatttttatacctcaaaacaattttacgtattttgctcggtagaagctgcaattcggagtctataaccacactaccagagttaagttattaataagttgtttattttttaattaaagtttttttaatccaatttatataaaaaaaataataagatttatgatacttttttcttttgattttatagtattatccacattaatatagatgactttatccaattaatatagatgactttatagcattgttgaaaatatagatgactttatagcattgtcgaaagtgttacattatgaaacagagggagtattaaattagttccattaaattataataaatatattttaataaaattttgtttttattgaaaatgctactatgtttcgctataattttagaaaaaaaaatcaaacaacttataatataaaatggaaggagaacaaatttaaaacttccgttttgaaaaacacacccttaaaccagtttagaaaatgttcttacgaagaaaaacgagaaagtagaataatttcttattattaattaactggaacttttatattttatatttagatcttaaacctaaaataacaatgtatccactgaaacttttatattttagaccctaaaccttacaataaccatgtatctattttagatcttacgtgcaattagtcttttatgtgaccttatctttacatgacccatccgagcctctcctactttatctatttcctctccctcccccaatgtcttcccaccatggccatttttcttcaaagacaccgacgactccaccaccttaatttttttcctctccctcactcctctctctctatattttcgtatagattctattttcttcgaagaggctgacgacttcgccactacaacgctacttcattgcccatctctgcctctctccctctccccatccaccatcatgcaaccctcccttcttcgttgacgtcagtgccgtctcttctcccttctcctccgttgaatcaaatagctcactggatccgaatgtgagcttatcagatctcgccgcgagctcgctggatttgctgtggagagtggtgatgaccatggtggcgagcggcgatgacttgcatgacagtccttggtggcggtgagcggcgatgaccatggcaaatcctcctcgcccgaaatctctttttcaccaagcatatcacagggcttcaaacttgcccaacacgtggccccgagctatgggttcctagctcctgagctgaggcatggtcgaggtaaccatgacctttgcaggttgtgcgtgacatcgtgagaccatgatccccaatgaacttgttttagataaatgattgctgatagaagttattttaagatgatgggagtatattttgtttaatatcccttccttatatatatatatatatatatatatatagagagagagagagagagagttactttgaccaataattagtctgttagatataattttaagtcaaaaaaataatgtattagattaatatttaaaagtacttgcttacaatatgattgtatttttctatcacataaataatattttaatagaaatgattattgatcaaaatattttttatgaaacaaaatacaccttatattttaaaatagagagtactacttttccaatctatgcaaccatattgcttaatactgccttcatccaaaagtctaagacctactccctccgttccaaaaaaaactcaactcccttataggacaacgaatttggatagattctagtcacatccagattcgttgtcctagaaggggtcacatcccttactaggttgagttttttttggatggagggagtatttctttgtcaccaaacttaagaaaaaattaactcattcactatgtgataaaagcaacaaactatacatatgcatttaaccagtaagtaataagatggtttattagattctggtcaacaatttaatttcacatatagagattataaatagatcttagacttacaaaagttttaaaaatataaaatagatcttagattttttatagggcgatagtagttatactgatagtgcttttatttctcatcgtactttccccatgcatctaaccactgctcttagaaccatcaaaataatttcagcttaatcttattttattttgttaaaccccttaaaaatgcttattcttgtgaaggagagagtatttaaccctctacttggttattatgccgttattaaaggtcaactatcttagggtaaaggtttactttagaaaaacggatctagcgtgggtgttgggggaagttggggggactcgagtctcctctaccacgctggatcaccattgagagaaggcgagagaggagaagggaaagggaagaagagggtgagaaagaagagtaggagctggaagagacaggacacatctctattaaaattccagatccgttcctgcacttgcaccacttgatgattgacttaccaatcgagagtcgttgttatatactatgttccatgatgagtggtactatatatgtcattgtcagcaatttattccactgaatgatctgatccctgtcccgcgtaggcgcgtggggtgtcacttacgcggtgcatccagacgcgcgcggtacgcgccccagacgcggcccggcgagtcaaccaaccggtgagcaactgctcttttctcaattgacacagatctgcacactccattccaaaatgattttattttttattatcttatttattctaaaataattttatttttatttattattatattagagtttataaaaaatgcatttaactagagtggaagaaagttacattatgatttgatagaatggagagtattttatttctttatgttggtctaggttggcatgtactccttctctaatttattttttacccatcccacacataccaatataaaacaaaaaaaatacaatacaaatatactttattagattccaatataattatttctcactctaactacttttaatataattattttccactttcacaaactccgatacaataattatatgaaaataaatttattttaggataaacgagaggagccagaaataagcttactatagaacagagagagtatagaatagctataaaataaagttattttaagtcggaggtatcactaattcgatgcgatatctaccgatctttatactccagttacagattctgagattccataactgcgggcgatcagcgcaaaatctaaaaaaagaacaacactaatggtaaaggtctaatttacctaaataataaggattggataacgcgtggtgatgtggtgatgcggtccgtaccccgtggtcgagccttattttacttctataaaatcaaacgactttaaaaaaaatgtggaataatttatgcagtgcaagcaacacctttccaggactgctaaagttattatttataaatttctacttttttctataaaaacaaatctattacataactgttcatatttgtaataatagcaatatcatattccattatatttattgtttatatgatggagggaataactaaaaaaatagtttcaggcttagaaaagttgcgacggcagtgaatggtgcctaaagccatcccaacccaaaaattatcaactactttccatacttgccatgtcatatagacactatgtatagaaattactccttccgtttcaagttataagacgttttgaactgctttaagcttgaccaagattatagaaaaaagtagtaacattttcaactcaagacaaatttattatgaaaatatattcaattattaatttgatgaaactaatttagtattataaatattgttatatttgtcaataacttagtcaaacttgaaacagtttgactttgaccacggttaaaacgtcttgtaacctgaaacggagggagtatatatccaatggatggtgttttcacattaaattcttatccaatcacctctcttttctctcctttcatgcatctatccccttgtttttatttttggtttttgtgtagagatggtttcttacatgagaaatggtgttttatctttttacctctctactcattaactctcttgcatattagatttttgcttctgtgacaatataattaatgatatggacactatacgacatgtagggctggggatggcctaagattagtctgtattgagtggatatcttaaagttttaaaagttcctctttaaagtttagtgcgtgcgcgcctatctgtttcgtctaatcgggaaaaagttactacctccgtcccaaaatataagcatttttaactatgaatctggacaatatttaactatgaatctggacattgtccagattcatagttaaaaatgcttatattttgggacggagggagtatatggttttggcctttttacagttccgtcagtaaatgaatctttttgtccctttcaaataaatgataaatcgggattattaaaggatttgagtcctatagtttttctttccctaaatgagcctttagaagaaagggattgggaactattaaatcccataaaactctaattgaatacctaaatccatagagttctctataagtttttatcttcccgtaaattcctgaatattaattttgtgctctatccaaagttttaaacaatcattattgtactttcttcctgtgtattataatcccacgtttatacttttgttctttctactcctgcattttcttgagcatgcgtttaaaatggggttacggattttggattatagattgttggcttcctaagcgactaaacggtatttaagaaacattttttcggtatttcttagaaactttttccattaacctttaccagtacattttttcctttattcaaacaatcattatcatatttttcaagtgttttgtaatctttttgtctatactcgtgtttctaacttgatgaaactccacgcgttgctttaaaagtttagtatgataatagtagaaacatgtaatatagctagacgtcttaagcttatagaatttgtatatttgatcgatccttgcaaaggccataacaattaagttgatgtggtttatgataatttaaatggtatatagattgataatttaaaagtaaaagtaaggtgatgtaactttataagagaagaaaatgaggaaaataatttgcactatagattaataatcaaaaggctaaaagcaattgagatgatatggtttaatgagagaatatagaaacattaactaaataagaatgaactatatatgggatattgtagaaaatgataaagagatatatgttgaaatattatgtaaattatgtgggatgatgatttaacatacttatatttttaaagttttaacgtataataaagtatagatgatatagtatgcttgtataatgtttaagatgtaacaatttctaatggatgattatatggtatttttgcatgttgagatttaagatgtagtgggttgtaactttatagatagtatagataaaatcttgtgtttttcctacttcaacgttttcttcagcatgcagtttaaaggcggttctgggttaagtattataaactatcacgtgcatgtttcacaagatactaaacggcgtagtttttatttaaagaaatcgttgtcaatatttcttagaaagctttaattcaacgtcctaatatttaatccgtttgtttaatatacccttaaataattatcataaactcattttcatccatcacccgtcatcccacagctaaaaaaccatgccttaagtttgctggaagtcccccaaacaaatgccatgaatagagaggtgaaaactggagagaaactcccaagcaactcccaaagtctcaatctgctcaacggacatgttccaatgattcacttgttcgttattaattgttacattttctttgtttatatatacgcacatgtaaggatgcaggaagacgatcgatcaaggttcacctcggaaaagaaaaaagaacagaaagaaagacgatctagagggagccaaagattgcaagatcgatcgcaaggtaacgtacacgtacaggtgagaggaatcgatgccggccgacgcgcgagctgctccgccgtcgtgcccgttcccgacgatacggtcgcatggcgccgccgtggcgaggtcgcacgcctacgactggctcgcgctgctcctcctcgtcgccgtcgacggcctcctcaacgccatcgagccgttccaccggttcgtcggcgccggcatgatgaccgatctcagataccccatgaagcgcaacaccgtccccatctgggccgtcccggtgcggcgcaattataattatctgcgatttttatgatccgtccctcgattaagtttcctctttaattacgtgatctaatcaggattatctctcgtcctaaatggcgcagatcgtcgctgtcattgggcccatgattgtcttcaccgtcgtctacttcaggaggaggaacgtgtacgatcttcaccatgctgtgctaggtacttaaatcttccaacgttgccctccattccattgcaacatctccttaatttctttgttgtgacgaacattttgatccatcgacgagcaggcattctgttttcggtgctgattaccggcgtgctcaccgacgcgatcaaggatgccgtcggccgcccgaggccgaacttcttctggcgctgcttccccgacggaatcgcggtataacagcaaatctcaacttaattagcccctcaaaacagtcaaacctctctggaatttacgccccaagaacgcctcgcttatcgagcgatacacacatgtgctgtgctgtgctgtgcctgtgcccaggtgttcgataacgtcaccacgggagtcatctgccacggcgacgcgagcgtgatcaaggagggacacaagagcttcccgagcggccacacttcatgtgagtcaagtctatatatctcactcccctcatcacataacaatagatcaagatcagccaactgaatgtctgatcattcttctatctagattgattgagtgaatgatataaacaagaacttactacagtgaaattccaatcactgaattcacggtatatatagtgagtttgtgacactgacagcagaaagccagaaatgatatgttctcgtgctctgtggctgcagggtctttcgccggtctggggttcctgtcgtggtaccttgccgggaagatcacggtgttcgaccggcgcgggcacgtcgccaagctgtgcgtcgtcctcgcgcctctgctcgttgcggcgatggtcgccatctcgagggtggacgactactggcaccattggcaagacgtctgcacgggaggcgtccttggtacgtactccaatatataccactgacactgtacatgcttgatgaagtt

SEQ ID NO: 28953 - DNA, 2278 bp, Oryza sativa
  unsure (1)..(2278): unsure at all n locations
aannnnnnnnnnnnnnnnnnnnnnnnnnnnnnnnnnnnnnnnnnnnnnnnnnnnnnnnntgtgcgtcgtcctcgcgcctctgctcgttgcggctatggtcgccatctcgagggtggacgactactggcaccattggcaagacgtctgcacgggaggcgtcttggtacgtactccactatataccactgacactgtacatgcttgatgaagttgcggttttatcagaatcgatattgtgagctatatatctcgttctctctgctgctaatggtcagtgctcgtctataggattggtggttgcctctgtctgctatcttcagttcttcccggctccttcagatgagaaaggtgtgttctgctttctcccttcgtttctctactttcttgagatggattacacagcataccgaccacggcgtccaacaaaggattaaaatcacggtggtgtaatcggattggttaccagttaccactcttgaaccaccaacggtatacgggggagccgtcaaagaagtttaaatttgaaattgaaatcatattaatggtatatccttagccacaattataataaagaaaaaaagtgcaaattgagaagtaggcaccttcaatagaaaaaccgaaaaggacagtccgctcgtcaccgtaattcaacacaagtcgagttatcgtgactagctgccacatgtggccgtccgcaccatagttcgagagaacatcaaggccaaatctgacttctcaaggcaaccggatctacatgagtctaagttgttagcctgctagatctgtctcagcccaaagggccacaatatttgagctaattctaaatattaaaaaaaaacttcaaagctagtaacttcttaaaggatcaaaaacagctaggtccaaacgggccaaaggtcaccagatccaacagcatcgagcttgagagctgttgcatccgagttcattagatgagaagtggaggaaagtaatggcagatgatatatgctaggaacgacatagtcatcctaaatctggtgacatttagttccgcctagcatgagaggaaggggagaatgtgccgcttaggaaaagtgtcacaaggaggtgtcagggagaggatggggcaaggaataggggctagcagcattggggaagcgaaggtagcatcgatgacagaaatagaaaggggagcatcacccaggagaggggtggagaagaagtgtgacaagtaaggaggatcaggaatctggcaacggcccgaatcaattggaaaagggattaaggacaattcactcatcgccacaattcaactcaagccaagttatagtgaccagttgcccgcactatagttcgagggagcaccaaggctagatctgatttctcaaggcaaccggatccacacaagcctagaccgctagattcgaccatctcaaaccggaggtctgctacatttgagcacattttaagcataaaaaatcaattccaaagctagtaacttcttgaaagaccaaagcagccagatccaaacatgcctgaagtcactagatctagctgcattgagctcgagagccattgcagaagagttcattggatgagaaaaggagtggaggcctaaactggcaggtgatgctaggagcatggtcctaaatttggtggcgtttagttcagcctgagtggaaggggagggggtgctacttaggaaaggtggcacatgaaggtaccagggagaggcctgggcaaggaagaagagcaatagtattgggggagtgaaggcaccggaaatagacagagaaaaaggagcatcaccaggagagaggtggagagagagtgtaactcgggggatcagaaagcaggtaacggccttaatcaagtgaaaaaggggattaaggtttcttggttatatagattttcgtaaaaatgagtagtctgttgacttagatacgacgtatgtctcgtggataattgtattttgatctacttatgaggtggtaatacttttcatatgcttaggcatatgaaaatgtatgcattagccatggaaaaatgtttgaagatttttaattaaaaaccgactactattggaaaataaacaacaagttaccactgataaccggtttttaaattaaaatgttggattcaagcttttatatggcaaccaaattgttattcgctacgtgagagaacgatattattttcttttctaggaataatatattcaaaaccttgcattaactaannnnnnnnnnnnnnnnnnnnnnnnnnnnnnnnnnnnnnnnnnnnnnnnnnnnnnnnnnnn

SEQ ID NO: 28954 - DNA, 4760 bp, Oryza sativa
gctcggtaccccagaaagcaggtaacggccttaatcaagtgaaaaaggggattaaggactcttggttatatagattttcgtaaaaatgagtagtctgttgacttagatacgacgtatgtctcggggataattgtattttgatctacttatgaggtggtaatacttttcatatgcttaggcatatgaaaatgtatgcattagccatggaaaaatgtttgaagatttttaattaaaaaccgactactattggaaaataaacaacaagttaccactgataaccggtttttaaattaaaatgttggattcaagcttttatatggcaaccaaattgttattcgctacgtgagagaacgatattattttcttttctaggaataatatattcaaaaccttgcattaactagtggttgcaccacgccaatggcagggttctggcctcacgcgcactttaggtacatcaccgagaggggaagcgagaacccaacgcagcaagccaccgaaccactggacgccatggaaaccggtaggggaggccaatgaacaaggtgcaagcaagaccaatcttgtgtatataaggccataatgtacagctcctcctcaaggcacgggaggtaatcgtcgttagtttgtaaatactttggcgtgggccaatggtaccgactaacttgactactgacctgacgcaaataggtgttgtttgtacatactgtatgtattttcaacgaagtttgtacatatgtattggttttgcttacttatgtactcctatgtattttaaataattttagtgtctaaaattccgttcttctcccaagaatggcacggggtcagatcaagctctgtgttaaggcctgaactggcccatcctatttgggcttgaattcaagaaatcattgtgaaaagaaataagtctattttgtgtcccacatcttttgcttctaaattctggttgaatcacctctgccatcttctaaaactgttacaaatagacttcttctatgcttcggaaagtggtttttttaacgtggttgagtcgatcagaaacggacggaaattagctttagcatattcgttttcatattatcttttttggaatcgaaaacctggatacagaaataaaatcaaatattatcgaatacagataaggagcgaaaacgaaacggaaagaatatggcaacgaatatttgccggtatataaatatcccctcaaattgagtttccttaatcaaggaagagatatcgcttgttttttatcaacgcctccaacatttatattgtcaattttataggtggtcccacaaccgtatgtgaaaatcgattttcatggctattctcttaagagacccacatgtaaatatgattattcattttttaatcccaagatattttacaatatttatagcttacttaccatatcactaatcaagttcttgttgtataaattggaggtgttatttattttatttcgcatcttcaaaacttatagtgtttgttttatagtttaaaaagtttcaaatataaattttataaactataaagtggtagatcccattaagctctacaactttgatatggaacacatctccatcaaatgtcgtttgaattgcatatctgagattttgtaaaaaaacatatatggtattttataataaatatttagacccttaaataatctcaaataataacattatcaacaagaaagttgtagatctcatcgagctctacaattttgatataaagtttagggataagcccatcttacaccctttaactctttacttcgtctaaaatacaccctcgaactttaaaaccaagcatttaacaccccccaactattaatatcagacaagttacacccctgaacggtttgtaggctggttttggtacggtaggacgtcaccataggatgccatgtgtaaaaaaagcagtgggtctcacatgtcagggttagctttcttttcttctcttctctctccctctcacgggcatagcctcacagaccggtgttaaggagtagagaatcgaagctgctgccatgcgccccgtcttcttcaaccttgggcaagcggcgggctcatcatcgagctcgccatcggccccttcttctattgagctcacccaaggggacatcaccagcgccgcttcatccccttgtagccgtcatcataggcacacgccatagctgcacgtagctcctccgccttccctgtctcacactagcatgccccttcgcggctccgccgcctgtgccgattgcagctccactatcatgcttcgtctcccttagagcaccgcatccgctccctccaccaccaaaatcgagctagagcactgcatccgtcccctcagctgagcttcacgtgccctacagccaccgctccagcgagctgctggcggcgatagatgcagctagcttgggctgctccatcatcgatggagggaaggaggagaggtggcgtgacatgtgggaccctttttttttacacgtggcatattatttaccaaaaccaccctacaaactgccgggggtgtaatgtgtctagtattggtagtttgaggatatgaatacccggttttaaagttcaagggtgtactttagacaaagcatagagttagggggtgtaaaatggacttttccctaaagtttatcttcatctaactctgtatgaaaaaagttatgtatatatacgtgttttttctaaaatttgatccatgtctgcggatatccaaacaaaatttctggatagtttccaatcatttcccttattgtatttgtttttgtttccgactaaaaaaatccgaattcatttccgaatccgagaatttccagataattccgacctatctgaatttgaaaaatggtccggacggacaaaaactatccagtttcaaccctacaagtagatgggacttgcagttgactcgctgagaacatgtccacgcttgaggcaaatgcctataaactaccggcaaattgggaaaaaaaaagaagaaaagaagaaaaattgaacttgcacactcacttgatgaagatacacgagttgttttctgaggcactgcatatcttttgacttaggagtagtaattaattatacttcaccaaatatgcatactgaaatcaattgggccatccaccatcaaggcatcaacattatctctgcagatgcatcagacggcaataaggcatactcctatgtactgctacgtgcgtcccccaatgtccctagtagcggttttcagtcagagcgctcttttcccggcatgtcgcacgctttgctgctctctcattctcctccccacagccactgcagataaggtggtatgttctgctacaaacaggccttgtatggtcgagctagcagcagattaaattctctctcttcttgcaagatcgactagattttcaggtggtttgatgtggactgtagaatggatagaatcttaaaacgtgcttgctttggaggatatttcgtgatgtcgtcaccacacgtcgcaaagacagggacgtcgcttgcagagaccatagtaaaacacatcacctctacagtgatcttatttgtcgataatattttactatcagtattctcttcggtgaaaactatatcaaccattgtttttattataaatatgttactaataattaatgtggtagtataaatagatacgattcattaaattaaaaatacaatcaacctagattaattcttttataagtaaagatcatcataaagcaccacctttcgcatcgatttttaaccttaagcattgtaaaaggtcagttcggataaggtgctagttcctcaagttgagttgcggtacgtagaacccaacaagtcaaaaatatcgtcgttgagaaatgtcatgcgcttttgttgtttactggtactggcgctgccgatcgcgcgatgagccaaaccactaccgtcgctttagaaacatcaaacagcgaaactgatggtagaagacaagcgtgaggacagggaaaggaggataattcatcccaccaaacgtagaaaaagagacgggcagaaattaatggtgtgggcgttggtagttttctcggagggaatcagtagaaaatcagcactaggcttgttttatatatttaccctcggttataatgcccattcacatagttttgaaattttgtactagttctttttttccctttacaaaagactactgcatatattatctatcactccacatagtatgtaagataaatttcgattcgtaggtaacgaaacgaatataacatattcaattgtgaaagtgtctatatatttatcgtctgatttgggtgtatattataaattggtcttcacatgtttgttgagtaattgatgtgtgaaaccataatttatctagttcaatttctcaagttttttttcatcattatctaaattacatatgctccctccatttataaatataatgagtcttagattgtttatagtagagtttaagttgaggtgaaattgctctatccctaaaagttcaattacttgattggaacagatcacgtctagagatgtaaataaagtaatagaagtaatggttggaccgattgtgaaattagtaggtcagcgatgtaatcaaatctcttatatctgtggataaatggaaaagaccaaaatttatggatggccggagtatgtcacaaacaattttgctatatatttgtcgacaaattttcctccaaaaatttgacatatgtaattacagtataatcatagtgtaattacactgtaacttgcatg

SEQ ID NO: 28955 - DNA, 16195 bp, Oryza sativa
  unsure (1)..(16195): unsure at all n locations
nnnnnnnnnnnnnnnnnnnnnnnnnnnnnnnnnnnnnnnnnnnnnnnnnnnnnnnnnnnnnncctcctcctcctcctctccccgccggtggttcactccccccatcgccgccgcctttccaccacactcatcagtcgccgccggcgccaccgccgccgcaatctcggcctcggcgcccatggccgccgccatgggagaggaagaagactcttggaggcggagacgtgcagcgcagggacgggacgagacgaggcgagatgaccggggattggttggacacggagcaatataaaggagacgaacccgtctcgtctcgtctcggctcgaggagatgtgatttggattcgagcctgcttggcgccgaaggctcgcgccagccaaccgcgagtttatgcttactacttacaactcaccgtcagctgtcagggtcgttgccggtttgatctgcaactgcaaaccgccataaatccgtgtaaacaaatgaaaagcacggagtactttattagagttcgtgttaagataaatctccaagattaatctaatcgcacgagctgtacaggttctagaagcatattggtattggcattgggcagcaatcgatcgatcggttgctggactctgtttctgttcggctggagcccggctggccgtgacagcagagcgtatatacgtgcaggcctgcattactacatacaacgctaccctgcaactttaggttctgtctctctaatccttctcgctgtatcataattcggtgcaattttgaatacgtcccggccggctttgttgggtccttctcttcggatggaacggtttggtcaaaatagacaaaggctgcgttaatttgggtgataggaagtgagaatgcacatcgtttttcgcgcgcacgcttcctaaactactaaacgatgtgtcttttgtaaaaattttctatataaaagttgctttaaaaatcatattaatctatttttaaaatttaaaatagttaatacttaattaatcatgagttaatggctcacatcgttttgcgtatcttcctaatctactcaatccccttcttctcagacacaccctttaagtggtttggtttggtagcctcgagccgcgccgatgataaccgctagtcaaaggctcaaagacaaattgggagcagttgcccctgaaattgtcagttacttccaaattcaaatgatttagtactatgagttcttttcttcacataattttcaaaaactggcgccccagacaaggccaaacggattaagacaaaataatacagtcacgcagtttcagcataaaagccagagacatgactacatgagaatcagaattagaggtgtatgacagccatcgacccattcggcgcgcgtaccaaactctcatctggccgcactagaagcacacaacagctgcacgcacgtctcgctatcagtcgctggactggccatttcccctccgttgataagggatgcattgctcccgctagctgtctcggcctctagaattcctgcagacacgacgatactgcccatgcgatgcgatgcaatatgtacatctgttgccacggccgctactgccgatcgttattcgttgttagcgactactaatgcttgagcagctggagcaaatgactcggtacgtaagtgcaggtgatacagctgaacgtgacagtgactggtgcgagtgcgatcggtctcttagacagttgggttaggcagattggcgtaaggggttgttccatctgggtggtggtactatgttatggatgtcaaatctttctgcgtctagggttgatgatcaggcgactcgtgtctgtatctatggtgcgtcacaactcacaacgcacatctacagtagaaaccgctcaatgacagcgatcgagttcattctaaatggcactgcaatagcctggcttaaattctaagctcccttgaaacgtattgaaatattaattacataatatttttcactataattaagtttaatttgtaaaatttctattaaaaaaaggagcacctactgtattggatttcgtgcaccagttagtttgaagatatgattagttaattactaagtactagaggagtagaacacatgtttgtatttttgtggtgataccgaataaaccacagtgcacaaaatcaagtcatgaaacagagcatgacagctgaaagcatacaactgaagcatataggggtgaaaacggatcgaaaacggacggaaactagttttatcatattcgttttcatattttttttcggaatcgaaaactcggatacgaaaatgaaatcgaatattatcgaatacagatacggagcgaatacgagacggaactaatacggtagcgaatatttaccggtatataaaaaacccctcaaattgagttttttgataaaggaagagatatcgcttattattttagttcaacatctccaatatttatattgtcaattttgtagacggtccaaatcgattttcatggttgttcctctaagagatccatatgcaaatatgattattattttctattcccaagaccttttactagatgtataacttacttaccattgtgtaaattggagatgttatttattttacttcacatcttcgaaacttgtaatgtttgtattatactttaaatgctttcaaatacaaatgttataaactacaaagtggtagatcccgttgagctctacaatttttttatggaacacatctccatcaaatgtcgtttgaattgtagatctgagattttgtaaaaattaatatggtatattataatgaatatttaaacccttaaatgacctcaaataataaaatagtcaataataaagttgtagatctcatcgagctctacaatgttgttataaagtttgtcttcatctgattccgtatgaaaaagttatgcatatatacgtgttttttttctaaaatttgctcaatgtctgcggatatccgaaaaaaattccggatagtttccgaccgttttccgattccgacggatagtaaccttactgtattcattttcgtttccaagaaaaaaatatccgaattcgttttcgaatccgagaatttccgaataattccgaccgtaactatccaaatctaaaaaatggtccggacggacggaaactatccgaaccagtttcatccctagaagcacatgtgaaaggtggagccctaaaatcccttcatatatagtactcctttcgtgctgttgtactactgtattacttctaagctggcgtctcttgattgcatttccaaccgaactcctgttaaatccatttcatatgctggcggctggtgagagacgtcaagttttctgaaacatgtccggtgtatacatgtcaatgatcggtaaaaagacgcaacaagatagcacctcttgtgttttttcgtaatttattgaaccgtttaatcttgttattgcttatttcacatttcgaaatttccatgccgaggagaggagaagaggcgtggagcgtgaggagaccgttagccgatagctgcagcagccggaaagcaacagcaaggtcggaaccaaaaattttcagaccaatgcgcgagaccaatgaatgcaagttgccatttcatttttttttctctggaaaccaaatctcaagtttctgtcacaaaaggaaaaaacagtttgaacgctagactcgaatcttgggcgaagaagtcgtgaaaattcggaatctccgaccaaccgggtcaaaccagacgtgctcttaacgttcgtttcgtccctcctttgctgctactcctggctagaaacatgccagctgctggtattggaaaccttcaacgcagatgagcatcgaatcagttgagctagtaagcacaacagctgctgcttccttcaggcttcagtgcaataatctcgagtgggactacatgtctctgaatgaatgtcggtggccggtgaagggaattctaaccgctggctgaacgacggagtcgaggagattcgtggccgtgtcatcgatctcaccggcgaacgcattgcaaccaagcgaaaccaacgggcagaatgcagtgggcagctgtgcacacgcatcaatctgaacagcaaaagcatgcaatccggccaatctgtcgaatatatgccctgcctgccttacagatcgataacacgtacgcacgatggtttcgatgattcctctgcaggagatctaagatgatatgatactggtattacctactttgttcgtcccgtctctttctaagatattgttattctccccgcaaaaataataataataagatattgttattctctcgccttggaggacgatttggatgctaattcctcccccattttccgttctcgtttccttgatgggccagctgatatgggcttgttatgttcagttcaatagaattagttgtccagcccactagtacagataggcagtagaattttagcccatcgccccatccagcaagcatctgcggcctggtcctataccctttctttcacttttgtccacgatctaggaacaaagaaggtaggatatggaaccaaagaagaatatcctttttaaaaatgcagaatggctataattttccgcgaacccataaaacaattgcacatcaatatattagaagaagagagcggattttagttacacaacgtaaacggtgagaaggccgttatgcaatggttatatgccatcgaaagtttaccttttttattttatagcaccgaaatataccggttcattaatagtagcacctaaagttcaccctattctcatttttaacacttcatatcgtgtgtgtagttaggtcaataacgatcaaggcggacggaaaacgatcaagaattgacggaagtattaaaaataggaattgggtgaactttaagtgctattaaaatgaaccggtatctttcggtgctataaaatcaaaaacataaactttcaatgttatataaccaaattttcctattattatctttgtgtattgaatgaaaaaattatttagcagtttattggaccactgtttcccccccttttttttcaactcatgttttatgtgattaagcagtgggaaatagccattgcgcgtttccattttgacatctaccgttcaactttcaagaacaccacctttctgcatatgagccacgaattgaagcattagtaggttctggaaaaaaatatataaaaagatacgactactccttgagagccagtacaacagcatactacaagtcagctgtaaatacatatggagaaaaaaatagaagatagagaagaaaagcgggctacagatttatagccagctgcagcacggactccaatatatacattatgtgtgtgtgagaggtgggaccatatattaatgttgtagtatatatttataggtaactattgtattaatgaactattagattgtatatagatgtattagagctaatagtacattaaacttgctctgggtagtaacacaaaacacaaaagagcaacactgattaaacaaaacggagaaagtacgacgcaaacaccgattagtaataaatatatacaagagcatttgacttcactctcgcttcgatcaccatacccaatcccgttgcccataaccaccatcacaaaagtagagtaaacaacagaaactcccgaagcctcaccctcaccctcacccaacgacgcaaaccgtgaaatacgtgccgatctgacgcttcgaggagatattctccatgcatgccagacaccgacgaatgcagaactcagatgatggaagcgaacaaaatgatgaaggcgagaccacaaatcacgcgtagggcaccaactcagaggcggcacatgaagacgcagacacactcacacacatctttcctccaactcgctctttttgtaatcttcctggtgcaacttgaccatccagtcacaggaagaagtacttcctccggtacaaaatattataatttgaaacttatttgaactacctctatttatactatttgttattttacgatggatcaaattttatcttaggttgtgtttagttcagcacaaagtttagattttggttaaaattaaagataatatgactgaaaaattatatgtgtatgacatattgatgtgatgaaaaagtactgaagtttctaaactttgtatctaaacacagccttagattgtaatatttgtcgaccgagaaaatagtattactaccaagaatactgatcgtactgctgctccatccatcaatcccctggccaaagaatccaatatcccgaaagctgaactaaagcgttgacgacaccacaccgtcgtcgttgtccccctcccctctgcatcgtcgtggttggcccgcaggccgcagcacatgcacccacgctgcgcacgctggctggagacgcgttttcgcctaggtttcaaccccacgaatggatggacgagccccactgccgcttggtgaggcagccgctgcgtccttcgtgcatgtgaaacggaggtttgggcgtgagctcccccggcttgaccggcggcggcggcggcggttgctgagaccgacactgttgggttgggttggttggtttgttggtgcggaacaggtgggatcgctgtggttttttcacgtagtgccgagcccgaaccccgtcgtgccggcaacatactactactatgtgcagcccctgcttttgacccaagtgacccaactacggtttaattaccaggagacaccgatataaaagatgcaggttatgtgcccccatattcctttttttccgaacacaggtgtattgagaccatatggaccgagattacagtgttgcgacgcacatggagagacattcctaaatggaaacagttttgagtgacacataaatattaggatatcccaggatcttgtagtaccacagaatcaacagggtttgagaaagggaaataaacattgcaaaaaaagaaacgtttcagagatctctcgtccccaacagcgaaaaacattgatctctcactttcacgctctcattttttttcctgagctaagcacacaggtaatcattgggggaggaccccgcagtggagaagtgtgaacagggttgcgtgataacttttgtgggaagattctctctgcgaccccagaaaaagagaagggaataaaaatacatggtgcttttttacgtgtaaaatatttatcctcctcgatgcacccagcagatcaggaaggcgagtcaaaggggcccctcaacaaaccttattttggaataaacaccacgctcctgccacgcttatactaatactcttcacggtcagtgcttagtccactaccctttacgatctttgacaaatgttcctacttaattttcagtttttcacatgtattagtgcaaaacgaaaattataggggcaattacaaatttaccgttgctttgaattgttattacaagactaccactaaagaattattaaaataccactaaaattgtcattcgagagacatccttataaaattgaaaaaactggtggcagatttgcaaataccctaaaattatactgctgattgaatgcatgcatgcacaactcaatatgacggacacgtcatgaacagtgaattcagtgtctatacatgccatagtacacagtttggccgctagctggatggtctagagaaaggcagagtaataataaactttactgaaatgcttgtcgatcactgcatatcgccactgaagtgtgctctttttgcacccatgaatgttagtataacatcatctcacgtgaattgacttggagcgaaaacattcagcatggcactgggnnnnnnnnnnnnnnnnnnnnnnnnnnnnacgcattatcacctcaaactagatgagatccaaacaagatcttgactgagaaaagccaggggctttgcagtaggacagggcagtggcccagcagttcttccaactcccaactcagatcgatcactttctggacaaaaagagagagagatagcatgcaggcctcagagtagaaaagctaggttttgatggaccaaagatcactttcagatcgataatcatgcatgttttctcggtgggggcaaaagactgtgggggcttgaaaatgggagttgtaacagccaatcagactccaccacttgcatacacacatgcatgcatggttggatatatttatactcctttggacaagggataggcagttcagggtcaggtttacgaccgagtcaaattggtggatcgatccagtcggaaaagcgaaaggcatgcacggtgaaaccgagacattttgacggtttggcatttgggtccttttgacgacgtacggagtatatcacaagtggtcgctggaaaaatggcgatgtgcatgtgccacagcgttgttgtcgttgaatactgtagtttttctcgcacggcacatgtggcagaggctggaaattaagtatattgtaagcctctcctagaatatggaatggactcgaggtgataatatataatttagcaacatattgagatgttttgtttgcatatgtagagagaggctacaagtttagcctctagcacagagatatacaaatgcctggcttgaagcaataaccctgcaccgtttcgcctctggatatgtccttatccattcgggcaaactaagtagtagtagtataatgtatattaatgtataaaagagtaatgtatttatacaggcagagagataagcataaaaatactgtttacagttgaaacaacgtacgtatgcatggcatcatgctcatggcagggcaggaggtcagtggtccaagagttggccagtttgacccggttaggtctgtctaaccacatcaagtcaagcccatatgcaataaactattcccctcttgttgattgtttcatgccgtgcaagcatcaagtaatataaagttcctatctatactagactagtgctacttggtaaagctaagcttccagagagcccaattgtatgcatgcctcccacaaccgaaacaatcgagaagagaagaagaatcaccgtaccgggtcaattaactaatcaacggggaacacacattggcgtaggattgaagctaggtgattatgccgcgcgtgacgaacagtagcgaaattttatccaagttgctagttgatctaaacatgatacacatacgcaccactttgacactttctcgtcgtcgcatttaattagcgccgaataagtacaaaggttggagttgattgcggaggcttaatccgctcaccccgagtgatcgaatcggcacgcaccggctggctatcttagctacgtactccactagctggtgaatggtgatacgtactactacgttggccaaacctatatatagctatcttagctagccgcttgcggtcgtcactacaccaccgtggctcgtcattcgttcgtggccccggtggtaaacatgtgttgcgtgcgcgtacatctctcttcacatgtgatgggggaatgaaaagaaaaggcatggaaatggtaggggcagtttgaacccaaattaaacggccggtctctgtggctggctagtcattccgatggagcctaacgtgagtaggcacaaacttaagtacaccaactgtcgcctagaatccgtttttacacgcatgcgtttggctatctgctccgtatctacgatgatgcggccactaagagcacccgcaatggtaaagtaaggtgttatctataaaacatgtactcccttcatcccaaaaaaaaaaagacagaccctggttccagtgtccaacgtttgaccgtccgtcttatttaaaaaaattatgaaaaaaaattaaaaaaataagtcacgcataaagtattaatcatgttttatcatctaacaacaataaaaatactaattataaaaaaaattcatataagacgggcggtcaaatgttggcacggaaatctagggtttgtcttttttttggaacggagagagtacatctcagcaatagactagattaatagtaaactacctcaatagtatgtctacatgggtatctatagctctctaatccattgcctcatttttctctatagactatcttcaagttagtagatagctttgctctctctcttcatttaatctcttccaagtagaaaaatatgctgacatggattttttagagagtctatagataaccattgcggatgccttcatagcctagtccttgtactagtagctacaactactcgtgtgatttcatcggctaggcgtggtaactctagtactactactctaggggtacggttcggcagatgtcacgttcatcgatggatatcggtgcgccgctagctggctagccgtgcaagactgttccggtgtggcggatttaccggtgcgcgcgcccgacgggccaggacgactcaatagatcgaatcgaccgatcgatccccccttatctactgcttgcatcaccgtgccatgccacacacccgtgcgcacgccgtacacatcacggccagcgccgatcgagaactcgctggcatgaggcgagcgctagctgcgcgcgcgcgcgatcgcggtcggcgtacgtccgtccgggcggggggagagagggagacagccggatcgcgacgtggatcgggctcgcgcgagaggggaggacgtgcatgcggtgtagcgggcgccgggcgggcggctcgatctgctgtgtcgcgcgcgggtgtgacgccgatcgatccggccgtcggtgtcgcggccgtggaacgcagccgcgcgatcgagctctcgtaccgtaacgtacgcgcaccggccgcgtcacggtcaaccttatcatgctggagcctgacaaagcgtacgtacgcttagataactgcgggaaagggaatggttgtatgtatcgatcgtgtggggtcgcggggtcgtggctctggcaaatacatacgtactactcgtgtagctataacacctgtgaacctgtcttccccggtggcgtacgtgctacacgtctccgtggctacttggttctctcctggatattttaagtctaccacgctctgctaataaatacatccgtcatacatgtagtacgtacggtttgttataagtagcttgtgactaagacttggaaaagtccctataagctaattaaagaacatactgtgtcatcaaaagatcgaccttagctaaagccgctagctaatactcctacttgtaactggagaaacctcatgtattgatgcgagattttagtatgatatcaaaaggtaaaaataatgtctaagatagctacaaaacgtacataaacttacataatttgatatggcttataataatgtactagcaaaatgcccatgcttcgctacggtgtattaaaattaaaaatatttgtttttaaccaaatttatttcaaagtgatttggtaattttgcttgctagaaatagtctcaaatgatagaaagaaatatagtaactcataataaattattatacaatagtgcgttgcaacgggaaaaactaatgttattaacttagtaaagtaatagaaaaatgagcatccacgttttctcttatgatctagaaattctcatattaattgattaaaatataaaaataagcagaactcattgtagataaggactctttcatttttctaaaaaaaatcacgttgtccaatcggattatctgcataaaacaaatcttttgccaaaaaacctaaactggatagattataaagtataaattataaaataaataatattggatgagaagtctagaatattctccaaaagagcctggagtacatataggaatacaattgagaaaaagaattaaaattcaaaataaaaaaatattgaaagaagagtttagagtccatatagaaaactaattagaacaataaaaaaaataggaatattggaagaagaatatagtccatatagaattaaaaaaattaatattatttaactttagtataaatttaaaatctatatcatgacaaataaataattatatttttagtaaaaaataaatccatatcatgagaaaaatctagacaaattttttgagaaaacattgattttagtcgcgacccatttggaggcccaatagtccggcggcccgatgcgggagaagccagagccatccgatcaaatggacggtccggagccctaaacacgagcagctgcggcggcgcccttcttccctccccgcgagcggtggcggcgacggagccgccggcttcctcctccccgtctcgcctccctcgccggcgaccactccctccgccttgtctcgcctccctcgccccctcctcctctccctctcgcctctctcccgcagtggatatagcagtggtggtggtggcggtaggggcggctccatctttccctctagcctccctttcaaggcagattcgccagcggtggtggcagcggcggccgcggccacgggcagatctagtggcggcggctccctccgccctctctcgccttcctcccgcggctgatccggcggcgtccgctggtggatctgtcagcagtggcggtgaccacatccaccaccacggcccctcctcctcgcgagagctcgtcggggcctgtcctctcctactcccctggccggtgccaccactctcgtccgacggcaagctcgatggcggcggtgcggatctgggtgagagttcatcgggggctctcctctccttctccctggccaacaccccagttgaagatgacaacaattttcccctccaccggatcgagtgtatatgtgattttctccttctccgactcgatttctctttttttttctccttggattcaatcggtcttataccataaagttgtctcttaagacccgattttttcacatgattgggtttaggaggaaatttgggttagatttgatacgaactctggatgatatttgtcgtgattgggtttttaatcgatctttgattttgtgatttgcccgtatcgatctctgatttttcttttttttttttgctttgactggcatacgcgatgaacgcagtgcgcatgcggggacagaaggtgctgcttagtcggattacggacaaaaatttattgggtgacgattggattttttagggacttttagatcttggatctaatgtgttcatgcttccgattcggttggcttcttgagtggaaacgaacattgagatggacaaaggatttgcaggggtgaagggcaacagaggggaggcttgcctggtaacggacaaaagcgggctgagatggacgaaggcgtaatgtgatgacaggaaaaatccaaatatttgtattaagttatagaaatagtatataggatgatagattatccaaatgtaaaagtaagatgatgatgtggttttatgatagaagaaaatgagaggtattttgatccatagattaatcatacaagggctaaaaaaatttgaagtgatatggcttaatgagagaagataatttggatcacaaattaatcacctaagggctaaaaacaattgtgatatggcttaatgaggtaagaaaaaaataacattagctaagtgaggatggactatataggtatataggatattataaaaacgatggagatacatattaaaatattctgtgaattttgtgtgataatatgacttaatatgcttgtattttaaagctctaaaattcaagaaattatagataatatagcatgtttaagatgtaaaatttattagtggacgatgatgtggtagttttgcatgttaaactttagaatttagtggattataactttataataaaataggattgatactaatctatctatctatctatctactattatattattattaaaatagtcttcaaagaatgcatcatattcgccctgaaagctacaaattctcacattaataaaaaataaaaaaaaatttaagtaggtatacaatctagaaataactaaaattcaaaatttaaaataagaaatatttaaaaagagctcatataaaacacactacaatattaattatattttaaatgaaaaataaaataaattacgaaattacaaaaggaaaaaaaagtcaaagtaagagtaatgaattcagaattaaaaataagaaatattacaatatcagccgatatagaagacaatgcgagattaactaaaatttttttaaaaaataaaataaacacaaaatagagagagacagagagagagtaaaagatagagttaagtgggaacaaaaatttaaaaataacataaattcggaagaaaacataagaaatactgaacaaaggtcaatctagaatacaatacaagattaattaaaagagtaaatttcacaaaacctgaggttttggggtatccgttacataaaaccctagttattgtgatttgtttcataaaacctcacattttgagtcaaaatgtttcgagaacatattcatgtaaaatactcatattttattattacaaaatattattttttacatcaattcacattagttggctaaaaggacatattcttctcgtctactttttttttctcaattttgcgctgaaaaagcttaacaaaatacctgctgattataatataataataggttaaatatagacataaatgaacaaaacatgattatcaacgcttgttaaaagcaactaacattatatatgtactaaaaagtatctcatacattctttttacaattattatagataaatatattagtcaaataaacgatgtaagtttgtacctggggttttatcaaacattttactctaaaacctggggtttcattatgttacagaagccccaaaacacggggttttgtgaaatttactcttaattaaaataaaaaaatctaaattataaaaataaaaataaaagttcaagtcgaataaaatatagaaataaccaaaatttgaaataaaaataaggaatattgaaagaggagctcatttcgaacacaagacaggattgattaaaattcggaatagaaaaatattattatgtcagactcagcgaggcccaccgtatatcaagtcttatgcataattaagcctcatgcatagaatgtgttccggctaagaaagaagaaacataatcctacttggtcactataatgactactcaaatcatattcatatatgtctctctagtcctacttagacaaggagacacccgagagtataaatacaagaccctctacaaggagggggacgtgtgaagacacgccgatacatatatagacaggacaagcccagacaaggcatatatgatccataggcgccacagaggccggtgaagtgggatctagggcaaattccaatctcgctgagctcctgttcgaggaagctgacaacagctatccatcgaccacctactcgagcttcatgtcatcaggctgacagagattagattaggttaccctcaatattgtactggtgagatattgatatacaaaggtaacaccgacttctgccaacagtatcagtatgctatatctgttagttatgggggtgaatcagtataaaaatccatgtatcaagtctcttttaccgcaatcttgtatataccctggcaccaacgtttcccatactctataaataccgtagacgtatatagaccctcgacacaagtatttttgagggagcaaacaataatcaagatagtgacctttttaattagtttatagagtaaaaattcgatcggtccttgaattggaccaaatgtcacttagatatgtaatcttgtaaattgctcatctagtttcctaatctaggtttaatatattacagttggtataaatcgcttttaactaggcacgactacatatgcggttgtccacggtggctgaaactttacatttatgctctcctgtagaaaccatcacaacgaatttgcttatagtccctcccccatatagtagttgtcattggggatataagtgggacgagcaagcatgtttttttctcgcttatccccattctagttaatttttctttcatactttgtccggagtactaccatattagaaattaactattgagcaggcttttatgtgggtagcgggattgtccacttgcatcttactgataatttatactttgtgagatacacttaattagttttggggatagatagtatatggatgtaaactaacaaaaacgagtggtcttacttcgactgcttagtcttttttttttggcgcactcatccattaaagaaggatgaaagagatggctatgtgacgtagttgcaactctagaatgctccgatgtg

SEQ ID NO: 28956 - DNA, 5051 bp, Oryza sativa
  unsure (1)..(5051): unsure at all n locations
nnnnnnnnnnnnnnnnnnnnnnnnnnnnnnnnnnnnnnnnnnnnnnnnnnnnnnnnagatatatcccccacgtcatgtcatactgtcatctattctgtagatgccgtggcgactataattaagagcaagttaaatagtatagccaactatgagctccaattcatctatagttaatctaatagcttattcatacaatagttacatactacattattaatacctggtcccatctgtcattcacacactatgtcttatagtccgtgctacagctggctacaaatctatagcccgttatccttctctctcctcatttatcttcttaaaatatatttgcagctggcttatagcctactattatgcctgctctgagcacctctatttatttagtccaaagtgttgatacagtagtacagtagatctcaactcccttccgtaccgaacaaggactttttttttggtttggacttaatatatttcgccctttaattcctaaggtggagtagatgctacacgcatagatatttctgattctagttatagtaaacatttgttcggtcaataaaacatccatttattttctacagaaaaactagtacgtagtgactgatgtctacgtacgtgatgtaattaaattaccggcgttagcgtggcccgatcgatcgatcgatcgatcgatcaataatgcgcgacgcgacacgatgagtttacgcgagaccagcgaccgatcgatcgatggatggagcgagcgcgtgcggggtgttacaccgaaattaaacatggcaagatcgagcgagaagtacgagtcgcgagcgagttaggaaggggtacgtcgcggttggaccccgaccagggaccgaccagcggcaggacgtcgccgtcccccggctggaccggcctttccgagacaaaaagcaggtgcgcacccaccaaaacctcccacgcacatctgccgcgcacgctaccccctctctctcgccttaaatgcttcccccgcccccgcccagccccgcgccggccgccgtccgtccgcccgcgcgcgggacacgtccctactccctaacccagatccccgattcggcacgcacgtagtacactcgtgagtcgtcgtgaccccaagccgcatgcttcccgatcgatcgatccaacacgcgcgcggctgcggattcacgtacacatcgcgcgccgcgcgcgcgcgcgccaccgcggtttcagacgcccgcgcacacgccgcgcgcggttacagcgtttcgttcgttgatacgagtagtttattgtgagaggttgtggttagctagctcgaggcgcggacgcggtgttatgggcgttgccgtgcactggcggagggcgggcgattcgcttcacatggggggcgagccgcgcgcgcgcgcggaggcggcctgggcggctgcgttgcctgccgcgttggttgcgctggtgcgcgacacggctacatacacacggtaggggtgcaccgccaccgccacggccactgtgcccgcgggtgctttttcttgaggctggcaccggtgcacgagttgtgtgtgatgacgtgttcgattggatatacattatattcacacacctcaggccgggctggctttgacctgctcagaaatccgtgacgaaagcgggcataactatccttgtacccacgcagagctcacctattttgacaaatagcagagatcagtttccttgtacggactcgctcactgttcgtgcttcgtttcgttgtttttttaggggtgtttgtggagcgggagctggacacacagcgctactacgctacgacccctcgctgaacattaaatagaatttcagggttttctccacgcgaaatccctgtcccaaaacagtggtagcacgtaccaccatgcacttcaaacacaacagcaaaaatggcctttgggcttggggtggtatgcgtatgatgcacttttgcatgattgcccacccgagctctaaatttttttgctgagagcgaggaatagtagcagaccaaacggtcttaggtctcctgtcattgtgatccctttgcatgattagatttcctgtactttctcctcctgttgcagggaaaaggaaaacgatgaagagactggagaggggaagaagaagaagagaacaccacctcccgtttcccgatgccccccctgacgcgcagaatgatgcaccgtctccgaatggaaacgccacggggccccacctgccagcttgacccctgctgctgctgctgcactgcacatgttattccccctccgcctccggtgtcacgcacgcacgcgacgcgacgcgatgccgaggcgtccgtaccaccaccgccagcatcagcggccgtcagctcgagatcggacggcacgggacagatggcagcaggcgtcacgctggcgtgtgccgcccccccgccgctaagggccccacgtgccagcgatggaggcaggcgccgtggggtggtcaaagggggcgcggggacggacacgtgtcggtcgccgcaacgtctgaatgttcgaccggtgcgcggcggtttgacccacgtgaccggctaccgccggtgcacgccgctgactcagcgcacccgtgaccgtggaccgtgttcccacacacacacccccaccgtttactgtagcggttgcaattatcagtacggccacctacaggggctaatcactgttctgacagtctcgccgagatctaagcaagggattattttgagattagaagaaggaagaaaaaccaaacaagctaagccaaggagtgggcgtctcatttggggcataaataatcaacttgttcctctcaaaaaaagctgaaatcaatttaatcgaaaagcaaaccaaaagtgtgagagaaaaaaaaatcctctcacccaaccatcctatcctccatccctctatctatctatatccatctctctcccttgcctcatcaccctagttatagctaagctaatagcctctcacacctctcgctctctcactacccctccactaccatactagtagcatccataaatcccttggctcttgcacgcttgcttcctcctctgtccatctccatctcgatcctggaagcgcgagagagagagggtgcgtgcgtgcgtgcgtgctagagccaagaaccacgagcacggccagcgtcggcgagaggcggcggtggatccggctatgtcgggcgagtaccagttccaggacgagctggcgccgctgttcgcgcggccggggggcggcgcgggggagatgcagatgctgccgtcgtcgtggttcgccgactacctgcaggcggggacgccgatgcagatggactacgacctgatgtgcgcgcgctggagctgccggtcggggaggacgtcaagagggaggtcggggtggtggacgtcgtcgcggccggcggcggcggggcgccgccgctgacgccgaacacgacgtcgtcgatgtcgacgtcgtcgagcgagggggttggtggaggaggtggaggcggcgccggcgccggcgccggggaggaggagtcgccggcaaggtgcaagaaggaggaggatgagaacaaagaggaaggcaagggagaagaagatgaaggacacaagaacaagaaagggtgagttaggtcacttcaccattaaattctctcctttttttctccttttttcccttgaaatcttgggtcattttgccaagttcttgatcttagttgctaataattcattaggatgagatcatttagagcttcttttttttgctgatccggtatcaagatttggggccggttttctgtgggctagattttgcttccttgctttgcttggtggtcattctttctttcttccattcattcattcattcattcattcttctattcctcctctttttgttcttttattcctttttaaggtagtttggcaaacgtgtgaacatatctagggtttcacactcagcttgcatgcctcacacactttcttccaaaaaatttaaaaccttgccataatgttttattaaaataagtcgtttaatgtatcagctagcccctctgatctttgttttgcttttcttgattacctgcctgctactgctagttccttcattcttcacaccttcttccaagttccaacatgaccaaagatctttgtaacttttgtctttgatccccttttaccaaagattatgcccaaaaagggtagataggaataaaagaaaagcaaagtagattgatccctagacaataagcatgccagtgttatccaccaccccattctgctacttggatcttgccagcagcttccttttcagtgcaatctccagctaccaacagtagaatccagtgtgagccgaaaaggggacgccatcacgagaaagctaggccagtgccactgtgccagacagggtgtgaaccccctaaccttgtgtacacacacgctcgcgtagtcgcgtgtgtctatccagtttgaacgggatcgatcccggccgtggccgtcgcttgccggacgacatacgaaattccgccgcttttgacgcggagaaacgtaccgatcgatcgcgagctgattggtaatatggtatggattggatgggtgcaggtcggcggcgaagggagggaaggcggggaagggggagaagcgggcgaggcagccgcggttcgcgttcatgaccaagagcgaggtcgaccacctcgaggacggctaccggtggcgcaagtacggccagaaggccgtcaagaacagcccatacccaggtacgtatgtacagttacacacacgtatagtacgtgactcgtagctgtgcgcgtgtacgtgtaccggccgcagtagttgcaccgcacgcgcgcgcgcgcggcagaatgcgatgattgcaatgatctgatatatacggggttgatttttttgcaggagctactacaggtgcacgacgcagaagtgcccggtgaagaagcgggtggagcggtcgtaccaggacccggcggggtgatcaccacgtacgagggcaagcacacgcaccccatcccggccacgctccgcggcagcacgcacctgctcgccgcgcacgcgcaggcggccgcggcgg

SEQ ID NO: 28957 - DNA, 4873 bp, Oryza sativa
gcgcgccgccgccgcccaccacggcatgactacgatgggcggcgccgcggcgacgacgacgacgagccatggccttaacagtgcaatcagcggcgaagacggcgtctcgagcgagacgacgagcgcggtcaccgtcgccgcctcggctcagccgtcgtcaccggcggcgctccagatgcagcacttcatggcgcaagacttgggcctcctgcaggacatgctgctgccgtccttcatccacggcaccaaccagccttgacgcgacgaccaccatcaatctgaagctgaattaatcatcagactagctagacaagaggtcatttggctctcgatcgatcatgctgtttaattaattaacatctcgttacatctttttccccccaaatgatcaccttctgtttcgtttcttgattttgtttttttctttcgtgctgcgagatggtacagggttttctactgggtctcgtatcatttctatgctcttactagctagctctacctagctctagtactaagcacttcttgtacatgtaagcgcctaattaattcccaggctccagcattgcaccctgcaggttgcaggactgaccatacgagccatgataattttatgcaaactttacattgatcttctcctatatagctccattaatggaagagtacgagtacttcatatatatgcacatatgtttaattggcatgttgttaattaactctagctagctagaccaatcgagctaaggtttcttgcagggtggtcaatcatgaatgaattgaattttgaatggcgttgattagtttctctgatactggctttcgcttgtcatgacgggatgatgattaattgggggttcgttgtttcgtttggttggtaggaagagttgttaaggaagaaaagtagcgagggttgttttgctgcttgtttctttgcgagtactggtcaggtcgttccaaggctagtactagtaccactactactagcattacgactgatgcatagtgatgtaaacctgcctagctagcgaccgtgcatcgctgtgtgcatgtcattgtgcgtgtatgtgattgatatgtggaattaagagctttggggcctgattagctagcttgtgcatgtttgcttacatttatatatgggttctaagtatcagagataatcatgcattatatatattcatgggtgtcgcagtcatgcatgtttgtcagaattatggcaaagagatgatcgatgcacctaatctctaactctaaaacgtggctgctgaggcgttaggggttttggacccctctgcctcttacagtgcattgatgatgtgactcatgtactaacaaaggtagtagatctaaaagcaagtcaattaatgtgtctaactggtttgctatttcgtcggctacctgattgacaatttccagaatttggttccatgcgagatcgatcaaggggccagcgtgtgtatagactggtcatacacatccagctgcatgaaatataaaagatgtagtacagtatttgttttatttgggtgtacatgcatggagtaggtcagttagatatgatgacacatgacatttcagtggaaatggacatccttttttttaattttgtttttcctttccaatgctaagctagctatccccaatattattaactatatatacgtatattgtatatgccttcaacaaggaaaatcatatatatatttttcatgctttctatttataatttgctcaattcatgtatgtgctatgaacatgtggtgccaggctgctagctagtagctaggagtacatgctgataaccggcacatatatttgcgtgtgagccacgtgtaaattaatggaagagactagatatatagtcttgcatccttatatgtgccagctgatttaatctacatataaggatattggcacacacacacatatatatatatatatatatatgtgtgtatatatatatatatatatatatatatatatatatatatatatatatatatatatattcacacgcaattaatttacacgtgtaaaccaatttgaaatgtttgattatcaagttggttttacgagtaagaagtcaaacatttcaactggttacagaattacgtactgtgtccagccagattaattacacaagtacatgatctcaaacccaaggatttttggagtatctaattccctagctagataagaactggctaaaaacaattgtagcttttactttgaaacacatgtgacagaaatgtcctttctttaattaaaggctcggaaccgagagaaaaatatatactacactttgggcgagtggtgaccatatcccgttaattctggtaaggcaaaatcttcttgtactgtgcatgcgattgtactttagagacttagattcatcatctgcagaggggcatgcatacatgcaagcattatctcacttgcttgatgccatattgtttaatttactactaatagcagtttagtcaacaaggagtagccaaggacacctctggaccatatgtatatatactaatcgatccaagataactagattcatggtcatggacgcaactttgaaaggagaaaaacaaaatcttgtgcagcttttaaccaacagcagattctcacggcctcattcaattggcaggtacgtaccctcaatcttgtactaccagagggtgcccaattgcatctcttcaatttggagctatatttatatgtgagatcgtgcatgcgatatactcactattctcttcattatgatcagctgatggttgttgcgtgagtaagaaagatatcgatatatgcttggactgttacacatgtctacctagcttgtggctggtagattttgttttctttgtgccttttccagccttagcttgctgaattttcctatagtactattttacatgtgatgggcacaagtggatggatcaatcatgcagtatatgtaatttaattttgactataaccttttgtgttgggatattagaattattacgcatatatggccaaatcctgataggcatcagagaaccagacaacatactagaaggtcaaaagcattaaaggccacagcgcaaggtgtgcaccaactcaccgaacgtttatttttccccggcacaaaagacaaatacggcgtagactcgtgttcaaagtccaaccctgaatatacatgtaagtcaataaagatacagccgaaaatactactatataaaagcgtataatgctagttcactggccggagaaattaagttacaatacattttctttacggggaacacaccctttgttgtttagttcatcaaatacaaaaatccgtatataattaatacagtaacgttcattaatatgaaatatactgtggtttttacatactacttcttgataatgtttaatgtgttaactaatcgtacttacgcatgatgcattatgcatgcgcagatctctttgactgactggttaaattagcttattggagccctgggcttgcaagctgccactgcatacatcagctcaatagtgtgtttctagattaagtccaagatatttaatttatttccaggttagcttaataagatcatctgaacaaggcttaacacggatagcagcaaccgtcgcatcgataattaattgggctgcttagcaccaacaaactagatagctatcgttccatgcctttgaacacaagtgatatgatccaggtcaagcccaccgttataactccgcaatggccactcccatgcaaacgtccaaatactttggcctgctagatgccgatacacatcaaaggttagggaggactagcttgcagttgacaaagaaatttgaccggtcggtcaggctgatgaaatgaccggtctcacaatgacacaaagatagggagaaaaagattgtggctcctatcaggtggcataatcagctaaagtaaaagccaaattttaaattttcaaatttaattttaagattgatttttaaatatttttaacttaatttctttttcagcattggtttttaagtcaccaagaatacatatataaaatttttatctacaaatttatttttattttctaatagggaaaaaagccaaacgaataattagtactggtactgtaacgtgtgaagacatacatgatgtgcatatatcacttgtaagaacgttttttttcccgacggttctatatcatccctgacggcagagctttgctccgctgagagaaagtactcccggtaatttcctggtgattttcatgccctgtcaggaaaaagttgggtccactcgggtgcagtagctgcacttgctgcatagccaatccgtgcagtaccaactgtttcctcgtgcatcacttgcggctaacgttggctgtgctgcagtgcagccagtgcaaccgagcattgcagagacctctgtgctgttgccttatgctatttgtagtgataccaagtattctatccgtactaaaatataagtatttttagtatagtgacaagtcaaacatttttaactttgattattaatagaaaaaaattaaaaaagattaaccatgtaaaagtgttgttactagatttatcattaaataaactatcatagtataaaactcattttatttaaaacatttaatttttatagatattattgatcaaaatagcatctcggaaaccatgtttagagtctaaaaatgtttatatttggtactaaggaagtagtatatatgtggatcttgccatcgtatcatgtatcacaaactcacgtgaaacctctatttcgttcatgaatacttgtcgattatcgcatcttgtgacttcatatgtatacaagcatacaaaaattgggagcaaatactatgaagcatttttttttggggggggggggggg

SEQ ID NO: 28958 - DNA, 26021 bp, Oryza sativa
ctaactattaattattagtacacaggggatggagacaccacgcggatatcaaatcagggtatattgcacgggttatcagcagtatttctcatagtagaatctttcgctgacaactaatctagataatgttggtgcaggtttatctagtgacatggtgaagaatcatgtcaagaatgtggtgactaacccaacgtcgtcagtcgataacattccagcgccactgtgcgacctcccgtagacagagcgagaggaaattgtcaatgtaaatacccgattacttatcctctcttgatcttaactcattttgtaggagtagtgattctaatactttcaagaatcgcccttaacggatgtgattgggggcattgatcgaccactaggaatctgcctcgctccatgaggacgttgaggcacatccccactcagccattgccctcgcagcagtgaccgcaatatcctcaggcgttggctctagtggtgcaataggagtcaaaaggacactttggaccaaatttcccagagccaaaggagcagggatgctcaggagggttagtgtctccgtggtaagtaaaacatcaacactactaggttctcttatggaatttgtcttagcgattgatgatttattaattggcagacttcttctgccaagaaagcctcctcgggcgaccgcggctagacctttgcttctgtcaaagcaaaaaagattctagtaagttgacctcttactttggttatcttcttgtttgattccttagaatctagttcgtcgagtttgattgatgtgtcttatagggagtgcgatcaccttggataatggataggagcaaagtagtggtagtatgatagtatcaactaggcaatcacgcgtcgttcaaaaactaaattatccccaatagagctgctactagtagtagtagtactagcatataaatccttctttttcaccaaaagaaacatttttgtatataattgtcaccgtcacgttgcgagctagccatacgtatatatcgtccgtgtcccctccggccggttccataaatagatgcaggtacgacaagacagggtgcattaatcaaacgacggtgttcgaaggaagctggatccccaagccatctgcgaaagcgacgcccatcgatcgttcgttcatcgatgaggcgatgatgcatccatgatatatgctctctctctctctctctctctctctctctctctctcttgccagggcctggacggacggaaaggatgatggtgaatggaatggaaggctttggcttcagctatagttctagccttcagaactacttaaagtggacaaaccttattgcaatatatcgccatgccacttgctagctatagctagtagcgacgattgaagaaaggttggcttggctggcgtctctctctgtagccgccgtaccatcgtcccggggcttaattgcgagaggccgtgcgattgctccgtcacaacagtagccaaaaaagagaagggaaaaaaaagaagataaagaacctcgaaagcgaaaagggaaaaagagagagagagaaagagaagatgagacaccgaactttaaaaggcgatgcagttgtcggcgtcgtacggcgacggcgagaaggaagaagcaaccggtgatattcacagagccagaattgacctgcgtaaccgggtgatctgcagctggccacgattgacaggtttactggtgtggtgccggctgagatgacaaagatgggttaatcttagggggtgtttgggagagaggagtagcagcagcaggagaagaaaaaggttatagtaacagcacggtgtcaccgtctgatagctccagggcagtgtgaaaactgttcattgtatttacagtggcctacagcaacaggatggatgcgtgaaatgtccattctttatttgggggttgggtgcgtttactatggatggcagtggcacccgggaaatgcgtttttccactccaaggttgtcacattattggaggatgagcagagcagatgaggccatgagggtctatgggagcttcattggatccgtcgaatttggccgcgcgccccctgcaaaaaagataacgaatgatggttagatttgaggtggataatgacaactgactagccctcctgtcctgagtgacagcatgagctaacactgtctcccaacaaaagggtactgagattgacagggctccagaattcacgtttttgagggtgtcgcatcagttgcatgtgtgaaattaaatgagatctaccaacagtgaggatttaggtcgagaaggacaggcagtgtgtaacgtaagtaaagctatggcagtatggcacaaacaggaaagttatagaaaccaacagaactaaaatcccctccgaattactgtttctatatgtgaggaggaatggaaagcgatgctattttctcttcttttccgctacctcaatgttaagcagcaaaaatccaaatatacatcatagaatgaagtgataaggagcatggaggacaacttacattattgaggatgaatggaggctgaagagaaacaatcatgagatctacagttattcaacctgaacagattccagaaggtccattactgattttcggtcaggcatgctgggtatggctccctttacttgaacacatagagatgcagcagcagctgaaattaaaaattggaaattgaagcctcaagcaaagtatgctaatgttgaagaacaagaaatcaattgcaatcaaatgacgaggagagggtgctttcagtaccagcaaatctcatgcactcttccttaggtttaccctcaactagagctacagcaaaagctgaggtgaaagtgtcaccggcaccagtcgtatcaacaacttctgtggcaggaattatcggctgcctgatcggctcccccccttcaataaataaagcagatccttgtgatccgagtttaaccagcacttctttcacaccctgtagacagaaaaacacagatgaatcggatcacaacttctaatcatattctcataaacaattatgcaccgtcaatatgtatgatatatatattactcgacactggatccaatgagaacaacttgaacatgccctattaaagagagtgattggagtaaatgacatgaaaaacgttcggttgaagaaccaaacccctgcactggcagctataacacacctgtagtttctttgcatttcttttcttacaccgcaatatacattaggcacaggttacatactttcaggtaattgcagccacaaaaatctcatcctgtttatacagcagacaagcatgaagagacatccagattctccatgaagaaagcacacagattctgtgtactgaagttaattaagagcttccagccagcggccagtttctgatcagatgctgacatgctgaagtgttatttctccaattgtgctaccagggttattcaacctactagttcagtatcattcctgggattgactttctaaacaactaactaatgtatgtcctgtccattttattagagaacaaagcctgcttttaccaaactcacttgttcaataaaagtaagccaaaagccagcataactactcaaatctaggatttagcactacatgtaattgttgggccattggtgtataacatagccacatgccagcctagccacctaggtaaaccaaaatgcacaaattgttacagcatcttgcttaatcatgttttctgtacccagtcatctagccacttagcaatacgattcataggtagtgattcaaggtcatggcaaatatcccttttgcgtgtgtatgcccgatccaatttaaggtcatggcaaatatcccttttgcgtgtgtatgcccgatccacttgcatgtagacaacatatgtgttcgcataccagagaactaaaacacaagatctatcctactaacggtatgaaaacacatgcacacagagacatacacaaatgggataatgaaagaagggcaggaggcttttgcattttcttaaattagttaccttgatgcaattcctcatgttacaattatcctaaacataatattaaacaaacagtcgtggttaatcaaaactaaccaatgagtattgatacaagtcagcaatacaagccatctattcgctccctctattttacaagacacgaattggtttggcgcagtcttcaaattgaactttgaccagaaatatcttgcaacataatgctcaatgtagaaaatcaaagattatataaaattacatagaaatacaaatttagaggtaccacctttgtactgctaaacctaatgtaaatagcctaaaggttggtgaaaacttatgaagtttgaaatctagaaatatgtgcacatgttataaatctgaacggagaagtaacctaagagctatagttaagttatgaatatgaggggaagaatgtgcataaaaacaaaccacataaaataagtctaatttggacatctcaccattttatggcatgctcctgcagctcgactgatctgttcaaatgtttctgtaggcatcccagtcaaacgtgcaagctctgtttcatttggactaaaaatatccaccaggctcagtagttccccagggacaggagcatccattccaccggcgtccaagataacaggcacacctgcaccttttgctgcctgaaaacaaaaattcagcttattacaaaacagctttactacgcttggatatgtaaatacacaaggtggttacagcattcccaactatctactatgaatgctcagatttcttaagtatatgatagtgcaatctatgaaagatgaaaattacgaataagattggatttatcattctgataatacattgaaatcgattgcggagtaacataaacacgaaagtagcactgtgcagccaacaagatcatttggtccaagtggagtccctaagatactaatcttcacaagttcttcagaaaggactgaagcacgtgatgctgtgcttaactagatcagtctaacatttgcccacataactgcatggaggcatgcttgagataccataagaatttaaaaataaaatgaatcacccttctttctgcatcgttggatcttcaggaatcattaactctttactcccacaaatcagtcacacagacaaatatatatgattcctttcagagttcagacatatgttgaagcaactcagcaatcatgatagcgctgctttatttttcttaaatgcattgaagtcacaacatataaattctcaagtcacaacatatgactctactttcatttgcactcaaacaatactagacatcacagaatcaccaataggggaaaacaaaggtaactgcaaacctaatctttatgagcaaatacattacagaagaaagcagaaactggatgttgtaaaagtatgctgtcctcacatgagaacaagctctccctgtacaaaatccacatgttttgtcctaaccctcattggttggtttgttatgcttctatggagcttagtgaaacagataggataattgcaaagcaccttaccacaagctaacagcattatatatatcaaaatcagagtgttgaatggcctaggtttcaagtgcaagtccattaaacactcatacgcaacagactgtaaattccagccaaatgaagatgccattagtctagacatgttccctgttttgttcaaactgatgttgatgatagaggagactgtgtgaatgctgttgggataataccatgcatacaggttaggaaaaaaaaaacatagcttctctaacatgccgtgtggccagatatatcctatcttacacagtgtacaaaatagtgtgcataaaattattttgctcagatcatttgatatcatgaggaaagaataccaaatccaaagttggttcttcccaccaaaacttatgctccctccgtcccagaatataagaagttttagagttggacatggttattaagaaagtaggtagaagtgaatgatggagggttgtgattggatgagtagtgaaggtaggtaggaaaagtgaatggtggagggttatgattggttaggaagagaatgtttgtggagaggttgttatattttaggacaaatcctgatggctaaaagttgttatattttgggacggagggagtaacatagacttaagctttagtagtgcattaagcaataataagcataaaacacaaattcactaagaacaagataagcattgaacagacagcacatcaaaatttggaatacttttgtcaacaacaaaaaaaacatgcatcttccgcttagaaaattctaatctatgctcaatatgtctaatcaactatccagtttcctaccaacgaccagatcaaaatcataatctggagtagccatcacacagatatatgtagatcaaactaaatgaacagagctaagttcagctaacagataaaagccaatccacactgtgtttttgctgcaatatgacctagaaggcttgaactaatctgcactaatgcaataagctcatcataccacacaatttcggttaactgtaggccacattttctcacttcgttttggtcaaaggcacggccaagctagaagccattagcaaatttattaaggaacatatctagctacgaaacactatcaaattcaatccaatttgacgaccacttaacaaagtgcgtaaatgagaaaaacttgttcaaatctaaagagagaattagagcaaccacctgcgcaacctgcacgttgacccaatcgggtatctcccgctgcagcagcagcacgccagcccggcggatcaggtccaggtcgtccgagccgacccccgaggcccacccctccatgttggcgccgccgacgatgatgatggagttctgcccgccgggcatcagcatcaccacggcgtggcccgagggcgcgccgggcgcgcgcgcgacgcggtctaggcggacgccgccggcgtccgcgagggcgccctcgaggagccgcccgttggcgtcgtccccgacgcgcgccacgaggtaggtgggccccgccgcgaggcggcccccgcaggcggtctggttggcgcccttcccgcccgcgaggctgcggccggcgcgcgccgccaccgtctccccgacgagcgggaggcggtcgacctcgacgtagatgtcggcgttggcggagcccacgacgacgatgggcggcgccgccgccgccggggcactggcggaggatgacagggaggcggagggcggcctgagggcgaacgagaggctgcccggcttgggggtggatcccgggaaggaggtcgtcgccggcgatagtccggcgagagggaggcggaggcgagcgtcgagagtaggcatggctgatcgatgagagagaaagcgacggtgtcagcgaaggtcacggggtggactaaagctcaagtctcggatgacgatgatgatttggctaatttggttttggatcagagctcaaatcccctccctgatctgctggaaattccgaatttccaacagatttggttcgagactttggctctatcggcctaattaacatatcctatacacaactactccatccgtccaatataaacattttggggcaattgcaaatttaccactactttgaatcgttattgcaaaactgccactagaaaattgcaaaaatgccactagaactgtcattcgagtggtatccttgcaatattcaaaaaaccggtggcaaatttgcaaatgccccaaacatttttaagagctgaacacgattattaaaaaaacatgtagaagaagttaaaaaaaacaaaaacaggtaaaagtgaatggtgaagagttgtgattggttgagtaatggagatagattggaaaagtaaatggtggatgattgttattggttgggaaaagaatattgggggagaagttatattttgggacggagggagtagtaagtatcctaaaagaattatataaaaaaaagttgaacacatagctctaataatattacacatatatataagattttatcttcaaatttataatattttagctcacaagactaaatttgaataaaattttactcttaaaactgttatttttttattttattatggctaaagtataataaatttgaatatgaaaattttatagatatgtgtgatagttaagagtacgagtaaaaattttcaattatcacatctctagattgcacaaacgctgttaaaaccaggaacggtaattttcctcgtaacaaaggcctgacgaagttgacctgggagcctggcccacacacgcaacgtttcggcccgtagcaactataggctggaactggatcgcaactaagaaaaaagtacaccgaaggtccctaaacttgtcatcgagttacaaaatcatcccccaaccataaaaccagataccggacgtccctcatctaaacaaaccagataccggaaccagatatatctggtttttttagttgggggataattttgtagctcgatgacaagttgatttggtgtactttttcctcgcaactaaataggcctgaacgggatcacggcacccgtgcggccttcggtaactgggccggagcggtattagcgaccaacgtgaggcccactgtataattgggcgtgattccgtcgagtcgcgcgggccgtcttatatttgggccggatcgtgcatgcgtgtcagggtaaactataccacacacgaatacacacgatctagtgaagtggagccgtagctgcagtacacagtaattacacacagattaaggtgaagttcacacagattacagtataataatactcctttaaacatgcagcgaaattacttttacttttcttattcgaaaaaagaaattacttctactactttgctacagatacagaagaagcgtaaccacgtttccctttctccgtccctctccggtgacgtgatgggctcgtggaccgatgactcagaccacggtcgcccataacatcaacggccgagatgccacccccatcaccacaaacctctcatccggaccgtccatccacacaccccgcttgctaaccaaccgtgacacgcaacctcccccctccgtctccccgccaaaatgacatccctgcccctcacaacccccgcgtcgaaggcggtttttcccgtggagtgacggaaatacccctacccccctccctctaatgcttctctctctctctcttctcctctcccctctactctctttctctctctctctctccccccttctccgtctgcgttgtgctgcgcgagcccccggaggcgaggcgactccgcgtcgccttcccccccgagcgcgcggccggcgagaagggcgggaggcgcgggcggcgaggtgctcctcttctctctctgtgtctctcgtcggcgacctcgcgcggtagcctcctctccggtggtggtcgcgcgcgcgcggacggtcgacgagggaggtttggagggtgggggcgcgactcggggttgaattcgctcgagctgactcactccaggtaagaattgaacagcgattcgtgtttccgagcagaattgagtgaattggttggagcggttccgctgatttacggcggtgatctgggtgctctctgttcgtgatttcggggtttgtttgatgagatttcagcgtttttctttttctaattaggagatgttagtttggtagggaggttgcggtaattcgttgagatggctgccacgttgtgaattttcctttctagggtttgggtcttcgcgttggtcctaccgtgatcccacctggttgtccctcaatttcgttgcttccttggctctactgacgctttattactgccgatctagccgtagaaaattatctttctgcaatagtaccgtagctgtacaaatgatctcgtctaaagcttctgctctacttcattttctatatgcagcatgtttgctaatctttttatgttgcaagtacaaatctgttgattaaggcatgattagtaggttaatacgtctactgctatgcgattacttgcgtaactgaagaaaggaattaatttaaccattttaacggttgcacctcctttgctgttaaaagaactaaaggagtctgcttttgaggaagcaactgagtgcttgtagaaggcgtgattgaatagtaaaaactgtcttaagaaagctagatcttttctcaacggcaggcttttcttgttataggttgtactaaatgtttacgttccttcatgagttcattttaaggctgtgtctatcgaccatatatattgagatctcatatatatttctaaggtgtattctccaacttttgtatttgttctgcagagggttttatagtttcaagcacaacgctgctcaagatgccagcactgaggatgaagaggaactttgacgatgatgtttttagggatgagtttgattccaaacccacaaaatctatgaagatctcacattttcaagtcagcgaactagagcagtcagctgtgttgaacttgccttataaagatccccacgatggtaagtgactgcaggcagctctgtgggagttaaggctgattttttactgatgtggagtttctttcaactttcccttaaaatatatgtaatttagctgtactgtttattacagttctcttgaacaggaactgtgtgtgcctaatgttgcattcggaagctattttttataggtagataatttaacaactcatgtttgttaagttggttttacttagctatttggaaaatgtgtttaaattgtgcattgttagtgatcaaaggttagtgagggtgtgcatatttcattgattctatttcctttttcagagctggatttgacaactcagttagctggccaggacattatgatcatggaagctgctagtttggatgatgctcttggaggagcatctttgctcaaggtgtggcatcatcatctgatcatatattattataattattattgtcgcactttacttttgtgttcaaccgtttggcttcaatacttccatttcattattataagtttcctcttgtacttcagtttgtctctccaaactaattagtccaatgaacttctgattacaaatgagtaaccactaacttctgagttctgattatggagatataactattgcaatttctttccaaagttcattgcactaatcagtttggggagacaaactgaaatgcaagaggaaacttattataattaaatggaagtattgaagccaagaggaaactgatttgtcatttgaccttgcacttccaactagtttcagttaatgatttgttataaagggcagaaggcattgtgtttgtttcttatttgtgttatgaactaacatttgtaggctaggtatatagcttcattattttggtgtcttctctcctattttatgtctcagcactctatatcagaatcattattattctgttattttatagaatcttctgcaatgtaatgtttccatgttgatttacaggatttaatatctgaggtggcagtttcaccaaatatggagaatgatatgttagttaattatgaagacatcagatctcagttaaatgtagtaaattattttgacaaaggtaaggagcaaccctttcaccttaagtgacttaggatatatatccattaagcgaagtagcaagattaattttgctatgcgctaggtatttacacttccatgtgcgctttgcattttcatattgcaattagcaaagcatttacaatgtgatgccatagattctaagttatctgaaaaccaatcttaccaagaatagaattaaaaacaagatttctttgctagtaatgactggaatattcctttgttacttttaaattatattggactttttggtcatcagtctttatttaatgcatgattctgatcattctttgtgtatacacttttgaaaatgtgtaaaaatatgtatgctacattagcatctggtgttgcaaatttaatatgattatttctgtgcggtcaagctatacagtatacactgaattgctgatagggaattgtatataaatgatccaaatttcagaagttctactgcaagaatgccacattaatctatttatgtccacaaactggacactgtttttgtctttgtgccaacttatcacaaattctgattttgcttggctggaggatttctgatcttttaatttcattgcatctcttgctccaaaaacgatgtgccacatatgtagtttttagctgagatagcaatgcaatcatttcaattccccctagttcgaaaacctttttgtcataatgccatgtcagtctctcaacattatatcgttgaacaaacctaggatgtttgcttaaattgataacttgagatgagcttttgctgtacatgctatctttggcctctgtataaaatcatgatatgcaatatatacttgtccattctattgtggaaagagaaaggtgtgcgctggcgctatatgcaaatgatcataccagaaattcatggtgactgattgtctaggcattttgattggtattgaatctgaataatatgtgatagtggcaaatccatcaaatatatcaccagattaaacccacaagattatcattttttttgtgatagtggcaaatctattaaatatatcatgaactgcttctcttgaaagttgtccattcatctacctattgccaacggacgaattgctaattcttgcagttgtggggcagtaactgataagcatgatttgaattgtgttccttattttgtaatagctccttgaggagaaaatgtagaaatatttatttgggacatgcttatgttgaacatttagttattactactcaaaagcaagtttcagtttgtaaatgtgcgtacttatttataattatgcatggtattttttgcagatgaagatgcaaattctgcatcatataatagctgtaccgttaattgtcatgaagaaagctggggctcgaatgagggttgcagtctgttggacatttataatcctgatgatgctttctctttcctattggatacgccctctgagtttctgggtagttttactgcattatatgatgaagttgtaccaattgattcattggtgaatataagtggccgatgtggagtattcccacttactgagagcactacagaagccagtattggtaatgagccatgcagatctgagggggatatgctatttagtaactcagaggtgttagagtggctcaatccacatctggctgaggaggatttgcctaatctcgttgattttactgagctgaactcacatgctgtatcaaaggagcaaggggccaggaaggtcactcttgtacttgatttggacggtatgttgctggttttaaaagatttattattttttaggactctattgatgtttcccagagaataatatattgttatttttccttcctgtgcagaaacccttgttcattcgaccacagagcagtgtgatgactatgactttacctttccagtgttctttgatatgaaggagcatatggtttatgtgaggaagagaccacatctccacatgttcctccaaaaaatggctgagatgtttgaggttgttatattcacagccagccaaagtgtttatgcagatcagctgcttgacatcttggatccagagaaaaaactgttctctaggcgttatttccgggagtcatgtgtatttacaaacactagctacacgaaggatctgacagttgttggagttgaccttgctaaagttgtcataattgacaacactccgcaggtaaactgctgataacttgttctgcgctaatgcacttcgtgttctaaatgttgtcacttatgtttttaagaaggttcagtgttaaagtgtcctggacctacatctctgaatttttgaaatctcccattcatcaactatcgcatgaagtatccgatgagcacctgaatactaatttccatgtttcattcaggttttccagttgcaagtgaataatggtatacccatagagagttggtttagcgacgactctgatgaggcattacctcagctgattccgttcctggagacccttgcttctgcggatgatgtccgacccataattgccaagaagtttggcgacaaaaaggatattgctgagattttccaataaatgttagggatagctttttgtttactcagatagaggaacagaaacttaattaacatgttaaccgggcttgttgacctttttcttttccttttttacagtgggtggttttcataggattaagaattttggtgttagagctagttgtgaattgtacatatcctcgtatttcttaaacagttctgtacatagtatgctgccggaaatgaaagtgaacttcacaaattttgttctctgtttccttcctgttaagtgtcccgtacatttgatgttgccgttcgatcagactgttgggactgtccaggacggattcttgcatctctttttcccactgtcagattctcaattggcaactaattaatttagtcgcaattgcgttgtgcaaacttatgtttacatgtttttttctctcgagatcgttgaaacatcgctgcatttgaagtaatactcaccacgtccaaatataatttgctcgtcgatgtattaaatttcgtagcatttgaagcacgataccacctaattcatgtttgaactctggtctacaggtactgctcatgctgtaagcctgtaaccgttaaccaaatacatctcagtagttagtggtgcggtcagttctgacaatcctaaaacacaagtaacatcaattcactatcatttcccatcactctaagagaagcaaacagttcattaacatttactatagtcctcagatttttttttttttgttcttttttatgttacaccaaaatgtactcctgttctacaagggaattgtctcgcaagcatttgtgctcagacgcccagtgatacaaaaagaaaacacacaccaccacatgtccacatgtggaacaaaagaaatggctgtctctggcagtaatatatagaatcaagttattgtatatacataagctcgctatttttattcccataagttctctttcattcaaagtagatcactcgctcatctttttcccttttctcccatttctttttcttcttagcagcaaataactgacggcacggcaatatggcatgcctttcttggcaggctagatcaatggctagcaagatgtttgtcttttccacattctgtaatttcattttcaccgcctcgacgcttcctcgatcagattgttggtcctgtattctttgtctgaatctttggctgataaggcacttgggtacttggattctttcatgttattaatcagctcagcggagcatttttgaagtggccattgcaccctaatacatcctcgagaccccatactgaacagtactgactttattgtagttacctccaactgcagcaatgccattaaaagggccaattccctgcatcatgttggattgtaaggcagctctgtctgctacatcagatttcgcctttgaaacgtagtaagaggaagctctcaaatcatgggacatatgtgacaccaccttagcatccatgaaatgctctgatggctggtaccgcatgcgatctttctcaagctcctgctggagctctctttctgagctatccgatttacggtggtaggcatatgctgataggttggtggtggctggaggaagcactggattccttaccacccttcgttgattgtatgggcccattgcactcaaattctcaaatggtattacagggcaagcccctcgtcctgttctacctgagaaattatcagaagaaaatatatcagatggaatcctctgaagaaatgagcttgataaatttatttaggagaaactattacctggaatcctttggggtacttgggaagttatattttgatgatctttgggaggaattggagcagaatgaactgtagtagtcctgcaaattagaaattaaaggtcagcaccaatattccaacggtggtctatgttattgatatcacctcaaatcacacactttctgatgtgtacagaggttttatagtaccataaaatcatgaaacaaagttttataatgatgcaagtacgatctatctgtttgatttgatgcaattttcttaacagaagcaaacttggcatcataatcaacaaaaatatactttcaatgggaagaaaaccattgatggttaaaacggttttagccaccttgggagcgaaacatgtttcctgtctgatggaacagcatctccattcttccctccattttcttccaggttagcaaattgtctccgaaagttgtcaagggcactgtgtaataacaattaggtgcaaccgaaaatgtattagttataaccaatggggtgcagaagatgggaataaacaaaaagaaaggaggtggggagcatgactgatggaagagaatccatgggacgaacctaggatataggaagtttgttttttcggttccattcatgtaatccttaagaagttgaggatgatactccagtatttcacggaatataagttccttcacatcctctttagtcacctttctccgctcaaactcaaactccatctttgttattggctggcatgatggttctctctctgctttcgcaaggcctttaaaatatggatcagccaacgcctgatatgtaaatcaatgaaaatgaatatcattagaatgatttcagcaccaaatgacaccaggtgcagccatcacatggaagtacaaactacagaagttttaattcgacattcattaataaaaactaacctcttcggcagttggtctatccttcgggtcgaatgctaaaagcctctgcagaagtttgagtgcagcaggatctgcttttgggaatctctcagaaaaaggtactggctgctttttcctcatactgctcaagtacctccttgctttctcattccgaatctgcagttacaacatgatacctggcatttattatggatagttcactttggagcattagtcattgatgaaaggcaaagcatacccttgtaacagtatccattgatggagtacccaagagatcagtcatcagatccaactggtgaaccacatttttaccaggaaacaaaggcttcccagttaaaatctcagcaaaaatgcagccaatactccatatgtcaatagctggtgaatactgcacagtacaatcgatttagcatccattgaaatttacagaggagcagatattagttgaacagttggcgtaaaagtgaagaaaatatcagctaactacattaatcctatcacttcgcctagatgtcaaacagacgaataaactctcaggttactgtaaatgctgtacttttcaaacctaaccaaataatactaataaaactatctatgatgatcaatgaaggcaatacctactaaaaaggtagcaaatgccgcctatgaatgcagcttctgaacaagacaatttggaaggaatgatccctgttataccagctggtaaaaagccaaatcggaatcaaaggggatgaatggcctgatgtaaaatcacatatagctatgggggtacttgtgcataaaaagggttatgtacaacaggataaatttaacacatagacattaatttttcaggaaaataaaaaatgaccgcatatgaagtttctaaacagtaacatgtgcatatctgtagggagcttggaatcaagtcacccgattaatcaagataaagtaaaattgagccagacatcataaaacagaatatagtcacacgatcgttgtcaaagatccaaatgaaggcttggaggaatgggaaagaggccacaaaatgtgaagtatgatttatgacgatatgtaacactagttaattcgaattgtgattgctaaatattaggaagtccacttagcatcaacagtagttgctatgactgacataaatggctgcatatcaaggaagggccacagattgacaagtgacaactattgtataccagcatgtggcataccaccagtatagtgtgtgtggccatgaatactaggctctagaatagctgccattatcattctattggcataacactcaatgtattacactagttaaattgaaatattatgtctttatgatataaaaatattacatttctctatgataaaatgtgtacagtcagaagagcatgcagaaaaccatagcaaaatcatgtatagggatgtgacaatgaattttaacagaaaatataattcagcaatataccatcaagtagaccaagcaaatcatgttatagggcttctggggaagtagcccaagcaaatattccaacaaacaacacatgagaactgcagattaattaccttagtaaagaaagaaccacacaactcaggagccctataccatctagtagcaacataatcctgcaaaaaacaaagaaagaaaattatgaaatagaaaataaaacttacgtagcaaaactatgcatgtactattgcagataatgcaatatatgaatgtacaatgtcacacaccgtccagaataccgttgtaggagtgtcattaaatgccactcgtgctagaccgaaatcgcatattttgagtttacagttagcgtttgccaatatgttctttggcttcaaatcacgatgatagacattagctgcagtacataaactgatggttaggataagcaatacatgtaaaccaagtgcatctccccattctgaaagatctaaatgagcatgcagtttaaaactcgacgagaaggattttcagtggtgataatgttaatggcttaacagtgaatagcagaaaacagtaatgatgacatgttgtacaattagtcaatttctagatagacaaagaaagtgcaagtatagtatctagtaatcaataaaagatgcaaaatagtgggaaatactttaaagaaataagaggatggcaacaaacagaatctccacagggcaaaaataatgtaatgaacagaataagcaactaaaggcaaatgatgtgggaatgacaatttcctttatttatagtggacttatttattgggctagcactgtgccaaattcatgtgcgagcacactacaagatcgtttatgctcttcatgaagcataacaaagaacccaaaaaaatgtgaataaactttacccaacatttcagagaataaattatccctcaacactaaacaaatattacagtcatcaataaacgctgtgctagctcagacctcagtttctaaaaggaagcataccagtatgaatatatttcaaagcacgaagcatctgataaagaaagaactgatgatgttctttggttaagtcatcatttgccttgatgacttggtggagatcggtatccatcagctcaaagacaacatatatgtccttgaagtccctccttgatggaggtagcattatatgcttgatctcaactatatcaggatgccgtaatagccggagcaatttgatctcacggaggattcgggcagcatcagataagtgctcaaagatattgtgtattttcttgattgcaaccttgtcgccagtatgttggtcaatagctgaacaaactacaccatagcttcctttgccaatgacttcctgtattttgtatctgttagcatcaccatattcgctgaagaaatccatctctggcgaaccctgaacataagtcaataaattgagttaacactatgctggagatagcttgtttaaaaaagagggagtatataattcaaagctaatgtctttgaatgcatagaagagtacttgctaacagaccactgaaacagcagatggttaatctgcgtacaacaaattcagacagatcctagttcaacaaactcagatagatcctagaacgagcaactggactctagtagctgatgtatcagaaaagacagtagctacacctgcccttctgatgcaaagactccttagtctccactctccagcaatgagcaaaacgaaacaatcaaagcctaagaccgaacaagactaaaaaaaaagccaaataatgactcttaagaagtgctcttggcctctggggcataaaaccatctcgatcaatatgcctccaaagtgggcatggaatatattgattagataatccactgggacaattaaaatgattggctattcttttcttgcaagtaaaaaaaaccaggaaggtaagaaagaccgcagagctggcttaggataaacatatctactcagcgaatcttataccgcatttgtgatgcttctaagtagcatctgaattaatcttctctccttggagtgttatctcggattagaagtggggtgggaaaattctctgaattggagtactagttattcatcaaggcgcaatgagtattcgactgactcgggaaaagttgtcaaaggatgtcatttcctttcgagggcacaaaaagcagacgtcgcccagcaccagaaggtttcagatattatcaagaaggcatccacggttaaatcgaatagagaaccttctgacaattcggataatttccgatccagagaaaggcgaaggggaggggggaaaaatctcttttgcgaacaaatggaacatgagaatcgagaactacagcgactgcagagctcaaaatccactgaaattcaccacaatccaacatacggagtcatccgcagataaaagtcgagcaaaaaagcggaggaaaacaacggcaagaacaaacccttactacgctcgtacgcatccgaatccgaagctccacgagaaagaaaggaagggaaacaaatcgttcttttgcacaaaatcccccgactccatataactcaagatcgtctcgacccgcgggacgaccaaaccgatctccaaacgccaaccacccatgaccatgagaccaccaccctccaccaaaaacccaaccacccccggcgagaaacaccgcgcaacaaaaaatgaattgccacctcctctcaccttcctccgctgctgctgctgctgctccgtctgcatcgtctgcatcgccatcgccgccgccgccccctcacctctcctccaccgccagcgacgaatccacccgcatttgcctcgcctcgccgcgccgccgcatgcgacgccccgcccgcgaggtgctagggcgagcgagcgagcgagcgagagggagagatcgatcccacgcacccacacccccacacgcgcggggggatcgaaccagcgcaatccccgaccgggacgcccgccccgccccgccccgctcccacctccccccctgcgactgagcaactcgcgccgaggaggtaggccgcgcgtgcgtgcgtgcgtgcgtgcgtgcaaagccgcctcgccttcgggagttcgtgttggcgtcgcgagcgaaccactgcaaaaatcggtcggggtcgcggacgcggtgggggttaaaaaaaaccaacgagctcttgcagttgtagtagttgtagcgagagctcctcgtccctgtctgtcctgtcgcttccggcctccgggtccgggaggatcacgctaaaaacacgcacgaaacggtgaaaccaaccgtgaaactgcggtgctgtgccgccgggttggttggtgggtttcgggcgcactcggtgcaagcgcaaacgcggcgtggcgtggcgggcaccggggttggggttggggattggtttttttgggtgggattttggagtgccttttgacgctgtggtgtggtggtggaagttttcggctctggtcggtcggtgcgccggcgagcagggttgacgctgttttcgcgacctttttctccctattttatcctctcgccgttgctttaggtgtgcgaatcacatggccatatatatgaccaagctgatcgggttttcaggcctttttttttccttttttctctcatcgtgcatcgcccttgggtacgaagcttcgtgcgccgtgcgatgtaacatgataagatatcgcaattatcggtggttagatctggggtgttggttcacttgcccggggtggcgagatatataagacgataaggttttgatccgggaattctaaaatagtcgtgtatggcatgtgatgctaatcatgctcttttgcatgcactgtgtgtatatctgtttctcctttttattttctttctacgatacctttttgcaattattattccaattaaaccgtctatatgcatcacgtgtgatctccccgccctaacatgctctgtcaactttgcgtttacaaccctaacatgttgtcagttttcgatcaattacgatgggaaaccagagagtcggtttacttatattagtactctctccatcccataatacaagagttttttactttttgcttgtactgtttgaccactcgtcttattaaaaaattgtgcaaatataaaaagaaaagttgtgcttgaaatactttgaataataaagtaagtcacaaataaaataaataataattttaaattttttaataagacgaatagtcaaacagtgcaagtaaaaagtcaaaatcccttatattatgggacggagggagtactatttttttcacaaatctatttaactatgaatctattttttattgatatttatattaatggtgacatttttcaaatgatacaatattaatagtttgggatttgatagatttcagttatctaaaactacacaccactaatctaaaattgcattgttatgcaaaagtgcaatactctctccatccagttggaaattgctatgcgtccgactcatatgtacaacttacattcgactagtgtatatataggtataaatgctgcttgtttgggtccacatgataagaaacaagctcagtgattggttgatatgacatagtcggacatgagtcggatggctcggtcatacgtatagcagagttccatccagtttggtaatcccctaaacaaaaggcaccaagactaaagaagctaaaatattcatcattcaattaatcatcatcggttaagttgctccatcgcttcgtgtctcgtggattgcgcatgttttaaatattgcatgtcattacaccaatagaaagatattggttggttgtatgcaatacattcaatgatgcacatttactctttgtacaaataaacaaagagatatttgttaggtgatgattattttgggaagataaatataagatggagggagtattagtttattgtaactgcaattttgtattagtatggttctatgttacttttatgttgagtttgaatacttaatatgcaactttttatgttctttatgagttgaaaatttatttgatgtttgggttaatgtagtttattgttttaacatatttatctatgatacaagggattttctttttgaatatttattaatagtgagagtaatcaaaacaattaggttcccattttagggttatgatgataagttgagaacatttttggtcagctgaaatctaaacacttcctaattgtttcggataatggtagaaaaagtttttgggttgattacacacaatttttaaatgcatttatgtgagatcgggtgcagtacagatgaaagctagcgttttattgttagaaaattttcctgcattatatggataataaagaatttaatgctgttaaattatgagaaacaatcattgtgtaaattattgccccctttttgattgctgcgtccaaactatgactttttcctaggttgccctgtcattgctaaaattatgtgtacgagttgctatgctattttaaataaggggaaaatgacattttagctagttgtcttcacattttctcccatgcaccctgtaaggtgtagtttggctgctgaactaatatcctttgaactagattgatcgttaagtctatttaattatctccttcaattatagccaagcctaaaagataattttgaaaaaatacatttctttgtgtctaacaataataatagtcgactatgcaagtagatgaacagacaattaataatttcaatcttaaaatgtgtggaaagacaataaatgagttaggccatagagttatcacagtactaaactttttgattatgtgtaggagggagaagagtccattctttctttatatcaactctaagacgcaaaatctgatgtactagcaattgctaactcaagtaaattggaaggaataccgggaatagaaaattcgatatggagtaatggctagagccaactaaagagttcaaccgtatttaatatatttgtaaattatatccctatttgtggataactaagactttaatatccacaaattgaacttaaccttaactatttatagtactatggattattagaagccatcttatttcatactgaaaatctcgtcttttcgatcgtcttgtcggtgtcacgtgggtcttggatgttcgctgaagcaaacacagcaaaattataattagcgtgtgatgcgtgcgtgcttatgttgatttacttgcacacgcgtcttcgtcccaacttttctttgttaaagtatgatcgatcgattaccagcgaaccctttaccgactctagctatagaatgagtcacaataaacacggagagatgacatccacgtcgttccgttggtgtccatgcatcgatgaaaacgccagcttcgcgcaagactagggctgtgttcttatgccattccctcaataattagtatggtacccatagtattaaataagctgccatctaaaataaaaaatgatgtgacaagtgaataaataagtaaagggaaggaaaccaggtcttccataagacatggtttctacacaatatttaagacatcatatgagataaatagcattaaatttaagtatgaaaaaatgttgtttacatttaaagagtagtgtccagtactagtttcttgatgatgtgtagtttatggaaactatgtctagtgtcttagattgggaatagccttaccccaagtttcctaactcatttccctcgttttccgcgcacacactttttgcaaaaaaagtttctatacgaaagttgcttgaaaaatcatattgatccaaaaaaagctaatacttaattaatcatgcgctaatgaaccgttccgttttccgtgcgcattgttctagttgggaacacgctctagcgaacagagcctaagggttatttagatctaggggtgtaaaattttgacgtgtcacatcggatattatatagggtgtcctatggagtattcggacactgataaaaaaaactaattgtagaatccgtcggtaaaatactagtgaatttattaagcctaattaatacattatttgcaaatgtttactgtagcaccaaattgtcaaatcattgagcaattagacttaaaagattcgtcttacaaattagtcgcaatctgtgcaattagttatttttttaagcttatatttaatattttatgtaggtgttcaaacgttcgatatgacatggtgtaaaatttttggcagggatctaaacaggcccatattctgtcaaatatgtttggcacttgctagcggcctatacatatatggacagatcacatctccgtacccaaagacaggacagagctagcggcctagcgccattttttcttactccgtatcgtttagagtacagaaatttctcggaaagcgacgtccccagctctcgcgttaaccgaccgttgctccttaataatgtaagccaacgtgcggcgctggtgcgctggtgggccgatcgaccggttcggggccaagccgcatgcggctgattcgcggcgctggtgcttgccgcctccctgccgttgatacatccgcgcgcaggtgacgcgcgtgacggcggccggtcccgtgaatccgatcgaaattggtgagaggtatcccgcggtttggtgttgttgctagctactccctccgtcttaaaaaaaaaaagacaaacctgatttccgtgtccaacgtttaactgtccatcttatttaaaaaaattaaaaagataagtcacgcataaattattaatcatattttattatttaacaacaatgaaaatactaattatagaaaaatttcatataaaacagacagtcaaacgttgacacgaaaccccagggtttatctttttttcttttgggacaga

SEQ ID NO: 28959 - DNA, 1976 bp, Oryza sativa
agctaggggtagtcctggtgggctcgtgactacccaaaatcttgcccagagacccccacccccaaaaagtttaggcttaaattggttgcttggtccaaatagcccggaaatatatgcggttggagggattcctagccactcagcgtctcaccagccagtagcgccagttcctgttcgcccgagcccgacaccgccagcctcctcgactccacgctcggtgccgccctcggctggcaggctccccgctatccgcgccggcgctgcgccatcccctcccctccttctgcgactccgcgccgggcgctgacgccgccaccgccatcccctcccctcctctgcgccggcgccgcgcgtcctcccctccggcctccccgctgtccacgccgtgccaccgtcctatcccctccatggctcagcctaacaaatagctgtctaaatggctaaatcgatttgtgaattgtgattagagattagtcagtctgtgaatatttgtacattttgaacttgtttgttaagtaagctacttatgtatgttggaagacattatttctatcacattttcactaaatttgtatttgtatatcaatttcatcgtgcaagaaaattttaccgcgtgacatgaacgtgtgaactaggactacccaatgaaaaattcctggctacgctacagcttatccatattcatatgatagattttttttttttacggagagctaatcaagagtacctcaggagagcaagagtcggtggccctagctagaatgctgtactagatcgatctatccatttctccatttcgtgtgcagcaatacagcaccacagaaacatgagcaagcagccaccgtcgaccgatcgattcatcgatcgatcacaagctagctcgacgactcgcaataatggacgctcctcttaactttccctttaataattggcgatgtaattaatccaaatggacccacatgcctctgtcggcgtaatatgattgcagatgttaataatggatagtcaacagtagtgattgataataattggatcctgtttaatgctattgatataatcgcttcggccatttaaacaggtcgttttgaacattgatattttgatgtcatgtctttttttacttgtggatacagtctataatgcctacatgtcttatcattactctatctaattggatatttatagaacttacttaaaatataaccatataaaaatattttgtattttttatgacaagtctattgtaatcgttttcataattaagttttaattttttttactatatacattgcaaaatataacaattaaacatggaaattaatacgtcaagattcatagtcaagagttactatattttagcatggcgtagtaactaccaagatattatagtttgactgcacatattttaggacattacttcctccgtactcgtaaaagaaatcgtttaggacaatatttaagtcaaaccttgggaatataaattattaataactctcaagttgttgagttcgaaaatataaaaattatattgagatcgaaaatataaaaattatatgaatagatttgtcttgaaaaatactttcataaaagtatacatatatcactttttaataaatatttttatagaaataagaagttaaaattgtgttttggagaccgtgtcgctgtccaaaacgattttctttatgagtacagagggagtactttttaagaagggaggtagtacaatacaaaagtatgatatttaccattagagaaaagtacattttacccccctgaactatcgaggtcgatcgaattacacccctgaactcgaaaaccggacattctacaccctcaactattgaaaccgggcaaattaccccccccagcactgttttaggtggttttgggatagacttgctgacatggcattctagcgtggcaaaaaaaaaaaaaaaaataagggacccacatgtcagtctctttatctcctc

SEQ ID NO: 28960 - DNA, 10564 bp, Oryza sativa
  unsure (1)..(10564): unsure at all n locations
tcagcctcccgccgcttgaggagctccgcctctgcctcccgaggagctccgccggcgcgaggggaggaggctggccggtgcgaggggatagagaattagagaggagatatagagactgacatgtgggtccattattttttttatttattttttgccacgctggaatgccacgtcagcaagtctatcccaaaaccacctaaaacagtgctcaggggggtaatttgtccggtttcaatagttgagggtgtagaatgtccggttttcgagttcgggagtgtaattcggtcgacctcgatagttcaggggggtaaaatgtacttttctcttaccattattactatgtatttatagaaccccaacataaacaataatattgtgtaaagttcccataacaagttctattatttccatacatcaaattcaaatatttaaaaccacacacacatgtttatggctccttcgaaacacatgattaaaaaatatagataaacaggaaaaaaacacgggattttaaacagaaatataagtgtaaaacggataattgcaaattacaagaaaaaaaataagaatgatcatttgaatagacggtaggaaaaatacaagaatcagatgagtgcgatagactcaaagtattcttttaggaaattggagttcttaccaacttttctctaaaatatatgtaagattattgattcaacataaatttcaaagtaaatggtaagattaattcaatccttgtatcaaagacctttctaggaatttttttataggcttgaaatccaatcctctaattttttatatatttctcctactaattaaagagggccttagaattttgaaagtatgactcaagaaatgtccacagcaatatttttctttaccatgccagtcttggatttgatggctccgatattattcaaacatgcgtgtatatgaagggttgaacttggagtctttcggataaccatcgttaatccaaacatactattacaaaaacacacaaaaaatgaaatcataaaaatatggtgcgtgctagctagctctccacaactggtaacagtacccgataagcaagtacattaaacgccaagaaaatcaccctaccactctctgtctcccacgagccatcgcactcgtatttgaccgcagaatcgcacgtgatctgcgcccttggaagtatgctcaacatggttactgtgcggctactaatcccccatggcattatccagtcgacgatcgagcacagctgagtgtagtactagtatgcctgggtgacacggagagtactgaaacgtaatccctccgtactaataaaaaaaatcgtttagaataatattttaagtcaaatcttaggaatataaatcatgaataactcttaagttattgagtttgaaaatatataaattatatgaatagatttgtcttgaaaaatacttttataaaagtatacatatatcacttctcaataaatatatttatagaaacaaaaagttaaagttatattttagagaccgtgtcgttatccaaaacgacttcctttacgattaccggagggagtacgtgctcgccggcaaggagaaccgtgcaaattggaatttctcgctgcagaaatccaaaacagtcactagcaaccagagcatttctttacatgtaaattggaccgacgtatcggctactgcaggtcagcaattatatttttaaagaaaatttgcgtggacgccgtgatgactaatcttgctgggtttaacactgactaggacaccaagtaggtctagtcttaaatttttaatgtctcatgtacgatgaacttagtaataggtggtgatcgaaagaacgtaacattgctgaagtatatagatctccaatacgaaaatattctctagaaaagatcgcaaattattagggaacaacgaacacaattttgaatgtttggactaaaatacttgatccatatgcatgcctatgtggcgtcttaatccacgtcggcctcaacaatactagctactatatattatgcatgtgttaatttggttttagttcgcacgcgctagttgtacagattcatgtatagaacacgtattttgtaagcttatctaccaatgcactcagctcataaaattgtactccatccgtttcaaaatatttgacaccgttgactttttagtacatatttaactatttatcttattcaaaaaatttaagtaattatttattattttcatatcatttgattcattattgttaaatatactttcatgtacacatatagttttacatatttcacaaatttttttaataagacgaacggtcaaacatgtgctaaaaaatcaacggtgtcaaatattttaaaacggagggagtatattgctagtgtaatttacttttcttttaattaggctaaagattgtagttcagttcactcgaacagtcagttagatagtgacaggggcggagctatagtgtagcggccggtgtcaggcgacaccgataactttcggtaaaacctatagttaaactgcttatccacatattataatattatgatctaattataattagcattctatgacaccaacgaattaattttctggatccgccactggacagtgatgttctaatttaatttgcaaattgcttgatttgggttgcttaccagaagtgccatgcagctatgcagctttccttttggcacgatgtgtatgcacctgtagcaccttgacgacggggtgcagatcaaacggccaaaaagatggacgccacctgtagaagatccaaggggaagaaggcagtgtcactttcaatttttatttttaagactcgctttcaaattagtgattgtttcttgtagtctccatcaacaccacactacctgatctaaaaggaacaaaaggagtttgctaattgtgattacaggtgtgcctacgctcactacacaagggttaaggaaactaggaaagcgtttttctccagtcctttttcattgaaagatgcaggtacaggttaaaagaaaaaggtatacaaggtatacacagagtcagcatgctataacttgctagtgtactaaattatgcttctatataacttggacaatttctttagagagagagagaagttggacattctctgatactactacactctgcaaatgcaagacagtttgaagtacagtgacagcctgactggttaacagcacgcnatgcatgctcattaagatcaatgaaagatgggcaattaagcaaggtaatcattttttgaaaaaaaaaacacaacaaggtaatcagatcaacctcaccaatttatttggatcagagacctagctcaaactcctaattattcaaccacacaagcaggtacggcaatgccagacagtgacataaattcagcagcttaaatatttcatccgtccaaaaataaaaccaatccccaatgtgcaggttcatatttaggatttagttttttttacagaggaagtatgtctgagaatacggcacgagtatccacgtcggcaactcggctaatcctatccatagttgcctacctgtatggacagcattcgaagcttggcaagtgaagggaacaagtgtgcaagtgccaaaagcttctagcccctctccgttgatctcatggaccacctgcaaataaaaataacaatgctctcaaaaggggacattattatgagccagtgctttggggcactttgctgcatggcacttttggtgctctccctatcaatgtctagaaacgatacgcatacgaagaaatctatatgtatactaaaacatttaaggctggacacgaatcctctgtagtagtgtacttacaatagcagtggttgacaagtgaatccggttccacatgtcagtggcagctactgtagggacaataatactgcagtctgcagataatcccaacggttcaaggcttgtttggatgaaaaaggatttacatatttacatccacccccaatccatcatgttttgatttttgttggttggatatgttcatatgcagatgttaaaattcatccagatttttttaaaaaagggggaaccgaattaaaatccttgttattgcaaacaattcgaagagatcgactatgtgattattttggttcgccttcgccaaacaagtccgaagagaatctttgtagccatcagatgtatatatatcagagtgcaaggtatttcatgggcttagttcataccgagtacttggtcgatgtatacataccaagtactctgctcatccataatactccgtatacatcaagctcgacaatatcataatcagataataatgactacatccgactataatgagatacagagtttctagcattgcccatattcatttagatattaataaatatatatatgtgtgtgtgtttagattcattaacatttatatgtatatggactcccagcctctgttggcagcttggatgaacttacaacggatggcagtttcactgcaagactggagcaagatctccttcgggtcggtgcgcaaagagatacagcggttggaaagaaggctgaagttcttgcgtaacgaggtgttcacggatgctatcatccgggaagagagacttttggaacagcagttatgtgatctctttgaaagagaggaaatcatggcaaaacagcggtctcgaattgaatggctgaaagaaggtgaccgaaatacatccttcttccatgcccgtgcctcagcaaggaggcgcaccaacaagattaagttgctggttagggatgatggttcctcctgtagcgaatctcaaggcatcaaactcatggctgagcatttctttaaaaaacttttcacctctgagcagtgtgagtcagtagaggaagtcctagaggccattccatgtaaggtggacgaatccataaatgaagaactgtgcaaggcctactcggatgaggaaataaaagaggcgttatttcaaatgggtccaactaaggcacccagcccagatggtttcccagctcttttctaccaatctcattggaattttttggagaatgacatctgcagggcagtgcgtggttttcttacaggggacgaaattccagaaggcctgtgtgactctatcattgtcctgatcccaaagatccacaatctggtgcacctctcaaaatttcggcctatcagcttatgtaacgtcctctataagattgcctctaaagttttggctaatcgcctcaaaatcttcctacctgacatcgtgtcggaattccaaagtgcatttgtgcccgggcggctcattacagacagtgcacttgtggcgtttgaatgcctacactcaatccgaaggcaacatagcaaaaatcctttttttgctctcaagatagatatgatgaaagcctatgatcgaattgagtggtcttatctccaaggatgcttaacgaagcttgggtttgcccctgcctgggttagttctgtgatgagatgcgtcacctcagtcagatatgccgttcgcattaatggggagctaactaggctagtgataccttcaaggggcataagacagggggacccagttagcccttacctcttcctgttgtgtacagaggggttgtcctgtttgctgcaaagaaaggaatctttggggttgctccatggaatcagaaacggtcaccagggtccgccaatctctcaccttctttttgcagatgatagcattttctttgccaagagtgatccaagaagtgttcaggtcctgaaatctaccttacagtcctattgcaacgcatcagggcagaaaatcaaccttcaaaaatcttcgctcctcttcggccgatactgccctgatgccatcaaaacatgtgtaaaggactgtttacaagtgtctaacgaggctcttcaggacacctatttgggcatgcctacggagataaactgtgcagtaaccagctcctttaatttcttgtctgaacgggtatggaagagagtgaacgggtggaatgaccggccactgtcaagggctggtaaggagactatgcttaaggcagtagtgcaggcgattccgacctacatcatgagttgttttcaagttccaacaactatttgtgataagatgaaatcctcaatggccaaccattggtggggttatgaagatgggaggaaaaagatgcattggcgctcgtgagaatggctgtctacgccaaaatatcttggcggtatgggtttcagggacttggtcatttttaatcaagcgatgttggccagacagggttggcgtattctcacagatccaaattcactttgctcaagggttctgaaaggtaggtacttcccagactcagatttttggtctgcccctaaacctcgatctgcctcctttacctggcgtagtattttgtttgggcgggagttgttgaaaaagggggtgcgctgggctgttggcgatggttcgaccattaagatcacgaaggacaaatggataccaggtgtgcaagcaggaatggtgaatacccgcttccctatccctgatgatgttactgtcgattggctcatgaatcctgaaaggaatgcttgggatgaggagattgtcaaggcagttttcaacgatgatattgcaagagaagttttgcaggttcccataagtcgtcatgggggagaagattttgtttcttggccacatgacaaaagggggttgtttactgttcgctctgcttacaacttagtgagatcaaatttatttgtggtggctcagagttccaatgggagaggacaacactctggagcgaatgtggactcgcaattctggaaggcactttggacaatcaatgcgccggggaaaatgctgatacatttgtggaggtcagtacatgattgtcttcctacagggttccaactccggagacgccatgttcctgctacggagggatgcatcttttgtggtcatgatgatagaattgagcatgtcttccttgtgtgcccctttgctgcaactgtttgggatgccatcaaggagaagtttcagattaacttgtgcagacgggaattatgcaatataaggcaatgggtgtttgatttcctaactcgcagctctcacattcagaagacagtcctggctgttactctgcggcacatttgggaagcgaggaatttttctaggaataaccctgttactacccacccgcgccaagtgattcacaaaattgtgtcgtatgtcgatatgattgtgcagcactgccccaaggataggaatgcctctgggtgtgatctcccccttccagttacaaagtggaaaccaccgccgccaggcatggtactaattaactcagatgctgcactcttccaagcttctaatcagacgggtttggcctttgtaattcgggatcacagtgccacctgcctgcttgctgcaaacaagaggataaccggattgctctctccagaactagcggaagctttggcgatccgtttcgccttggaacatgcaaaggcggaaggtttccagaatgtgttgatggcctcagattgcctgtcagttatcaagagaattcaatctggggcacgagacctttcagttgttggcgttattgtccgtgatattaagaaattggagactgagttcctggaatgctcctttatcgtttaaccaatgttgcagcacataccttagctcgttgttccgagtctgctacttgtaatatatttcgctatgtaatcccggatcattttcgagacgtactcaatgctgatgcaatttaatcgataaggtgctgcctttgtctaaaaaaaatctatatgtatatggaacaatgctagaaagacttatattgtgaaacgaagagagtagtatgttccttcaaagatttttttccccaaacctcaatcatcgacaagcgtttctaaaagcctcaccatatatacaaagggggtacagtacaagtgacacgactcaacagccacgggcacaacccattttcatttcgcggcaattgctttctcctttctactagattagtggcgcaaatgttcggtacatgcttttgccatgcatcgtcattagccattgatttctccattatcgctagcccctgtgggctccctgttcctttttgccctagctgcatacaatacaagcatggttttctgttgtcctgcttctgcttgtgatgttcaaaccacacgaattttgcaaggatgaacgtacggaaaatccccaaatccccaagcaaaattcatcgccaaacaaatgtgctgtgattacgtgttgatgattaattgcttggaagtcgctagaaacagtgtatgatgcgaatagaaacgaacggaaatggggctcctgctaataattcgaaacgagccgctgggattactccctatcgctgtggatttggctgaaccattattacggtaaagtaataatgaccgtgcacgaggaggaaagagatcattttactacaacttagtgaccgagtaagccaacgtcgatgagtacaagccgtgccatacatgtcactcactgatccccttcaatgatggtgttaccaacaaataatgcaaccgagttaattggaaatggatggattatgatattgatatatacttaagaaaagtatttaagatagatgcatgttcagatttactcttaaaagttgattctttcgaatatataggtgtacacgtagagatgcaagcgggccgactcgtgaattcacttataggtcaaataaatgataattcataggttttcgcgtcgtagctcagccgcatctagatatgcaagtgggtcgatacataaaacatatttatacatcaaattaatatgtaacccgcgagttaaacccataggttatacactaattttgtctataagcgggttcatggataagccctatgtacacgccatggttgccacgtcgcgcacgttttttacgcacgcgcgagcgggtgcgacgacgtgtcgtcgtgtccgccaagaaaaaaaaaaaagggcggcgagcactcgcgtcgccgctccggtcgagagcgtgcgcgaatttcctcatcttgtgagacctcgcctcccggggcgattggtgagtacgccgtgtgaggcgaaatgtgatattgtgatggaaccagacggcttttggcatctgcagtgcagtgcagaggaatatgaatggtccagagacaagacaagtagtgattcctggtttggtttgctaagcactgtagtgattacgaggcctgtttataactttatatgctatacccaagctaacttacccaaggtgtgacgagtcactaaaaagtttggccaacaaattattatccacaacgaaatgagtgtcatctgattaattttcttatggtggaatctgtgcactcatattcaagtactatacttaacatagatgcttgaatctacgactaattataatttcagtgatcgatacattagtggtgtcttcgttagtcttaagatatactacctccttctttaatagagttaattagattcatgccattataaattttatggtttttttaaaacctaagccagcattactggttttatattaagagagagagaaactgtacagacaagagacaacgacccaaattataagggaaaccgggcccgaaaaccatacagctgcacggttaattatggggaaccggctgaaacccaacggacagaagaaagcatgggacctaacacacaactaacaacaacaacggagcccaaatacaggacatcgttgccaagctaaacacaaaaacggcacaacagctccgacatcacagaagaggtgttatcgttgccgagctagccgtccaagcaacccagcagcgccgacttcaccactgcagcgacactgaagccacaaaagtcgccaaagtgaaagcagctccaacatccacaatggatatcagccaagccaccaaagagccacttcctccacatggccagcaccaactctttggaaaagactacaacacgtcatcgttgccaagcgtcgccgcaccccaacagcgagcagctccgacttcatccgcagaagcaaccgaagagtgtgtcgtccaccatagaatgaagcagacccaagaggtttaggcctcgccgaatgccaaggaaagaaaccttttgaaccgaagggaccatcaatagtcatcgatgtaaggaacttccccgaagcgacgcccccaagaaggacacgacgcgtaacaccgtcgccgctcgtccgaagccggagcaaggttttcacctggagatttgtggggcaaatggcagagcaccatgacaacgccttcaagaagggaaacagcgccaacagcgtcgtcatcatcgaactggccaaaggcacggcaaggctttcgccagcgtctgcacattacccacacaagccccccacatcgacggccacacgatagtccacgacgtctcacaagcattcaaccctcgacgcaacctaccgtcgcccacactcccctgctgcaccgaccagaaccggccaaggccgccagggaccggtcgtcgaagctcggctagccatccatgccgccggccgcgcttccacgtgctgcaccgacctctgccaccgccggccgcacaaccacg

SEQ ID NO: 28961 - DNA, 2333 bp, Oryza sativa
catgccgccggccgcgcttccacgtgctgcaccgacctttgccaccgccgggccgcacaaccacgcgccgtcgccagcctccacgccgccggccacgcctctacacaccgcaccggcctcccgctgccagccgcgtctccacgctgctgagccagcctccacactccacgtgacgcacccgactccacgccgccgggccgggctacacgccacgccgccgggcgcatctccacgggccgcgccggcctccacaccgcgggcctcgcctccacgctcctccacgtgccaccaccaccagagccacgcctcctctgctcccgctgccgcctgcatccccgctgcctgccgccgccactgcatccccgccgccacccgcctcccctcccgcacctggctccagatccagcaatggtcgacgtggattcggtgatgcccgaggtcgcagactccgtcaccgccgccttcaccaccgcggcccacaccccgccgccagtctccgcctccgcctgccgccgccaaccccgcgccctgcgccgcctgtcgccaccacgtccacctactgtcgtcgcccgcgcgccctgcacgcctccggcctcgacgacggcgccgctccgaccggcctccaccctcaaattcgcccatgccagatctagggtggccgccgccacgagccctgcccggccgtttgctcaggtggcggcgaggcagaggggaggggggaagaacggcggcggcggtgggttgggtcgccgcccgagttgcctgagcgggaggcgacgtggggggatacgaggcccgatgtaaggttttgaactattttatggttttaaaatataccattactatttaactatttgaaacgttaccattacaatttcatatatatttaaaatataccactacttattcaaagtgttctctaaaaatttttggactgaattgttcattttccactaatggagctagatctggccggctcttgcgacggtgcgttctcgatctgatgctatctccatcctcctcactctggtgcgaccttggtgcccacaccctctgtcctccaggttacaaggcttctgaagaattattcagagtttgtttatctctaccatggtttcaatgatgaaagggctttgtgaagcgcagggggaagcgcgtgccatgggaatggagcacgaggaggcgcggtgctcgccgccggcggcggcggacgtgacaacggtggccgcggtcgaggctgcggctgcgaacttcatcggctgctgctgctggactgcttccttttcgtgttcagtctctgcatcttgcatcttcagttaacagtacaaaaattgacaatcatcgacatcaacttgctgaatttgagtgtccaagctttgaatcattcaatcgcttccagcggatggatacatatttacatttcttccagtggactgtcacctgctgtagtgctgtagctccaagacatcggatgcaggccggatccatctccattagtacaatttggtccaaaaattttaaaaaatacacaaaaggagtaagtagtggtatatcttaaatacctgtgaatttgtagtggcacgatcttaaatagataaatagtaatggtatattttaaaaccgtaaaatttataatggtatgtatccaatcaacctttttttaatatatgacaccgttcactttttagctaacgtttgactattcgtcttattcaatttttttgtaaatataaaaaaatttaagtcatgcttaaagaccatttgacaataaatcaaatcagaataaaataaataataattacataattttttggaataagacaaatgattaaacatattttaaaaagtcatcggcgtcatatattaaaaaatggagggagtatatagaaaaattattatctgtaagtatggcaagatttgacttaaaaatgtgcattaacaaattagtgaaatatggtttgcaacagtttaaagaaccaacaaaaaaatatggccacttaacattgagggcaaactttggcagcgaatcaaaaggatacggagaagggagcgaataggaataagttcagttcatgaccctcaaatatgatcgaaatctagtccataaccctaaactataaaaccggatatctcgacccctaaactcctaaaaccgaagcaattcgactccctaggcggttttgggaggtggttttgctgacgtggcgccacgtggaaatattgaccaagtcttcattacacgtggcgttgacgtggcaactacgtggcggtagaaataaaaaatatgtgtgggacccattagtcattcacacacaaagaaatgtgggcccact

SEQ ID NO: 28962 - DNA, 947 bp, Oryza sativa
  unsure (1)..(947): unsure at all n locations
gtccccgcgcgccaccggccgaagggggaagaaggggagagaaagagagagaagggagtgagggaggagggactgacatgtgggccctacatgtcagtgggcccacatttatttttgggggaatgactaatgggtcccacgcatattttttatttctaccgccacgtaggtgccacgtcaacgtcacgtgtaacgaagacttgttcaatattgccatgtaggcgccacgtggcgccacgtcagcaaaaccgcctcccaaaaccgccagggagtcgaattgcatcagttttaggagtttgggggtcgagatatccggttttgtagtttagggtcatcgattagatttcgatcaaatttgagggtcatgaagtgaacttattccgaataacacctcggagaattctagccatatgggcctgagattatggacagaaacactatggctagtctcagcccaaagaatagtttgcttatatgttgggcccataatgaccggttaacatgtccgtttctcgatctcagtttcgactgcaaacctcagtaatgtggtagttgcagtattggcttcaattcaaaaattcaaacaagcccatagtacctagataacagcaacactgatggcgctaaaggaacatgttaatatcgtagtgcatcaccagtaatttgactaatttccattcatggggagctgaatttgaagcattatttgtttctttgcacatcaggtactacagcatcggtatcacagcatcatatgtaagttttcattcctagctgttacagatgccagaaagacactgaacagctgaatgtggtagacgccagacataccacgtcttacgtttaagttaaacactgcagagctcaaccccacaagtgtaggcattggnnnnnnnnnnnnnnnnnnnnnnnnnnnnnnnnnnnnnnnnnnnnnnnnnnnnnnnnnn

SEQ ID NO: 28963 - DNA, 707 bp, Oryza sativa
  unsure (1)..(707): unsure at all n locations
nnnnnnnnnnnnnnnnnnnnnnnnnnnnnnnnnnnnnnnnnnnnnnnnnnnaagcgtcgatgtcgagtcacagcaatctgcggaggagatctcaaacagtgccgattcctgaggctccaatgctgaacagatacagaaaataggacatgaaaacatttcattatcctgtctggtttggtcaaatattcaatatagttcaataccgtgattgcaacaggtttacatttagcaaagactggaagacataaaggcataggaatcgttcgtttccctttcttttcttcttcttcttcttttcgagaagtgcttctatgctcccctaaaatatccgccgtactatgttttctgtagatgagtcctccaactcgtttactctacgatatgtgtagttttgttttaggggagcacagaagcaccttcttcatctataccgtttaagttatcaagaggagctgacctcgaaggcatgaatgactagtaaccagaatttgttacccttgtaaagaacccttgtcgatcctcagttttaccatgaagtacaaagttttgttggtgtaccatgtgcgcaaattttcttctcattactagtttggatcaaagcagtgcacagttgcaaatgcatggtgatcttctcacacttatcatttctgacagatgagcagagaactttttctgggaagatagtccatgttttctcccatagctaa

SEQ ID NO: 28964 - DNA, 518 bp, Oryza sativa
ggcgggctggcctagcacgactctaggaagaagatggaaaaggaaggaagaagacggaaaggaagatgatggatggaaaaggtgacagcaacgacatggttctaatttcgtaaaattggagtggcacagttatgaatatacaaattgtaatgacattttttaatatccacatttgcaatggcatggatcaaattaacccttgatctattgaaaatctatttttttaatttttacaatccattgttttacaccttcattattatcatatttattttttgttaatacatttagtccttaaggccttgttaacagtgaaatttggtaatcggcaaagacgtcatcggcttagaatcattatcggctgtagcatctcggaatcagccgatgggagttatcaagtcgccaatagtcggattccttctatattcggttaaggaaatcaatatactaaaggaagcttatccctaagtgacccgagtttaaagaggatgcggcatggcagtttatctattaattag

SEQ ID NO: 28965 - DNA, 594 bp, Oryza sativa
aaagttatcatctacgttaagagttcttcaatttgtgttttctcgggttcggcggtctaaccagcaagtcgtcggcggttagaccggcgacaccacggcggttagaccggcgaagaagcggtggtcagaccggcgacggcatcaggcgacttcaggcgacaggagttgatctcagcggttcgaccggtgttattacctcggtcagaccaactgcttccaggcggtcagaccggtgcaactactttggtcagaccgcgatccgtcgaatttgagggtaacttctaattctgcaaaaagtttgggtttttgagtataccaaccattcaactctctctggttggcttagttcttgtgtttcgatcctacaatcacctcctcgattgaatcacatatatgcatgcaaacaatataattagaaaacttaatggtacaggaattaaaataaatatttaatatatgcatacatacaggccttatattataagacatgagaaaaaaaatggttgtgccttatattttggcatgtagggagtaatgatttttaaaagatgacacatgtatcagtgagagaggtttactgtagagatttattta

SEQ ID NO: 28966 - DNA, 598 bp, Oryza sativa
atccataactaactcccccctctggcggcatgttactcttttaagactgaaaattaatatgagacttcttcaaaatgggcttaatgaacgcacccgacgagaccttgaagaatttggtaattggatcctagatctcggtgatggcatgctacctacaaccaaaaaaaacgatgaatctgaaccaacatggatagatattcctaatgatttactaataaagacacccggcgacaaagtaaaggcaattatagatgaggtctttccagatttcccctccagctacacagatcattcctatctagcatgtcgtgctattgtttgcccaaataactcaacagtcgatgaaataaatgattgtgttgttaagatgatacctaccgaagctaaagaatatcttagctgtgatacaatttcaaaagcatgtgaccatatgcctgactttgatatactctacccaactgagttcttagattctattaatgttaacaattttccatcacatcgtcttactcttaaaaagggtgtcacagttatgttgttgcgaaatttaaatcaatctatgggtctttataatggcacaagactattggttgtttct

SEQ ID NO: 28967 - DNA, 1031 bp, Oryza sativa
gactttttcacaggtattatagttgcagttaagttcttataaattagtactgttctcattgcattcataagagactattccttcctattgtcatcatagcagatgctattggaatcattactgagataacgtcagtagctcctatccagacatgcatcagagacggtgaaagcctcaagaggagcatctacatcagtgatgccgagttagtcctccatctcagtttttcatatctgccaaaagatatttactctgcttccctaacaactttgttgccactgttccagtaacgccagctaaccgctgcctaatattctccttcctttcaatatgtgctttttgtatattgttctgttttactaataacataacaaacacttaccatccatatactttttctgccattatactataccttttaatagtaatgtgacaataaatgttgcgctgtggggagaccgagctacaagcttccctgcaaatgacattcttgaggctggccaaaagagtcacaagtagtaatctttgttgggacacttgtcaggggatttggcagtaagtacattagaaacgtttgctatcgttattagtagctttccacaaattctctgagattcttataatatgtgtacagggaatgtttctttatctggtaactctgcttgcaagtggtacataaaccttgacaaaccagaggtggctgccttaaaaaacaggttccttatttgtcctttctttgccatttatatcttgttagtttctattcctaccaccagtttaaactcacacttattggttctgtgcagcatcaaaggaaattatgaaccgataaaatatatcgacctcccagcctcatctgatgctccaaacaatgcagaacaaaagaaaattattgagatcaaggacctgcacccttttaagttcaaggtaaatctttactaatatcagtactcattattgtgtttgccattttgcaaaatagtgtgctaatcaccaccctacttctggcaaacagaaacatcagttcttgg

SEQ ID NO: 28968 - DNA, 1781 bp, Oryza sativa
  unsure (1)..(1781): unsure at all n locations
nnnnnnnnnnnnnnnnnnnnnnnnnnnnnnnnnnnnnnnnnnacacttatcttctcctcttcgccgctacttgcacctccccaccacatatctgctgctcttcgccttcccgtcagcaagaacagctttcacaagctcttcagcctccctccccaggtaacaactgcagcttattatcttcagtaatctccatatgttcattcctatccctcctctccctatacagaagtgggtcagatccaaacatctgtaatagaacaatataggaaagtattagagcaaacaaactaaacatttttttgatctctgcaatgggcacgcgttaaccaacaggtcttctatttctttcctagaacactatggaggcccatcaagataaccaccctagccagagacaaccacgaccattgtcctatggcagtagccgtccactgttagcgacaaaattttcaagccgcggagaaatttcacagctatttgccgatgtcatttaccaggacgctgtggttgtcaccgttcttggagctggcaatccaaacacaacgaaaatatcagctatgataggcttcgtgtgtgactgccagattgatgattttgccttactgccgttcaggcacaaaatgtacattgtgctattcatggactcagacaagcaatatgagagatctcaaaaggcgtttgcccagaaatcctacacattccaaacaactcagctgcattttgagcctttcaagatgaacctttcaagatgaaccttcatagtgtcccaaacccactgcgccaaagagtcatacttgcactcgaaggaataccaccagaattatggaacaagcaggccatgaaagaattactagacggtagttgtatggttgaagagctttatgaagagcatcatatacaaaacctgtcgattttcagattgtctgcatggacaactgaccgcaatctcatccccaaactaatggattggaatattgaggaggttcaaggagaggaacaatcatctgaccaaggctggaaacgcaatgcagatttatttgtcatattaattcacattgaaaagctttttgactacactgatgaagacagcgacaatgagatcgatggagaagttttaaagcaatatgagaaagacaaccgtcgactgccagttataaagacattccagtgggtatctcggcaaacagacacagatagcggacctgttgaaggcgggtcgccggcaaggccaccacggcgtcttcctcttgaatttcgtaggcgccacccatatcatccagctccatagcagaatagttccttctatatatgttctcaccaaccacatagccaaaccacttatgctatagatctcctatgtgatctttttttggctactccattagagtcatacgtaattctcctggttcgaatatacaattccatcgcatgcactatgtaacatatcattttacgtctgttctcgcgacactctattttgctttcaactgatcttcaatgtttgcttacactcttccaaacttaacattactcttcactgccattacggcgcggcaaggcacgccaaacgtcctagtataatgcataagcagtggcgaatctaggataaaagttgagagggtgctccatgtaagccagtttaagctaagttaaatactatcttgtcccaacttttactctctcgttccgcgcacaaccgtgcatgttccccaaattgtaaatgatgcgtttttttaaaaaaaatctatagaaaatttggggtaccgagctcgaattcgccc

SEQ ID NO: 28969 - DNA, 1281 bp, Oryza sativa
cagaaggcagccgattaggttagatcttgatgttggtctagattatataagatatctaccattctatgaaacttctagcggcttgattgtctagatatcactcttcttttcatacttaatactgcatcagttgagtttgatctattaagtcgtgcttagaatatcgatctctagcctgccttctagttgccgattagaatagcatcggagtttcagccgatcgtatctgatttaactatatttgttctatatgctatactgatatgttaaatctgccctttatatcaagatattgccgtatctaaacatgttaggcctttgtttgatatattattcttgctttaatatcctgatatggagtagtatcggagtattagccgatacatgcgagatctatctgatcggctatgctataaacatatatagtcctgttattgatatatgtttcgatctaagtgatttatactatctcggcatgatgaccgatctatcccaatcactttatttaagtatatatcgatatgaggagtatatatcatttatatctacagccgatcgagtagatttagttcttctttacttattcatgactgccgatcgatacacagatgacatcggcccaaagataagtgatatgtcatcggcatctagccgatcggctatcatttatagatttaactacggtttctttgcttctatttcttgttgattacaggatcaaatcaactggcacgctaatacatccgaaggcgagctttcgacctgcactggagttaagcagatctcccaggccatgtgttttctgtcaacacacctattacgcaggattgtcacaacccaaccaacagataatagtcttcctcctctggttgctactgctactacacaccctttcctctactacctctgaggagctaggggcacctggggttcatcgaggggagctggggctgaagccccaacgatgaattcacccttgcatgtcctttgagttctggatctagatctagcagatcaagaacaagacgctcataatccccttctaattaccttattcaatatcccctctaggttaagtcaaccattagatttagtcataattattatgtcaaccattagatttagtctaaatgtatccttagagcacaagccctattggacattacagcaaacaaccccctcccccactccaaaagtataaagcccagttcactcggtgctcccaacttctattcttccccattgagacccatgtgatacccatgccatatactgacatag

SEQ ID NO: 28970 - DNA, 1145 bp, Oryza sativa
  unsure (1)..(1145): unsure at all n locations
nnnnnnnnnnnnnnnnnnnnnnnnnnnnnnnnnnnnnnnnnnnnnnnnnnnnnnnnncaatcagcttcatcgaaggagaacaatatatcccgttctgtcgtgcttctgcaaactgtgctgctattaaattgcccgactgtctgtagcagcnaattcttttgcgaaaaaactttgtatgaattgctctttatgcatgtaaccaggattctatattatcatgcctccaccgtgataatactgaatgctggtagctatctaaaactacttcgtctgactgagcattaccaggtttattcaagcatccagtttagttcacattcatcgacccaggatatctgtgcgcttactgaccactatcggcctgctttcaggaaataaaagttaatcaccatccagatactaaacctgaatatatgtttcttccatacaaaacatctatagaccataccacaccgctgtatagtacaaagaaccaaaacacacacacacacacatacagacatacatatatatatatatatatatatatggtattgaatgctagggaaattcacccatcaaccaactccatactgaaacaacagcctacgcattctttacacactccatccacaccatcgcttgcccgtacatgctgcctttgaagagacatgacatatttgcagcgagatgccatacagcacatcctattatttctatctctaccacacttatcttctcctcttcgccgctacttgcacctccccaccacatatctgctgctcttcgccttcccgtcagcaagaacagctttcacaagctcttcagcctccctccccaggtaacaactgcagcttattatcttcagtaatctccatatgttcattcctatccctcctctccctatacagaagtgggtcagatccaaacatctgtaatagaacaatataggaaagtattagagcaaacaaactaaacatttttttgatctctgcaatgggcacgcgttaaccaacaggtcttctatttctttcctagaacactatggaggcccatcaagataaccaccctagccagagacaaccacgaccattgtcttatggcagaagccgcccacgggtagcgacaaaaatttcaagcccggagaaatttcacaggtatttgcc

SEQ ID NO: 28971 - DNA, 1300 bp, Oryza sativa
ctactatagggcgaattcgagctcggtacccagtagattagatggcgatattgctagagattatgtaagatatatgataactcgacgaattatataaacaagattagagtgtcataaagatggaagcactaatcctaagaacgcaattcgtcataacgaattttacctcttgttgaagatcgaaatcgatgcagctcaacccgaaagcaagaactcgtcgaaacaaaactaaagcaaaaagggtggtgatgcgccaagattgtattgaatgtgtgtgttcaaaaattacataaggctcggggtctatttatacccgagaattacaagatatgcccatactggacacgaccattatctctaacaaactctaagatactataagtctttgcggcagacttttgcccacatttatctataaggaatttacataacatatcctaattaatagatacaattgccttcccaggactctatccgtgcgtggcaatcatcttgaaatacactaacttgaacccgatgtcgcatacaagttgtattgtcggaatcggctatatcggcttatttagcccgactcagacccaaccgatcctaaccgtagccgatctggattccagccgatccctgctctgcttccgaactcgatctccgcctccaacttcgctttgatcaagtcctctttcccgacacagatgttaccaaatttggttgttaacacatgccccccaagtccgggatattcgataatgttccggatttgccgtatgccgactccgagcgagttttgcactccgccgcttttgaccgttattccagcgctttaaatactaaccgttacccccgagaaatctcacaccgtgacttccgttttcaccgctcaagcgaaaccttttctctctcttctccggcgattcctccggtgcaaaggtgattcctaggcgacctcctcttcgacgagatctccgcccgcggccatgtcgtcctccgccagcccatctggtgcaccaacagccgagtacgctgaggtaagttctcattggctaaatccccttctttagcagcagatcgatcttctcttatctcatattgcttttcctcttttggttgcttcaaatttgtagcatctttctcaccaagtcgcaattcccagtctgacgcatgaaaattactactttcttggcccaatcggcaatcctgaccccaccgagttcattgttggtgaaaccaatagaatcccctttagactaaccaacccagatctaggtcactggaagaatactttcaagggtaccgagctcgaatt

SEQ ID NO: 28972 - DNA, 1451 bp, Oryza sativa
tggaccacatggttcaaacgtgtgttagccagcaagagggttcactgggatgaaattggaatcggccaagcacttgaccttactatagcaaactcagccaaggatgaacccctaatggcagctgcttcttacttctggtcaaacactactaatgccttcctgttcaatcaagggcctatgactccaaccctcatagatatcagtatgatcacaggtctggatgtcacctcatcagccaaccctatgagtttgaacacaaagaaccaatatgacttcaaaaccaaaagcgtaggaggttggtcaggctatgtggcagcatacatgggccagggttcggtcactcctcgagaacatgtggcctttctattaatgtggctagaaaaatttcttttctgtggatcaagttgcggccccacaaccaactggcaatttctggctgaagctctagaaacaaagagacaattccccttgggcaaaattctcctcggctatctataccatatgttgagcaatgcatcggctaagatagcagttggctcagtagttggagcaggtggaccctggtggctgctacaaacctggttaaacctgatagtcatgaaggttgtcaatcggccatccgtactagaagccgagttcccaagactagagccgattgtaggggatgatggagaagagcgtactcatcggagatgcacatcatacggagaatacgcttgtacaccaactgatgccggggcaaaactatcggctgaactgctcaaggattggttttgtagcttctatgaaggctttcaaaaagatgctagaatctggttcctttatgaagactctgcacaacttgagcacccagtggatttcagattcgaagacatcaaccatgaagtataccaatcatccagggaaatcttctcggctgcaatcagtccatgcatccttcctgttggcattcatcaaggaagaaacatccaagcttcctatgaattctatcatccaatgagctcagctagacaactcggaatgggccaactcccaatcggcttattctttgctgacaagatccaatgccgaggagggatttcatcaaccctaatgatcgattggctacttagccttcaaggaccccctctgggcagtattgacaacatagaactggcaacattcagaagcaaaagctttgacaggtggtggggtaaatggaaactgcatttattccatcaaccagcttcaatgtatatgacatacctctttccagatgttgtccctcaagtaagtcttcaactttgctcaactctagttaaataactgttcagccaattaatctcaactaatcgtccttttgatttgcagacaacagagtcttcccctcctcatcaaagcaacagtggcaaagacatccgatatgccccaggtttaattcctaacggaggtaggctatctcctccagttat

SEQ ID NO: 28973 - DNA, 691 bp, Oryza sativa
gacttcatggagagaatctttggtgataacgctttagacctttaataaagatgtcataatatcgctttttgactatggacttatcttatctggaatagtgtagattccttatcttgaatagtgatctttgtcggggatgacaagatctttattcattatcttcgttgattatcgtgggtgctgattgcaccgtgtcaatctctgacggctctgatttctgaaatcactgagccaggcttctgtagtaacttttcttggagcattcatttccaaaatccggtttaattatgcgccctgctcccttgaagtattcataactttggttgtaatatttgctgataaaaatccttgtgatcttgttttggaaaaccagctgatattcataatctgtggtgatagcttcttcaatttctgcagcttcagaaaataatctccaattttcatgattagcaattgttgtatatatttcttcctcttcatccgatagtttgctaggaccgtcttcttgaaaattaaattgtccattcatgatatatatataatgaattgctggacgaacaggtggtgtgaattttggtggtatgaggagaagataatcctgtatcttccatttccaagtctcctgcagacatctttcacatcgcttccaaaatcagattgaagaatctgatcgagggttgcatagatggaa

SEQ ID NO: 28974 - DNA, 1100 bp, Oryza sativa
atacttacaaatattttgctttaaacactttatacttcgaaaatattataaacacaaggaattagcaggggatggaaacaaagacgtgtattaaaaaaaaccctatcgggcaaatagtaagtttatacacctaaagtttgtacacctgagtttacacatctgaagtttatatacctaaagtttgtagacctaaagtttataagtcaaaagtttatatacccgattcaaattacaattcggattccaatatttttttatataggaactttatacttgtaaaatttacactaataaaagtttcaacatccaaaaatttatagttgcagaaactttatacttacaaacattctactttaaacactttatacttcgaaacattataaacacaagaaattggcaggggatagaaacaaaaacatgtgaattaaaaaaaaacctatcgggcgattagtaagtttatacactttgcttggtttaattgatccatggtatgggacattatagcggttaaagagaaacagggaaatagactagtaaaatcattatcataaaaatagtatatctccattttttttattgcagaatctgaagactgctttatttcaactctgttactttcagattctgccgagctgttatctttgcttgcagagtgctcaccagtggcatccttgcttggaacataatctgaaattgcacaatttgcctcgctacagtccgagtcttcacgataactaataccatgttcctcaaaatcatccatactgcctgagtcacgtaatggaatttgttatctgcgcaacagttacatagacaccttgagctcctgaccaactgatttattagaaatcattgatacaagcagatagcggcaaggaaatcaaaaaggttatgcaaaaaacatgaaacaatggaattcagaaaagcgccaaaaaaagatactattcatccaggagattttattccgtccaagctgttcgttctctatatgctgaaggtactctctctctctctctctctctctctctctctctctctaccccttggttttcagacacatgtatgagcatttttggtgacttggtgtagtgagaattttt

SEQ ID NO: 28975 - DNA, 2365 bp, Oryza sativa
tttagtaaatacattatacttacaaaaatacagatcattgttgtgctattggtagatacaagttttttcagttctactttggtaaataccatattttaccaaagtttacagcaactcttttttaacataattacaaactaagaatgatagctgacagttaacagatgagacaagaagaattaatccatgcatgcacacaaccacacgcaggataataaaacagtgacaatcactcaagcagcttactgatgaacatgagcaagcaatattaggtgcttatgttggttgtgtagccagtattggccagtcaaaacaagtggccgctaattgttggaaagttggccaactgggcaactgagccaagaagattatcaagccgggcatgcaaagacagaaacatgtcgcagtacacaagacaccaaaaggccaggttcatgttattcggtattgttgatatattcagttcctagccagtttttaccccaaaaagcaaaatttcaaaacatgttttatcaaacactaaataacaaatactgatcaaccgagttaaccagtgcggatcgggatagttgcgaaacaccccctacgctacacatcccatttgccactttcctagtgcatcccaaatttacccttctgttgattggctgcttctctctgctggatgctacagcagtcaatgcctaacaaaggtgctatctaccctgaagttactctagaaaaggaattgcaagggcgagcagaaatcatggtagtgacagcaccaaaggaaagttccagcaataacaatggcaagaaacaacaatgtctaagcttagctctccatcttcccgtcctcaactaatgtccctctctcctttcaatggtcaacacagcatggtccaaggcttccgcatgatgagtccacagtctcatggactatgtgcatcctctgaagctaccataacaccgatgcttactatttactcttcattcaacataaatccgtagtgttcaggtggaccctgctacctcttactgaaccatgatagactaactattaattcccgttggattgaacaacaatgaaaacaaacaagaagtaaaacggaatgatcaaaataacctctaggagcacctcccacctctctctctctcatgttctgaacacaaaagggcgtttactaccaaagtcatgaatgctgtgggaatcacaaaattacatactggacacactgtgtcataaaaaaaacactgatttcctgtgaaaaagttcttttaaacggaaagtaataaataatggatggaagtttgtcgcatcaaacataaatgaactgtcatatatattacctcaaacatatcccttccataagcagaagggtattcttcatcaccagggccaacaaaaccagcatcgacaccatcatcatcctccaatccacctagctcaacctcttccaccgcgttgttcccaaagaaagcatactgcgatgcatcaaacttggtagcgcctgcacagagccagagacaatcaaagagcccgggaatcagtactgaatggtacagcatctccccactcctttcatttaaaggtaaaaggagaagctattttgagttgggattgatggtgtgctccactcctcaagtgacaacatatttcgtggctagatctctatatacaactactgaaacgaatcaaacaaccaaactaaatcacttcggttaactagctaatccggttcatacctagaacacacatagcaaccacaagcataaaccatccgaaacactaataatccaatcaacgagaggaagatcttctccatctaggggcaatctacgagaagagacgaattgcattacccgtcgacgccgacgaagaaggctgcgccgccatccgcggctagggttgcaagttgcggcagaagatgtgggggacacacaggacactggcgcgccggccgaacggagcggaggccggagatgccggagcggatcggggagggagagagctcgagagaggagatggcggagaagacggcggaggcggaggaacgccgacgaggaggagccgagcccgctcgagagatagaatcaggtcagaggggaattttcttttttctttttctttttttttttggctggtatatgtgggagacgccaaaacgtgcgaactttttgggcttttttagattacgtgcaagtttgacgggagcggtaaaaataactgaatcgtatgtgcagttctgatgatggtagaggtgaaaagtgactgaagcgtgtgctgttttttttttcaatcagatcttatgtagttttgcaattatcaccctgctagaaaaaaatttcgagatttcaatcgagcaaaaacaaatttcagaagcta

SEQ ID NO: 28976 - DNA, 3343 bp, Oryza sativa
  unsure (1)..(3343): unsure at all n locations
cgcgatgcgaggaggttcagtcggcggcaacagtggttgcagctatcgagaggagtgtgccattccggtgcagcgaccagcacaacgaggtgacatggcgcagccagtggtggcatgcggaggctgcccggcacggggcaccggtgtagtggtgcccacacgctggcggaggttcagatggcagtggagcatcggtgtgtcaacagtggataggcaggcggtggatggcgggtgaaaacccagcccgtccttggccgagccagcaacgatggcagtcgagcgtcactccctcctgagggcgttgtcatgctgtctcaccccctctagtgggtgaaagcgcagtcaaggttcttgagacctcgcggacagcggcggcgatgtttgttgtttctctctatcgataatatgggcccggggggtacctaggctaggaggaagagaagcctttcctccgcaacgtgcgcggtggacccagcccccctcggggggtcgtgcggtcggccgaagagcgaccgcccgtttcgcctcccgggggctcggngtaccttgtcgcgcccctcgggcccgaggggctaaaccgccccgaggccctcgctcgggcgccacgtggccgccacatgggggcttgagcggggaggagcgcaggttgccaggcgcatttatgggcagtgctccaaccgctccgtcgcatttaatgcaacgtggcaggacgtgcgccgcccactgatgggtgtgcgccaggcgaccggcttttgaccggtctgtgacccggcgatggatggatgggacaggcggcagagcacccacgtctcactccgtgtcacacggcgtgggggctggtatgccccgtcccatcgtgtgcaatgaaaggacgtgcaggtcaccgcctcccacgcgtgtgagcccatgaagtcgccaagaatttattagggaatgacgggggatgtcccccatgtcaaataaaggacttatgtgggggccacccacgggcggccgttcggatcgctgaccgcccatggcatgggacactttttaatgtaggccatgggggtccttctccccaactgggagggcagggaccctgcctgtggcatgccctttacctataaaaggatgacctcatgtcgcaagcatggggaggacggctggatgaaccgaatgctgggtataagctagtaaagccctaacttgcgctgacaggatccgaactctttgtaacctcaaaaagatcatcatacacacaggagtagggtattacgctccatagcggcccgaacctgtataatccccctctctcttttcctcacagttgacccttcaagcacaattcccaccgacatgggcacgagaacgcgctcttcagacttgcacccggtcccctggccgaactcacaaagggggggtctcacggcctcccgctagagagggtcacccctcgacactctccctggagacgctgtctaggtagcacccttgccggaaccacctaaacttttgttgcatgcttgctctagagtcacgtcgtcttgtatcggcgccctagtttatacaagttggacacatcggagggccttaggggggagcggttcattcttctctctcactccctctccctagatcccttagatgtggatagagtagtgctttgtgtcggttgtaggggttggtttctgggcgatcccagttgtagctcctttgttggtctagcggcggtcggtcacgcttagcggtggctggtccggtgctagccttctcttgggtttgcggttggcgctgtcggtgtgtgggtggtggtatctttttttttcctttcctggttatggcctactagggttgtgattttgtaattttttctactttatcaatttgaacttcgccctgtctcgtccgagtcgttaaaaaaaagaagaagagaggtattcatatttggttatgtaatgtttcgatcttatttgatatttttttatatataactattttccgatatatataagcctatgttaaacttattcttcatgctcacatactaaaaaccaacatttataaatcatgttttatacatacacaaagtaaccaacggtttagatattaagcacgccaaacggcgcgcgtattttctagtatgggttatagctcaggtgggtaagtcccgctatttggtttaatccttttgtttccgatatagcaggacaggtttggcctattgttgaatgttcctttatacatcgatgatgagtattgcagggaggaacatggcacaaattcgaagtgcagacatggcatgtgaccaaaaaggaggactgcatgggaaggaactgacaccggaaggagatttcttggttgccttcctgaggtttggttgttgtactttttactagttcattgatacttagattttctgttaatttagtcatgcatgtctaaataatagtactatttttttgttaggaggatgagcaatgcgacactttgatttgggtagatccagagtggcatccaaaagtacaaaaggcattcgagcagctttggcacttgctagaacgtaccaatccaggtcggaggcgctctgagtggacctgttatgttgaaaaaaaaacaaaggcagaagagggaatgaagctagagctggaaatggctcaccgtctttcagatatggaaatttcattcgagaagaagttgtccaaacagaaaactgatgacattagaaattggttcataagaacaatagatgtagttgtgttccttctcatgaaattatttgataatatgtactatgcttgccgttgttgattttctacatgtaaattagctatgttaaggcaacagacgtagtttgtcatctgatttgtagtaaaagaaatggggtctcaggccgttgattgtcatctcatttttctagctgtgcattgttcatttgggttgatgagtaccggatggatggttgcaagttcaggtgtactgagacaaattttccagaaaattattcatatggaaccatcacttcgacactattttgggaggctcactggaaatcagtatgttggaacttaaatctgacagtccgcaacctggcatactgccggtggaatattagctgattgcaacagcctgttgagcttggtaactgagaaattgcagacaccaatgtccttaaccagcccatctgtcacaattctctacatttcacaatacgcagctgggtctatatatcagacgaacttggaaagcttagcaatatgcaaacttagtgttatatcagtgcaggtcccattaaatagctttcagaaaagaatagaggttcaagccaagtgtcagtgagcagtactgtaccgtactgcagagg

SEQ ID NO: 28977 - DNA, 750 bp, Oryza sativa
acaaagtcaaaagactagaaatatactaaaagacccgccgcttgatctctgtttgctctatccctatcatcctcttctacaaattctaacacttcaacaattgttgggaacatatctaccaaaattttgagagttttgtaaggagaactccaacgagtatctcatggcctttgaagacattgctcttggttcaacccttttccactttgaagtagcccacaacctaatgctttgctcacatgctcatcattgatgtctctaaccatgtcctgtctcttagctgaaccaccaaccacatttaacaaggtagaaatcatactcacaatagccacaactactaactgaagttggtgggcgaagcaatggacataataagctgaagtactctctcatgactagtgattgtagcccattatattcacctcgcatattactagccccatcatatccttggcctcttacttgactcaagcttagattaaaatctgccattagagcatcaatagaagccttgaggtatgaggccgttgtttccctcacatgaacaacagcaacaaacctttctttcacaattccacatttatcaacgtacctcaacaccacggccatttgctctttacaaaactatctattgactcatcaattagcaagcaaaacacatcatggccaagttcttccaaaatggaatgtaatatttctttggcaaagcagtcaacaatatccttttgaatctcaggagctatcataaga

SEQ ID NO: 28978 - DNA, 550 bp, Oryza sativa
cggcatggatttcatcactggtctacccagaacatcatcgggccatcactctatttgggtgatagtcgacaaacttaccaaaatggctcatttcatcctggtgaggacaacatattctggaagccgtttggcggaattgtatatggcaaggattgtgtgtttgcatggtgttcctaagaaaatagtatccgatcgaagtagccagtttacttcaaagttttggaagaaactttaggaagagatgggttccaagttgaacttcagtaccgcttaccatccgcagacagacggacaaactgaaagggtaaatcagattttggaagacatgttgagagcttgtgctttagacttcggtggatgttgggataagaatctgctttacgcggaattctcgtacaacaacagttatcaagctagtcttcaaatggctccttatgaagcactgtatggtcggaagtgccgcactccgcttttgtgggatcaaatgggagaacgtcaggtttttgggactgatatcctaagggaagcataagagaaggtaaagatcatt

SEQ ID NO: 28979 - DNA, 813 bp, Oryza sativa
  unsure (1)..(813): unsure at all n locations
nnnnnnnnnnnnnnnnnnnnnnnnnnnnnnnnnnnnnnnnnnnnnnnnnnnnnnnncttctgaccacttgtacttcacatctttctgaagcagtcgcgtcatgggcttggcaatcttggaaaaattctctatgaacctccggtaataacctgcgagacccagaaaactacaatctctgaaactgtcttcggttgtttccagttggttacggattccacattactaggatcaacggcaactcctccggctgagatgatgtgaccaaggaacttcacttcagacaaccaaaattcacatttgctaaatttggcatacaactgatgttctcgcagcttctctagtgcaagacgaagatgttcttcatgctcttcattggttcgggaatagatgagaatatcatcaataaagacgaccacgaacttgtctaggtattctataaacaccttgttcatcaagttcatgaagaaagcgggggcattggtaagtccaaaagacataacagtacattcaaacaacccatacttagtggtaaaagccgtcttaggtatatcctcctctttaatcctcaactgatgataccctgatcgaagatcgatcttggagaaaacggtggcacctttaagctgatcaaataaatcatcaattctgggcagcgggtacttattcttgatagtgacatcatttagtgcacgatagtccacacacatcctctgggtatgatctttcttttccacaaagatgactggagctccccatggagacgaactcggtctgatgtatcctttctgaagcaaatcatctacttgcctcttg

SEQ ID NO: 28980 - DNA, 839 bp, Oryza sativa
aattgaagcacactccgggcttgctgccttgcttccttttggctagctgattctatgtcaaagctgcaacaggacgtggagcttggttgcggttgttgttgccagcattgttgttgaagaactgacgctgcggacgaacaacagactaagaacctccctctagcattgactgaggtcccatagcaagacgctgtctctgactattcccctgctgagccttgaagtgagcattcggcgtttcttctgctccatgcagttgtacttgtcctcctggcgaatagccttatccactaacttctggaaatcatgataatccccagtcattaatgggtaagaaagctcatcattcagaccttcgaagaacttctcctgacgctcttcatcagtgcgcacatcttctggagcacaacgggccagacgattgaattcatgcaagtattcggtgacagagcgagatccctgaatgagcgccctgaactccttcttcttgagagacaccactcccgatggtatgtgcgtcttccggaaagcagcggtgaactcaagccaagagataggttcagcagtagtcctgttgagacggaagtgatcccaccactcagaggcagggccatgcagctggtgtgaagcaaaagaaaccttctcttgatctgtgcactgaagcaggtccaacttcttctctatggcgtgcaggcaatcaccagcttcaacaggatgggtggtgctagagaaagtaggcggcctcacgcgaagaaattctgccagcttattcgggggaggtgcatggctggttccctggttctgctggttctggagttgctgcatcatcagattcataa

SEQ ID NO: 28981 - DNA, 2690 bp, Oryza sativa
ttctccttttaatgcggctagctccttctccaaacgatccaccttgtcctccagcttgcaaatctttccgcgattccggtcttcacgatcttgagctgctatcacaattttagcgcgggtctcatccatggcccacagcatctcaaccaaatgccttgtggtagcatcattctcaatccctgcaggttcaaggtaactgccacggtcacttccctggggttgacgaggatggtagcggtactcggtgtcggccaaccgatcattgtagctttcgcggagctctcctatggcgatccttgccacctcctaacaagcatgattgtagcttccctctccagcctcgaacatcaccgatgggatatcttcacgattactgttcaaggtgactttgacacgacacttctcttcatcacgatcatgaggaatctgggcatacaaaggggcagtctcaaatcctatgaggaaggacatcgtacgcaactcctgaacaaatcaacatgctaagtttattccattgcagcaagattaaataaaacaatgtggtaacaacttttgttggtaaatgggccattagcacagaatagatgtacagtactaacaacaccggaataataaataaattttgaattagaacaattaaaaagatcatgaactgcatgtgccattaggttggtttaatttaaagagaaagagaggagaacagttctacttttccaatatttttagagggcttctaggggtaaccatttggcataacctagggtcaaggaggctctgataccaacttgtcacgcccggaatttctgtccaaaattccaaacgcttacatgtgtgtaaaccctcatccaagaatcagccgaggcacacaataacaaattgataatagagtacaattattactctaattaataagcgaataaaatgtcattacagaggtagatagttcctttcaatcaataaagttctaagcagcggaaaataaaggaaacagcgcagacgactccactccataggcagcttgaccagggctacgcctaatcatccacaccatcagcatcactgtaaactcctcctctgatgaatgattgtaaggtgagtatatgacatactcagcaagcctcgcagcaaatatgcaagtgcacaggataacaaaggatggcatagtatagtctcatttgcataaacagcatttaataaatatttcagaatttaataaaacagtagaatattaattaaacagtattaatccaacgctatacaacataccctgttgcataggcccaaccattctgaacaaccaatcccggctgcacagttctatctccaaaccaggaatatactattccaaaccaggagctatcaagttattaacagcatcatttaatatggtgagaagtgtgaaactaaacatgaaagacattgttagacccgcccataaccgcgggcacagctattcgaatagtttgaactctggccagaggtgtaccactgtacccacaagacacaacctcaacatcatgtcaaccatgcgttgcgatacttgacaagtacctgaatagagattgtaacaataccctctatataatacaattcacagcagtgcaccgttcccggatcataatcacccccttgtaaacaaggtatggactccccagtgactcccgtgggcttatctccaccacttcacagtctggtgctctactaagaaccatactatacagaaagtaaagccgttgcccacgctggcttgtggttggcacggtaaatgtttcacaaccgaaaatcgtgaaccggtccttaattttcatgagcacaaccatcaaaaccatatgtcacaacccaccattatcaggttttagttggcaaattaattaattaaccaatcatgattaaccatcatgaggtatcattaagccatcattaaataatagtgaagcacaagttatcccagtagtgtgctaatgttactaagcatggctaagaaattatatctaatatccagctgaacccatatataaagctcaactagtcaagttataataaccctaggtatcaaggaatagagtaatcaagaacaaaagggctataacaaggcaataggttaattccacccaatgacattcgaaaataaatgcagtagttgaatagaaacaatagctttaaacgggatcaacatgcttaaagggttgtttgggatctgtgtgacttgccttgctggccttgaaattcctcaaaatattctcctgcaaattcggactctccgggaacgttggaatctaaagagaaaagaacaaaatcaccaaaacagcacataaacaagcatgaacaatacatgtggatatttttaacatgtagatctcaattttagaaaaatttagagacttgaaccaactaaatccgagctaagatgaattagttatgaatttttaaagattaaatcgcattaaatcatttatatagattttaatggaattatgacgcaataatgaattattttttaaaaggaaaaggagattattgcgtcagcgggctcggctcacggtggaccgggtgcacagcggcggttcacggaaacgaatggccgagatcgatctatccaaaacggacggccaagatctaacggtctacgaccggtctacggcggacggcgtcgatgacgtcagcggtgatgtcatcaccgacgacggctc

SEQ ID NO: 28982 - DNA, 637 bp, Oryza sativa
ccccttcatcccttaggctatccttgtaggcgtcacatttcttgtaggggtcatgtttgaacccttcttcactgagcttggacgatacacctcgaaccctaccctctgggctcaagagtacccagtgtcatatttagcacatatttctacctctttggcttaaaaaatcatgtcttctatgcactggataaagactctattttattggcaaccccttgcagctcgaggtcttcaaacgaaaattcgccttcttgcgtgatcttaggagttctagcttttacccattttttcgatatttcgctccattcctccattggtacctgaagccccgccttcctcatttcttcctcctcttttgcccactgcgccacctttggtgcataccccccggaacctaagcgatgaggaaatctgttcttcttggacaactcagcaaacttcttgctcttggcaatttctttcggggaggtcttcaacttaacataatcgttccactgtgtcggtgttatattggcatatgtctcaaatggtgtccggcccgtcttcacgaattttgtgttcaatgtgtttttccaaccacgccacgacttgtccattgtttgcagtgcacaaatcctcaccgctgcttctgatccat

SEQ ID NO: 28983 - DNA, 954 bp, Oryza sativa
aatgaagaccagcatcccaagattataccatccaaagcatgctgaataaattgtagaaatatatcgatgtaattcaaatgttttacagatgatacccagtcaatctcaattcatttccaacttcctttagaatatttctattatcaagcaatgaaggttatttactcaaattacagaaagaagttatagaatatgttagtttcctacaacaaagactacgagagatgcacaacttgattgcctatgatcagttgactcttactttgaatgaactgtaggaaaggtgtgcagaagataaatgttcagacacaggttaatgtaaagaaagaggcagcccaacagggaaaaatcagatgccctatccaaactgaataaatcgaaacactgtccgagcagatcgaaaagacctaattccaagagaagaaaatcaatgttcacaaagctaatctatattatgcccccaaatgttagcatcggttgaattgagaatattcgaaataaagactaagtatagtaaaagtttaaaccggagagttacagtcttacagccccaatctaagccaaatgcaaaataacacatcagacaaacaaatctaggtaagatcaaaccaaacccccaaaaaaaaaaacaccagctattcctgccactctcttgctgtacacagccatcacggtaataaatcaaaataaatccccaaagcaaacccaccaaagcacgtctcctaacatccaaaaccggaacagaactccccaacacttcaatccaatccaatccaatccagtcgccacgaaacaatccaagcgcaaccaaagcagctacaaaaacttgaaaaacggcggcgaggtgagagaccttgggagaggaggcggctgaccgcctcgtcggggtccatgccgcagtcccgcagcgccgcgtagatctccgcgtcgggccggttcacgatctccttcagc

SEQ ID NO: 28984 - DNA, 11265 bp, Oryza sativa
  unsure (1)..(11265): unsure at all n locations
nnnnnnnnnnnnnnnnnnnnnnnnnnnnnnnnnnnnnnnnnnnnnnnnnnnnnnnnnnnnnnnnnnnnnnnnncatccgaactcagccttaagcttcttcttctctcctctctatccatcaccgtgtacacttgtcgcggcggtgtgggatctcaaacgcgcacagaaacctctctcgctgacatggtggggacaccaccatctgggcccacctgcagtatgtggttcgctcgtgggtaggatcttccggtgtaactataggcgcgcacgggattgtctgctcggggaggcgagggctcgcgcggacagagacggaagacttccgccccgaggctagcatgtgggggcaattattcggtgggccccacgtgtcagcgaaccctgcgactggcgtggcctcggagttatcctgagcggacctgacgcgtggggccacggggccggtggtgatgaaagtgacgatgcgtttttggtttttttttttttttgtgtgggtcagtgggattcctcctcttttgcgagaagaatttaggcgggcagtaaacggagatctgtagtagtacgccccagtagtggtaagttagttgggtttttcctgatttggttagattcctctcctcttcttggatcactttattcctcttcttcctttgacgcaaaaaaataacaccagaaattcgttaatgtccagggttttttttaaacagttgttcttttctttttgtcgtaacattcttttccttctttcctttgtatagacaggaatattttccatttcgaatttgccgtttgcaccctgctgttttgtgggcttaattaaatatttacatttatgtttctcccgctaacaatcaatacatgcaatccaaacatgtacagtgcttgctttctttttttgcggccggggacataaaatgtagtgcatcttttttcttttcagaaagtggtccctccttttaaagaaaatacatgacgccattggattataggttgaccattcatcttatttaaaaaatatataattattatttatttttatataatttgttttattgtcttggcttatattttgcaaacctacacaacatttttgaatgaatacgaatgctcaaatgcgtacctaaaagttaccagcatcatatatcacaactgaagaagtactcgtttttacatgtactaattaaaatgtatttgctttaacatgtaaatagccaaagcgatagtacgtgtaataaaaaaacgtaaaaagctccacataacactaaagcgagtatgctactctatccgattataagacatagtttgactaagtttatagacaaatatagtaatatttttattaaattagtttcatcgaatcaataattcaatatattttcacaataaatttgttttgggttgaaaatattactacttttctctacaaacttggtcaaagttaaaataatttgactttaaccaaagtcaaactattttataacctgaaacgaatagagtatcacggaatctcatatgactttagctgtcagttccttagattcctttgggataaaaaaaatgataaagtttcaaaagatgtgcttgatggcatgtaaaataacacgaattgataccacagagagggaaacgtgagggtaaacaccgtgattgttttccattttctttttggaattacacgtctagttggaattataaaatgaacatttggggtgatggtctatatattgtgccaaacgagttacctatataaataactccacagcaataattatttgacaacatgtcttaggtagcatttgacgtttaaccatcaacaacatcccaaatgcttattctataacaaaattaatatgcatagatttaggtagaaacgtattttagtgtcttgtaaaatatatatgtgcaatacggtttaaaatatgttgaatggagtcatgcatttgtaactttgtgtttgcaccaggtcgccgaaaagcgtgtcttagggctcgtacgaaactctagtcttgttcacttcatggccatgtttaacctttcgaaaatttggcattatttaaaattttagcaagttggcaacgttactaagttttggcatgataggtttaactacgatgatatcaattctctaaacacaacaaatatttggtaacaaactaaatactaccatacatctgttaacttcaccaaataatggtgtggtttaaaatggtaatccctccgtcaaaaaaaacaacctagtactaagatggggcacatcctagtacaaatgaattatagtttgaagtcgaagtataacagtttataactctcatggaaaaagggattgtgttttttttaagaattcgaatgcatactagatttttttagtggttccttatggaaaaagatcgatcatctttaaatcctatcaaaccttaattctatttgtgtttttgtttctcatcaaagtgtgtttttttctttgatctatggattaatttgatccataccattgcaaatgtggctattcagaaaaatatcattacaattcgtctattcgtaaccgtgccactctaattttacgaaattagaaccatgccattgccgtcaccttttccatccatcctctttctttccgtcttcttccttccttctccatcttcttcgcggccatcgcatgtcgctgagccgagatcgagcaccacgccgccacgaggcggatccgggaaactgagcaccaccacctccaacaaaagcagctctggtcctcccaccaccgcgccacgtcgcgctccacgccaagggcttccgacggcgatgagtcgtgggccgaacaccacggcgacgaggaggagaaggacacgccgctcttctccaaggaggtcatccggtgcctgcacgtgttgcgccaaccagccacgctcttcggcaagaacgacaccacgtgactccgccgcctccacgccgtgctcgaggaccccgcggcgctcgccgacgtcgacacggtggagattggggagggccagaccaacgacttcctccgcgtggagggaggggacaacgcgtggaaggagcaagggcgccgaggaagccgggcggcggtgccgactcggcacgcggaaggagccgtggcgcggccacgcaggggtatggggcggcgacgttggcgagcggtgctcagaggaaggatggggcggcagcgcagagaaaggggacggcagaggcgccgccggcatgcgcacggtattggtgccgatgtgaggagggaggagacgacgcgatagcttcaactgcggcggcgtccgcgccgacgtgcggagagagggacggcgcgggctccaacgcatggaaggagggggcggcagcgctgagggaggggatggtggcgccggcttggctccctctctccgagctcaccgacttggctccgggagacgacgctgccgccagagagcgacggcgggcgggctggcctagcacgactctaggaagaagatggaaaaggaaggaagaagacggaaaggaagatgatggatggaaaaggtgacagcaacgacatggttctaatttcgtaaaattggagtggcacagttatgaatatacaaattgaatgacattttttaatatccacatttgcaatggcatggatcaaattaacccttgatctattgaaaatctatttttttaatttttacaatccattgttttacaccttcattattatcatatttattttttgttaatacatttagtccttaaggccttgttaacagtgaaatttggtaatcggcaaagacgtcatcggcttagaatcattatcggctgtagcatctcggaatcagccgatgggagttatcaagtcgccaatagtcggattccttctatattcggttaaggaaatcaatatactaaaggaagcttatccctaagtgaccgagtttaaagaggatgcggcatggcagtttatctattaattaggaatagtttgttagtttccttttatctttaggaaagtgtgtttagtgtccgataaggactttatattttacttttatctttaggttagtttctttcttgtctgacaaggacttttatcaacccatgggtataaatatgtacacccagggtctatgtaatctatcactctcgatcaataatactctcggcgcatcgccaccctctttcccgaggtttttacttatcttccggcgggatttgggcacctgacgcggggctgcatctgttcagttcgatctccggcgaaggggtaagtcctacgttctgtcgggccctggtgaatctgtcggctacgttggtgttgttcaaggctgcattgattcgatctcttggatcgctctggtttggttgatatatttgcctacctgatatctcaattctatctctaattgcattgtgtttagagacgcatcggtttagttgggacggtctcggttaggtatgatctcctgtcttagccgatatatctctacaatcataatgctgttctaaatagatttgttatatccatcacattagacagatctatcggctcatcgagtattagattatcatatacaatctcgtgctgcatcggttaggttcgatctactagattgttgttgataatataagtcttgttaagccgataggttcatgctaatattttatcggggtgctagccgataagttatctggacgttgcatcggcttgtagggattgcatatacatataagttggatttagccgatggcaacaaaggtttcactgtttaatctaatcttgtggatcttatgacatcggacctccagccgatgtgtgctttaaccttcggatcaatacttgttctactatatcattgctagccgattggtttatactggattatattgttattttgttacatcatcatcaaccgattacctttatatcattatctacattggacatatagccgattgcttaaaccctattgctatcggctggtatcggcatcggctattattggctaccggccggaactactccatcaggttgtcagccgatcggctgttttgatctactatttgcatatcttgtcaattgcaggatcaaactgactggcacacccacatctcatcatatttggacctgcactggagctaagcagatctcccaggccggtgtgttcgattttttcatcaacaggcctcctttgaaatagagaaatttcatgaaatttgtgagaaaaatgattgtttcccgtaagaaaaatcctatgaaatctccacgagctaaaatctctgacagtgtgttgcacagccgggccatccccctctaccccatccactccgaactcccaccactaatccgaagcggctcccacgcccgccgccccgccgccacgccgccatgcggctactcccctacgcgccgtcgccgcggccgccgcagcgctcgctcgccacccgcaggaccaagccagggccgccgtgcgcgctccccttccccgacgccctccgcgccgctgccgcggccacggcggccgccatgtccatctccctctccctcctcaccggcgacgccgtgggggcggagcggccgcggggccccgagctctgccgcgacggggccgccgccgagaccaaggaggaggtgaggaggagcgaagtggtgacgaacgagcagctcgtggaggaggcgtgggaggtggtcaacgaggggttcctcccggacgccggaagccgtccctggtcgccggagatgtggatggtgagcacttaacaaatgattgaatatgaactatgaagtggttcaattgcctatatggaagtctctttgtacattaatggatttctagtcggaatggccagtcttctgaacatattttatcctccatagatttatctcagggaaacgttatatcttgaatatgctaattggctaattgcttcgcttcaatgcaatgcagaaaaagaagcaagatattgtccaaacctcaatcagatcccgttccagagcccatgatatcattcagaaaatgctggctaacctgggtgacccatacacaaggttcctgactccctccgaagtaagtaccttacaaatggcactgttctttttttggagaatgacaaatggaagctcagcatattggagaaaacatcatcctattacacgagtagaactgtacaacttgttttttttaaagagagaaagagaggagagagtatgagcctgaataatttacatttcccaacatgtttagcctacttatagtcggtgggtccactaaatgccattccttgtttctcctagtgatccatggtttttgtagcaattagctattctgacattgttgtttctgaatttagtgctaaagttggcatgaacctgtttttagaatctgggttgaccatgggcctcggcctctcgggccaatgctcatgacaccattatttttttaattggcaagtcagaatcgtgtgcaaatgactatatattgaccatcaaaaagtttttgggatccctgtgacttggacctttactgccaactattgttttgcgtgacttttacacttagggaatagcgaatttgtgtcaagagtttagacaccagaaaactcaacgctccacaatgatgaaatgatgatattacaaaaccattttttgacgcatttcctttgtttcactgattttacttattgctgattttgcatgaagatatgctatatcttctaactgtacttcagttctgatgatattttgcatgtgttaaatcaatctggtgaagttctccaagatgtcaaaatatgacatgacgggaataggattaaacttgagagaaattcctgacggcaatggctcttccaagttgatggtattagggctcatattagatgggcctgcccactctgctggtgttagacaggtatcaacaactcaacatatatacttttcaattagtaggcatgcttttcaatcataacattggtttgattgactatttaattatttttatgttttatgtaattcctgttgatagtattcttatcacagagaactgttgtttgtcattttttttgtatgaaatactgtagtcttatttagctggtttttggataatatgcacatacttatctttcctgtcctgtctttttatctcttattagggtgacgaacttttgtcagtcaatggcattgatgttatgggtaaatctgcatttgatgtgtcatccatgttgcaaggtccaaaagatacttttgttacaattaaggttatgaataatcttataaacatcatacttgtcttttgcccagaacttctttgcgctccttattataactatctcaatattgcttgtatattgtataggttaagcatgggaactgtggtcctgttgagccattgaaggtacagagacaactggttgctcgcacaccagttttctatcgattggagaaaagagaaaatgaggattcagctataggatatattcacattaaagaattcaatgcagtggccaaaaaagatttggttagtggtgtgttgctggtttgttaaccttatcaactttcattttttagctgcacttagctgcattgctttcatagctgaaccgttctatgcatagaacttattgcaaatggccatgtagtatctaattcttaagccaaaactgctatgcatgtacatataactattttcctggctcaaactgtgagcatcaggagaacaacttaaaatattgtttccccttctgcaaattggccatctaacgatgctatttcagaacttaaaatatcgttttcccttctgcaaattggccatctaaggatgttatttctgctgattctgtatgaaactattttgatgttacaaaattttccgatattatttgttgatattccattaaaattattatcggtagatataacttaatataattacattggatggtggcatgttatatccactaacatatgttctcttgtgcagcactaaagcgtctacagaactcaggtgcctcctattttgttttggatttgagggacaatcttggtggactagtccaagtatgcttttttcatttcaattatataaccatgtcagtctttggtctgctaaacaaaattgtgtttgtgggtgccattcttttcctttgaagttcttgagttgtaagcttcttgaaacagttgaggcttatgcatttggataatgaaagacactgatataatttatttggatggggttattcttactcatggtacttttgtttactttaaaggctgggatagagactgcaaagctcttcctgaataaaggagacacggtaattttttacttgcttccatattttgtcaacttctagcacaatatctgttacctgaaaaatctgtccatagaagttaacccaaccttttttttctacataacttcttttaaaatccatcaacctttttgtgcccacctcagctaaaagttactgttcatggatactacatcaaaatgaaggtacttcctggctaaaatggttctagtttaggtttgaacttggaaaaatcaagccatgctagttttttttatgttttctcgaaaacagttattttttatgttagacatgggtttggaattataaattaagagcttgtagttacaattcttgatatgcatttggatagaatcttcgttgaaattcatatacttgtcctgtgcatattaaaaagtttgagggctttcagccaggcatatgattgactaaactgttgttaattatcctttatatcgtgaactgaactttggaggtgtacttttcttaaagaagaactgagatgtagtatttatgcccctatggaacttcttcaggtgatttatactgctggtcgtgatcgtcaagtacaaaatacaattgttgctgaaagggaacctttggttactactcctcttatggtatgtatgctattgtgatgtacatgaacctatctagccaattcaactaattttacactgttacatgcaacagaaagcgaagaccgacaaattacacatatacagacacctattaagttgcacatacagaattctggctttcctattctaactttgacagtgagaatcatcaagctgtagggtgttttatgatttattcatgcccatagttttttatttgcacttttttgatcggctgatttagaagtggaatgatacagatccagttaatcatatacgtaccctttactgaaattttagctgaatcatgcttctctcttttgtctgctataataagatctccacatgctcattgtatctcacatatccattcacaacttcttcataggtacttgtgaataacaggacagcaagtgccagtgaaatagtaagtaccaatttaactttactggtagtattagaatagtatcagcatgagctcaccaatgcactaacgcttttctaggttgcttcagcacttcatgacaactgcaaagctgttctggtcggtgaaaaaacttttggaaaggtttgttaaaaaaaaacacagcatatccaaggaaaagcactctctgtgaccaactggcttatactatgccttggatgcggcagggcttaatccagtccgtatttgaacttcatgacggttctggcattgtcgtcacagtgggcaagtatgtgacaccaaatcacaaagacataaatggaaatggcatagaaccagactaccgccgcattcctggtgcaactcacattcacccattttcttttgttccactcatgtatataatgcagttaacactgaatttcctgttgtgacagatttcaatgaagccaccgagtacctttcacgttgccgaagcaaagaattaagctgaatgatgtggtttattctgaagctcctcagtcagctgtaagaaatttttacacttgcatgttctgttcttactgttgaaaattcttgatctgcaatgagtcattttccttgtgataataaatagaaaagacggatggaaaactaataatgcttgggtacttgttgcaacgatgaacaaatcttggttggctgactgtacttagcttcttggtgcttgcagcaatagataagaatctagctgcttgacttactgatggattgatgaacatggtccaaagagaaataccttcctttgccactttgattggttaataccagttattagtttcacaaaattgacaatgttaatcaataaatcatagaggtcttctctagtgggagtaagacatgggcattgggcacgcacactttaacttcacaatactgggggctactgtctacacaactgagtaggccctccacttacgatgaaatggtggccccggtatatgattctccaccaggtgtagattctagattgtatgtccccatcccataaggcgcctctttttgcctgcttgttgatgggtttggacctactgatgagcattactgtccgcgttaacttttccagctcttatctttgcagtgtgagatgaacagatgaacaactagttacagacttggaccataatggatgcttggggttttgtacaatgatctctcggttgagctgagagctgagtgctgaaatgataagctctacctcgagcgtcggtacaagtttgaaccactctggagagcagccgtaagcatgtagaatggcttctgctgcagtgctgccttcagtggaggatttatcgaagtcgcccccctatattcgctgatttaggcgtctctaatcatgatttgccttgacaatgctctgaatacatcaacaccaatatgtaaatagcttttgttctgtagtagtatgcagcaaggtcatactgcaactttacttaaaggaggtgtatatctgcctccgcacagaattgcaagaggggcatacgacgcgagaaaaatgtgatttttctatcgcaaacggatggtttcgctggaatgctatcccttcaaagtgattcattaaaatgctatcctaaactgaggggtgttcaccaaaatactatttttggtctttttgttaatagaaatgattttgctctattttagttttcttgtgaccaaaatacccttccctcacctgctcctccccttccctctcccttttctgtttgcgtcgccgcattagtctgctcgtgccgctgccctccgcatcgtctctggctccggcgccggcccccgacgctcccccacgtgctcctccccctttctgctcgtgccgctgccgccccagtcatctgcaacagctgccggcgcggccctctcctcctccttgctcgccgcccttcacccgctccaccg

SEQ ID NO: 28985 - DNA, 25128 bp, Oryza sativa
gcggcggagcgaaggaggcggctgggcggggcgggcggaggccggcgagcgggaagggggagagcaacggccggtggccgatggcagtggaagcggagcgccggtggccggaggagagcagtggccggcgctccctcgagagagaggaagaggaggagagagtggagagagtatgataggtgggcccgtatcaggggtattttggtccggaaaaaagttaaacttggagtaaaagcatttctatttacccaaaagagcgaaaatagaattttggtgaacacctctagtttagaatagcattttaatgaatcaagagggatagtattccagcgaaaccactcttttgcgatagtataatcccaattttctcaaaaatagtattttctccatagacgcagagctactgtttattcatccaaacttgttttcttcattagacatgaaatacacgtatacgcatgccattatcccaccggaaaatggtacacgtagcaaaaataaaatacagcagtgctatgcatgcttaaattttcttttcttacaaacttcttgttgtaaaatgtttgtaacaacaaaaaaaccttgcaggtgcatttttccccattcaaagtataaactcaattcggttttgtttgattctcgtcttgctaactctgtttggcacaactttatatcagtagatttgaagtttgtatgttaaagttatagtaatttaatatttaatattttttttctaaaatagaaacaaaataatttattaaaatattattaaagcaatcgtatatctagattcataaatttatgaagctaaaaatattatccagctttaaaactttttggggaaattgttgcagtgtttagttcctttcaaacttctaaaaatcccgtcacatcaaatgtttggacatatgcatggagtattaaatgtggacggaaaaaaaatcaaatgcacagtttgcatgtaaattgcgagacgaatcttttgagcctaattacgctatgatttaataatgtgatgctacagtaaacatttgttaacgacggattaattatatttaataaattcgtctcgcagtttacaggcggaatctgtaatttattttgttattagtttacgtttaatactttaaatgtgtgtctgtatactccccccgtactcgtaaaggaagtcgtttagggtaatgtttaagtcaaaccttgggaatataaatcatgaataactctaaagttgttgagtttgaaaatgtaaaaattatatgaatagatttgtcttgaaaaatactttcataaaaatatacatatatcacttttcaataaatatttttatagaaacaagaagtcaaattatgttttggagaccgtgtcgctgttctaaacgacttcttttatgagtatggagggagtactttaaaaagaataaaaatttggtacacgaattaaatacggcctgtgtgaaaaagggctaattcaaaaatggaaaaaaaaacacatatccctatgtcaaactcctggcggtttacgaggacgtggtacacgtttcatgtacaccgcacagcgtatctactggagtactagtatccaaagctcagcgaggagtacgtgtgccggcgcatggggtagagaggctgagacatttgcaaagcgaggtgaccgaccgcgagaagcaaagcgagcatttgcctttgcatccccttcccttcccgtcttgaagcgcccgctccgctcccccacgattcctccttcctccacacttccacagtctccggcgcgctcccctcgcccactcttcttctctttctccctctcttcctcctccacctccagggctccaggctaaaacgtcttccccgcgggagtgctaggttggctctgcgcgtggggcccgcggggaaagctcagtggcgcgcggcgggtttttggcgggagcgggacttggtggccggtggcggcgctgcctgcgggtgtcgtgccgcgatctgggctccggacacggtgtggcttttgccctaccttttccaattcccaaatgcttgtgttgtagtacttgtatacttgcatccggacttgtagcagtagtagtttctagtttgtacttgtatactgggaaagtgatttcatcccctcgtttcatacatgtcatgtcacctaaatagtcatcacaaatttgaaaagatttggcaacatagattaatatgaaatatatcactccacaaacatgcaagtttaaattcaaattctacaagttgtaacaaaaataacaaatatagctgcgaatgtacaataactattttcagtttaatttgttcttttgttgcaacttgtagaagttgaatttggtcttgcatgtttgtggagtgatacattttatattaatctatgttgtcattttttttcaatttttttgataactatctagatgacatgcaaacaacgaggggatgtccccttgagggatgaaaatccacatcctccgcctcgtcgctatgattctcgtgttcccctatggtacaactgtggtgtaatgctccagtaattagtaatccctccgtcccaaaatataggagcctagtatactgaattacacacatccgcggttcgcctgttcatatttgtagtactgggtgtgtctaattcagtattgggttgctatattttgggatggggaagtagtgttattatactgcatcattttctcatgcagcaagtatatttgttaaaccatcccaatgggagttgtttgatcttttggcccaatttctcaactgattgctctatacactttaattgtactagaaatcagtatttacatgacataatttcctgatgaatgtgcatctctctccaacatacagaattggagcggacatggctgatgtggagggccaacagcctcatcaggtcagtggtgtgtccagggcacaagacggggttgccaaggtgagtttggggaaagagcatgtgccaggaagcgagctctggaccgacgggctcatctgtgcttttgagctcataaagggtcacaagaagctggttcagcacaaatcatggccgacgattgatagcatgcaggagaaagaggtccctatgcatatgaagcggcacataagtaggaacgggcatcatgtcgcaaccatgaaaccagaagagtgcgatgtggtggagaatccccgccagacagagtttgctaatgatccttctctgttcaaagataggccggtgcatgtcagggcaatcctggatcacaaatgggtgcctatcggatggtctaggattgctgaactggtccagagggttcagtcagatgccagctgggatagtgagccggcggagatgaccgacagtgaggatgattacactgtagctgatgttgcagctccatactggcagcgtccggtaggacctacatggtggtgccatgtcactgcaggccatccctcagttgacgcatggctgaatagtgctcactggatgcatccggctataagaactgcattgagagatgaaagccggctgataagtgatcggatgaagtaccttctctatgaggttgtctttcttattctcatttttccgagacatttcataattttatatacttatttttcttccttcaatctgtccgttattcaagaccttttttaatcattctacaattgaatgctctgcaatctgcgcggtgtacacattatctgcctgaacttctaaacttgctgtagcctgtactgttttttctattctataccttttcatgtttcgtgaaaaaaaaggaccaactcctgagctgttgtaggtttttttttctatgatcatggttaactgtgaagacctttagttttagaatgaatatttgtgattttgttcaagagcacacaccgacctttccacaatattctgaagacctctttctatgtggaatcatttcattgcttcaggctattgtatgaaatactactatcaatttatcatcattccctctaacccaccctcttttccttgaaagcattaacataacaataacattatggcctaactgggtgggtcaagtattatgggtctggaccaggctcatgcgttagtttaggcatgataaattaggaataagtcaaataaagataggaggatatctaattaggaaagagatgagatttgttagtaaaatagagatagagattggattggttcctataatgttggcccatgtccataacatcgagactggcttgacccattgatttgtcataaaacttttggacttatcttagatctgtcaaagtcacctgcattatgtacaggtattttcatggattttctttacttaatgggttctatacttctattgaactgttttttttctatattcatataatattgccaaagtagtctatcatggagtcgatgcatatatggttatgataactgtgccctgtcaacctgaatagtaggcagcaatatttactgtttggtcaaatcattcagcactgtttttctctctaagagttctatggtcttattatgtgcaaatcagtaatttctcaaactatgctgatttggtctgcttccagaacagctaaacagcctgactacttcatagaactactcatgtgcattttagatgcataaaatagtttaatgtctattagaaagtgtgatgatgctctatcagatgtgcacatcagatttattctataaacttctgttagctattcaggtcccagttagagttgctgggggactgctatttgaacttcttggtcaatcagtcggagatccaaaccgtgaagaggaagacatacccattgtgcttcggtcttggcaagcacagaactttcttgtgaccgcaatgcatgtcaaaggcccttcatccaatataaatgttttaggagtgactgaagtgcaggtactccttttgaaacaaaggcttatttgctggtatgaactgaatagtatttagcttgtgaatttttcatcttaaatgcttgtggaactctgtgcaggagttgcttagtgctggtggaagtcaaacacctagatcagctcatgaagtaattgcacatttgatcggccgtctttcccgatgggatgacaggttcattctatgttccaacttctaccactaccatcattttcggtttattttcttaggatgtttggtcatagagataaaatatccatcaataagaaaaaaaaatcttcgtttgttctgtgtaatcatgacacttcttttttttacctcactcaaacttatcataaaaaaagtttctatatacatcaatagattgcacttatacaggtttgacccatcatactgctatttactttcttggatttaactttgaaaatgaaaccaaacacaatgaaattcaacccccaaaataagaacaccattggcctatattttaatactatgttggctataagcttataccttatattgccaaaagaaccacgacaaaattcaacacccccaaataagaatctcattggattttatcttaatactatattatactgttgattaacttatgctcaggcatgccaaaaggacccttggtgttctgtttatctgcataataaaaaaaatgatttgatatgaggactttcaactttcaagagcaatttgttctaactatgcattctctatattccattacctcctcaacattactgaacgtctactgtctagtttgtaaaagaagatgcatattatttgctttaggaagacaatttttgttcttgataatgataagattgagcataactagtggaaactagtatcctttttccaacaaataataacaaaggtaccaaaattcaagttgaagaggacttgaactacgatgggggcacaatttatactcaattttttttcttgattaagatgttattatagatttttatctagccatattaacttgcccacagcatttcttttatcaggaaacctaacattttaatccattttagtcattctttcttttatgcctgcaactgtacttgctgtagcaaacaatggtgtctactcatggctaatagttgtgttattttatttcaggttattccggaaatatgtctttggtgaagcagatgaaattgaactgaagtttgtgaataggtgaggaaactgaacaggcatatctcaactagcagagcatattatttgaattgatgggcctgtgccctaaaatgaggtgatttcataacattttaaattaccttacatattcaaagttccaaacaaccatttcgcaggagaaatcatgaagatctaaatctagtcagcatcatattgaatcaagaaatcagaaggttagcaacacaggtaagtatgccaccctaatttgccttctatatataattacctcattgaaaaataaaacaccaatttattagattggccaatgtgtcgtttctacttgttgaagtataatgcacaaaaatttagatagggtagatccaaaataggaattgaattacatgtaggaacttctattcagataagtgtgcaattgtgaacagaatagtgttagcacattcaagttccacgtggcaattgtgcatgccattctctttttttgatacataatgatcatgagcccgtgctacaggtaatcagagttaaatggtctctgcatgcaagggaagagatcataattgagctccttagacatttgaggggaaataccacaagagttatcttagatagcattagaaaggacacaagagaaatgttggaggagcaggaagctgtccgtggccgcttgttcactattcaggatgttatgcaaagcactgttcgagcatggttacaagtatgcaccgagctatttttcattcttactgttgacttgacttgtaattgatagccaggttttgctcttctccaggatagaagccttcgtatcacccacaatttggctatttttgggggtggcggcatggttttatccataatcactggcctttttggaatcaatgttgatggcataccgggagcgcagaatactccatacgcttttggcttgtttgcaggacttctcttctttgtaggcttcgtccttattggggtaggaatactctatcttgggttacaaaatccagtgaccaatgagaaggtcaaggtgaggaagctcgagctccaggatcttgtttcagcgttccagcatgaagcagaacagcacggcaaggtgagggaaggtctcagccggcacagctcgtctcctaagtcatcatcggcctctaatgtagactacgttctaatttcttaaggctgtgaaattaatccccttgtgggagggattcactgaacaaggcctaaaagggattggaaaaagaataaagtacaaagagatttgacagaaaaaaaaaaggatttccggatagaagagttcttggtaaggactaaagtataagccatataagtatataactatgtttggtgatctgtatagaggtttagattagagtataatggttaacttgatatgctacggatatacttgtgactgggaaggattatcactgaggaaaatgtgatcgaaatgctaataaatatgagtaacgagttggcctccttttctgtataccaacctgaggtgttctgccattgtactcggaagtccgaattgagaaaggatgagtcaaaatgtcttgaaactagggctgcgttctttgtgatgagttctgggggattgggggagaaaaggacatcgtattccatgcgcacgcttcttaaactactaaacggtgtattttttgtaaaaattttctataggaaagttgctttaaaaatcatattaatccatttttaaaatttaaaatagttaatactcaattaatcatgcgctaatgacttatctcgttttgcgtatcttctcaatccccctgtgctcaaactcaccctagatgaaccacggggcacatggcagaagtagatttggcgtttaactatttttcactcatatgttaatgacatgtagattccttatgtgtcaatgacaatgtgagtcttataaatagttaattgctacatttaaaagaagtaaatggttaaatatatcatgctcgtgccactggtttaaatgatttgcgttgacgcaatcttgacatcgttaggttgacgcaatcttgtcattgcatgatctgcatcggcactaccagtagccctgcactcactgcatgtctgcatgtacacgaaccgtggataaaaaatcgattgctacgactacccggtaaaattaaaattgccgctaattaagtaggttaccaaactctttccagagccatgagtacacttttctagcctaaagcaaaccattagccattgcactttcagagtcgaatcctcatcgaatggtgtgtctggaaagctatgaaatggaaggagtgcaagtaggtgagggacaaaaggcgccaatgattaacacacacactcaactcagtccttcaaaagaaaaaggaggaaggtggcaacacttgcaaaacaagcaggcactaatcattggtaccctgtaatcatgtgcatgcatgaaaaaacaaatcaccaaggtgcaaggacgaaacaactgcctctgaattttagctatggggaggaaacatggaactatcttcccagaaaaagttctctgctcatctgtcagaaatgataagtgtgagaagatcaccatgcatttgcaactgtgcactgctttgatccaaactagtaatggagaagaaaatttgcgcacatggtacaccaacaaaactttgtacttcatggtaaaactgaggatcgacaagggttctttacaagggtaacaaaatctggttactagtcattcatgccttcgaggtcagctcctcctgataacttaaacggtatagatgaagaaggtgcttctgtgctcccctaaaacaaaactacacatatcgtagagtaaacgagttggaggactcatctacagaaaacatagtacggcggatattttaggggagcatagaagcacttctcgaaaagaagaagaagaagaaaagaaagggaaacgaacgattcctatgcctttatgtcttccagtctttgctaaatgtaaacctgttgcaatcacggtattgaactatattgaatatttgaccaaaccagacaggataatgaaatgttttcatgtcctattttctgtatctgttcagcattggagcctcaggaatcggcactgtttgagatctcctccgcagattgctgtgactcgacatcgacgcttcccatctggctgctgggcctttctgatcctgccaatagtaaaagagagaaagcatttacttgttagaaacaaaatctccaagaaagatgctcagttgtgtaaaacaaaagtttgaaaaacggtgacaaaaaatgtactaaacgtacttgtcgatatgcattctgaactgcttcaagcatttggacaacatgactcatttttggccttttgtcagcatctggatcaacacacttcaggccaaccaagattgcccgcttaagggcacgttttgggggcttaatctcaaggtttggatccactacttcctccgccctcttgctgctgatcatcattttaagccattctaccagatttgtctgaaatgacataaaaaaatgacttgagtactagatgatagactggtcattcaaattgtcgaaaaataggaaaagcttctacctcatctgcaggtttactgtaatcaactgggtctctagcagtcacagattccaagagcacaacgccaaaactgtaaatatcactcttttcatttagcatcccgctattcgcatattcaggtgcaacgtacctaacaacagattaagaagaaaattaagatgtgcttttttccaaatttacagaagacaaataaaatagaacaaacatggtgcaaaaaaaagctatacccatatgttcccatcactcttgtattgatgtagctactatcagaattcagtagtttggccaacccaaaatcagaaaccttgctgttaaattcatcatcaattagtatattacttgacttaatatctcggtgtacaactttggggtctatagcttcatgaagatatgcaagcctgaaaatcatgaaactcatctacattagcatgtagtagtattgatctttaaaacctgtatttatgtgagaagggtaaatttcatgggaaataactgcaagtaaggtccagactgtgatcttacgcttttgcagtgccaaggagaatcttcatacggttttcccaagtaaggatgcccccactcatggccccatgaagccattgttctaggtttccattgttgacatattcatagacaagcatcctgcaggtgaatattcagaaaaggtcaatgtacagtgagaaacaagggaacaaggaaaacacatattgattatgcacaagggaaggaacagaatttccatcttatgaaatggataattcattttcccttttgaaccttaagaacataatgcttagtatcacaatgaacttgcacatggtggattcgtataaactgggctgagcagcaaagttaattatgcagaacaaagggaacagagaggaagaaatgatcacctgtgtatcccttccacacagtaccccagaagtcgcaccagattcttatgccgaacgtgaccgatggcttcaacttcgactctaaattccttctctgcttgccccctgcaaacccagcaaagaaatcttagctccaagttaacatacagtaaactcactaaggcaatataaacttacacattgttaaggatcttcttcacggcaacttcagtcccattcatcagtcgacccttgtagacaattccatagccaccctctccaaggacattactctttgcaaaccggttcgttgcgtactcgaggtccctcaaggtaaaccagtgaccccatcccaaatgtgatagctcaggcaacccaaccagcggtgaagcggacgcatacccatacgatgaactgcctttcctaccaggcccagagctgctgtaatcttcagaatatgagctcccagccttctctatgttgtacactgagctgcattggctgaacgcgtcgacatcgacagatctactctctgccaagtgcgaaacacccttcatctgttcatatttatcctgcactggcatgataggtgttccactgtcatgcaggctctgtgcatcaactctgtcaacattgatatctttcgacacaatagggatctccatatgtgatctcccgtcgaatccaaccgccgtcttctttttcctccgcatagagagccacaatgctatgatgaacaaaattgccatcagtatcccaatgccgatggcaatcaggacccaaactctcaagcgaagcacgggtgttgtctgtgacagtgctgaactgatggagttgctgtcggacgacatatctatccttcagtctatctaagatcaagaattgtatcagagatgctctcacaaattcagaatcttgcacggatttgccagctgaatttacaaacttatcctggtttgcttttatctgttaaaaaacaaaaggtactctattacttaactctgaaacctgaaccagcacatgaacagaactataaaagtaataaagctgcgcgcatatgatggcccaattcttccatgttcagggggaaaaaatattatctttcatatcactgtacagacaattcgcacaagcaaactaatcaaacaggaaaaaaaatgtccatttctgggtcaaaccaccagcgaggcatggactcctgatgggactcaaaactctgaactgtttattcaacaaccacgcctatataaaattattcaaatgcaagatacagggtgtccaagaaagaaaaaaatccgcacaatgcaaattgcaaaaacaaaccagaattctaccgacaccacccccaacccacaccggaaatcccaaagcccatcacaattccaagaggcacagagtcaaacacctcccaagatcacagatgccgacgttcccccaacaaaacacgaagaggaaagagaccgggagattacctctgcagcgccttcagctcatccccattggccaagaatcccatcaagaaccacccccaaacccgtcgtcagagctgcaaaagaaagggcagttcttgcccgtgtgtgtgtgtgtgtgtgtgtgtggagtggagtggcgtgcaccggaatgcgcaagaagggcgagctgcctttgcttctttgcaagagagagagagagagagagagagagagagagagagatggaggagacggaaagacgagcactacagcacacatgcacacatgaagagagacaagatgaagctagagagagagagagagagagagagagagagagagagtaaaggagaagcaaaggggagaggggagaggactataggagaagaagaggttgcagcatttggaattaaagggggaggtgggggtgtggaaaaggagagagagaggagccattaatcaaaaagaaaattgcaaggaggttgttatttggaaatactctaataaagaaattaggagggaggaggagatttaattaattaattaatcagtcaattaatcaattaattaatgcttggggagaatggcctgatggttgagaccagcatgtggagggtgaggggagggaagtcaaacgtgctgaggaattatcttttgcttagttggaaatgcaaatgctttaatctattggcattatgacaatatcttgctttttttttcttagcagagcatcggggtgcgccttcgtcggtttgttgctagcgtgttattacgtctgtaatggacattagtattgacgtggagtagccgctataattactatgacgtgtggtcaatgcagcctgcgcctcgtacatcgggcgggtagatttggtcgtatgcatgttatgtgtgtagttgtgaagatggtttacgtatgttgctcttatgataatcacataacaacttgacatagcttgtcgctatgtgttgacatgagtaggtgatgaagtaaggggttgtaacgcatgtatttattttttttataaaagcattgacgtgatttttttattaacctggcaatacgacgatatctcgcccttttagcgaagcattgggacgtcttctctaatttgttgctagtacgttatttcatatgtaatggacgttagcgcggatgtggaatagcagctatgaattaccaaaatgtgtgaaaaatacaatcaatttagtgtgcaatacaatacaggtagattatgaccacatgaatactatgtgacattataggggcgatttacggtcatacatgatgtataacgtgagtacataatgaaataagaatggtaacacgcttttttatcagtttttattttagcaaaacattgacttgcctctttggttagcaggtgccaatcatactatcgtgacgcacgggttccatgcagctcttctcgttgataaaacccctgaatttgaccagatgcttatgtaatgcgtcatgctcatgacggtgaagcttcatgttatgcatggaaccaatcttccccattgcaaaaccagatagccagcagaagaaacgcttggaaagctataattacattgtaatttgtaaacaccttcggagtgttgaatcatctaaattttctttagagacacattacatgatttgacggttgacgccatactatttcggctagatgagtcttctctaacgtactattctctaacgtgagttactcacatgtgaacctgttagttgtggaacccatatatcatcaacttaaagtgagagggtagtatggcggcggatctgttatcgttcctatttcgattgtatgcaaattcatcttctaaaactcttcatgttataatggcagcgtacagtgcaatctcaaatatatatgatcattggggaaaaagggattcataaatcataataattaaagtctattcactgcttagcatcattggtaccatggctgatagctgactactttgaatgtctgttttcctgtttgatccgacggatgagattgagctggtggcactgtgttgtcactgtagctatccgatgtgcttgagagtccatcaaaaatcaatttgctgtctttccctggatcctattaattgccaaaaggacgccattttcccatatagaaaaaaaagacaccattttcttgggtgtacttgtcgttggagagaacaatttgattgtctcgccgctttagcaacatcttaaaatacaacaaaaaaacaattctttgctggtcaacttcctgagtcctgacagagacgcgcttgagatataaaaaaatgaaatcctatactattttgatcagtctgcagaaaacgaaaatgtttttttttcagtccggtattgaacatgtttagcacgacaaacattgagacagaaaagcaaattataaaagctgatgctttagcctaattcatgtgacgcgtactcgtaccgatatacataggtaagctttacatcaataacaatcgagttgttgagtagggcatgcatatatgcaaaaatgcactttatttcctagctagctagcttagctagtatgctctcatgacagtgcatggttaaggaataaggaggacataagttctttcggtgcagttaaatactcttttcatcaccaagaggcgatatcgatcaagcccccatctaatccggctacgctaaccttaattaatctcgtctgttgcctgcaactacgggtaattaggccattcgatctcagtcagtcacagtcaagtctttggagaggattgaacgcctatgaaaatatataaaaacgacaattttatgtactacttcgatctgtgaatgacctgataagttagtatcactattttatttgcactcaacaaatgttaggtgttggcaacatagcattgcataattgcgctaactttattccaggctagctacatgcgcacgcctagagttggttacttggttagttgctggcttgctgctcccatcatgatcgtctttaatcatacgaagcaggggacacacttcattaggcgcccctaaatgccattatggccaagggataatcacagttcaggcagaggccccagaatgcaatggccatatctgattatctgtcgccttgttagctaccactagatatatgtgataatactaacttctttgaaacaaaatatcagaataaatatcagtttaagtttgatcggatttataaaaaaaaatcatagtaacatttctaacacgaaacagacattttattataaattattcaatgttaggtttgataaaaattaatttgatattgtaaatgtttttaaatatgtctataaagtctatcaatcataaaaaaaatgtgactagaaaaaaatatttattaaaacgacttataatatgaaatgatgagagtactatttaaaaaagttaattgtatacatgctattacaaatatgccattttagaaaaaaaataccactaccactcatttattcatattcatgccatccaaatacgcacaaaattagaaccataccatcacctgatcgccatcacatttttttattatatagaccaaaatatctctagacatgagacccacatgttagttccatgcatcttctaactccatccttcactcttctttttccttatctctctccacctcgttgagccaaaagcataggtcgacgagagaggcgaatggaaaggcaacaaccagcgcaatgatgaagcgctggttcccatttacccactggcctgagaaggaaggagggaagccaaggccacccccgctcgagctcattgctatgccgccacccgcaccaagctcctccctatggccccacctactcctgacattatggttcttgccaaatctaggttgatgccctccctgtcgccacaagctccgcccgtcctcgtcacatcatcgtctttgtggctgccagcgggaggatgaggagccccaagcccgatgttggagatttggcattgcaagacacgtgacccgccgccaccgtcgttgtcgggcactgttgtcatttgctccacaggggagaggggggctagagatgtggggcgacaatgacatcaacgttgttgttgtggctggccagcaggaagggaagggagagagagtataaaaagaaattggggaagaaaatgaaaagtgtgatggtgttcaattttgtacgcatttggatgacatggatacgaatagtagttgtatttttctgaaatggtacatttgtaatggcatggatctaattaatagcccttgaaaaactatctatgccgacctatacttattaggcactttgtataatctcacacgttaattagaaagaaaaatctgaccattgattacaaagaacatacctttttagataatagaaatgtgttatgtctccagcctctgtcatatgacataacatagataataagttatttagctgaaaaaatagtaggtgaatggacaaacccaaactaccctaacaaagaaaatcaactgataaatttaaagaaccacataatgtgattataataagtaagcttataaaaattgcgcctcccatagacagaacatattatcatgataataaattctaatttaacattgtggaccacgttaagaacccatctattaagatttatagtgagttatgttgactcactgttcatgatccgacaaaatccccaggtgaacttggagaaaggaaaatatgtggtgagagctgatttcccgaaatctacagcaatccaacgtgctcctggagcggaaaaccttcgttgggagaggccgaggaatgggtggatgaaactaaatgttgatggctcctttgacatcaactctgagaagggaggtatcggaatgattctcagaaattgcctgggtagtgtgatcttcagttcctgcagatctcttgacagttgcagtggccccttggaagccgaactgcgcgcgtgtgtggaaggtcttcacctagcgctccactggtctcttcttccaatccaagtggaaactgattgcagctttgtgatccagctcttacatcactcagacaaagatcgctcagttctcgctaatatagtttaggaggctaaactactaacggctggggatcagcaaatcgccataagcaaagttcagcgtagtcagaatgttattagtcactttttagcaaacaaagctagagctgagtccctatctagtctttggcttggagaaaattgtacctttatcttgcattttgtctgcgaggactgtgattaatatattctcctttccccgaaaaaaaaaagaacccatctattctacacgttgtgaaaaattgagacttcaaactgaatactccaatttatttattattattattttatatataatatcaatataacaaataaccgtgtaccgacaagtcttgttaattggagatcaataaataaacgtctaaaatatgaaaactatcatcatgcacgacaagctgatcgaccagtaaccaactggccgtttggtatgcgtgtgggcgcgcgcgcggccgcggattgcgggagtaggccacctgctgccgcctgccggccgcggcccgcgtttggcctgcaaattttcgtcgcggcgaccgcgagacaccgagtgaccgacagagcgcgacatggcgcgcacctatgaatcccaggaatccagcagcagctgtttcttttcttcacctgaccgacgtccagctatactgaaactataaaatcaacggccttgattcggcctcagcctcgatctgtattgggcaatgcgttcactgtacggtcgggattgatgtacggggggagcaggctaatcatgccccttgtaggttgttgctgtgtcggcctggttgtttggcgtcgattcttttatagtttgggaattttgggcgtttttttaatatatgttctcgcaagctggaacctgaaagtcgtctggtgtgacgatgcccagctgtatatctgttacttcctccatggtaagttataagattttctagcattgctcatatatatatatatatatatatatatatatatatatatatatatatatatatatatatatatatatatatatatatatattcatgaatctagacatatatgcatatacgtctaaattcattaacattcatatgaatatgtgtaatactaaaaagttttataacctgaaatagatctagtttttatttctttactagcacaaaaaagaaagactagtagctaggagggtgtatgtgccttcatgcttgctgatgatttgagatcgacggggcagcaataatgtactgtactacactatagtttactcgtctcaaggaaggaaaatgtgcgtcctaacagcttttgcaacttctaaaaaaaacagcttttgcagaggaggatggattcattggaaaaactgactagttatcctgtgggttgtccggtttgatttgcttgatgttgtttagttgtggtcttgaggactttcagggttaggtgggggggcttgcagaatatactaagcttaaacgctcgtcgaggtgagctgttgtcacaatgccaaccaatctcttcacttcacgtgcccttttgttttgcttggacattcctagctcccctcgggtttacttggcctgttggccacatgtttcttttctgtccattgggagaacaaaattgatcttacctgatttatataacccggaaaaagggagaggttcaagcagaaggaaaaaaaaaacaaaaggtccaagcaaaaggcaaaagttcacttaaccaggcctggtccctgatctaagagtcgagttataatcacgtcccttaaccacgaagcctgatataagtatataacatacatatccttccatcttttaaaaccggtgtaaaccaagtccctcggcactagtgagagtccaagcaaaaacgcgagaagaaatcccaaagtccgtatcatgttgcattgcaagtaactacaatatcggatatcttgaaaatccaagtattgaaaccggtgtaatttaccccccccctaacggttttggaaagcggttctattgatgtggtgctttgacccggtccaactggctgactcagcgtgcgggacccacatgtcagtgtcacatttctctcactttccctctctccttttctactaccacaacagcgacgatgtcgagaggccagtcagcccagacagaggtgcgcagatgacacagaagctcgcacccagcgtggcccaagatagaggcagagcagcaacgggatgatcctgacatgtagcagtggtagggccttgaggctcgaggcggagcagcggcgtggcctcgttcggcagataggagaccctgaacgctgttactgcttctgtcatccaaaggcagctgcgacgccgtcgacgatgatggaggtcaccatcgaaacacgggatgtagggtgcagggagctagcagcgtgcttttgtcttccttctttgcccgacggccaacctccaacacccaagccgcccacttcatcggtgcccatcaatcgaggaggcatggagctagcacaggtgctgcgaggaggtgcaacctcgtactccagatccgtggtggctccctccccaatggatccgaccatttatcgctagggtcgagtccgtcctaggcggtgacggagttaggggggcaagcttcgcctcgagcttgtcaaacacctcgttgaagtcgatcaatagcaggtagcggggcagcgtcattgagcggcttttctaggagcgcagcctcgagcttgcctagtggggcggcaccggcgccgccctccaccatgcgacttccatgggagtaggctccatcatgacggtgttgagcggctcccccacctccatccatccctcctcccatcgtcctctccacactgttgtcgactcgctggccgcctcgcactgccgggttagaaagggtagaaaaagagaaaagaaagaggggagaagaaaatgtgacacggacatgtgggtcccacatgctaagtgagctggttggactaggtcaaaacaccacgtcagcgaaaccgttctctaaaactgctgaggaagtcaaattacaccggtttcaatagttgagagagtcatgatatcagtattgtggttaaagaatacgaattagattggagctatattcgagggagacaaagtgaacttatgcctatttcttccgtgttgtttcaggttttcagcccaaagttaagcgaaaaatccggcctcttgtggcgcgtaattacggcccaagatagaacaggtgcaatttttggtccaaaactgctccaaattcctgggtaaaatggcgtgtatttcggcctatagtggcgcgtcacagagggagaaaagacccatcaagaagtgtgcagattcagaatgggccgtataatgggggccaaggcccaagtggggcaaggggttgtttctctcctttcctctcggcggcagcggcggcaatggcggacgacggcgacagcgaccgcgtgaacctggagccttccttctacgacgaggcagcgaccgtggccgaggcggcggcggcggcggagaggctggagcacgagaagcaagagagggagacatgtccgacttcgacctcgacgaggagtccggccttgctccgatgcgcttcaccgacgacaccgcctacaccccaccggcccgagccctccgcttcctgtgcgatatgatcaacgtgctcgccatccgcgtaatcgtcccctcctaccccgattttgattttggttgtgtgatgacgacgacgacgatgatgtgtgtttcccttccccatgagcttctagaccagtggaccaccttgatctgaaatgtgttcctctcttccgccgctccagacaagatgctcaactcatcgcctcagaggtcaccctccctacactagcaagcatcctattccatgaattgcattatgtacaacagatcatcgaacgatcagtacaatttatttcaattgtaggatgaatctttgacattgaccggccctcatcgaggactggtgctatatgacagcgtgtagtttgaggttgacctcaagatgaaggatgatcgtcgaggccacgcggacaaacaacttagtaaaggactgctagtgttggatggcgtacagcctgcaccaaaaattgagcaatatgcagactgcggttcaaacttcaaaagtctcgctcttcctagcagcagcatcaggctctgcaccgtgcacgtcgcctcagaggtcacctgaatcagggaggacatttctgtggagggatcacagctttgcaccagcaccaatgctgaatgcaccatccaagatagcattgtgcttcatgatagcaattttccagcagctggtgtggtggctgccgatggcaatggacattctatcccactattgcgccgtgtgatggctgtttctttggatgagatgctggtatagtgacaattgttgcacaagctggtgatggtgttaactactacagacgaaccattgattttacactagctgtcaatggtggagaggaagctcaaattgtgtgtggtgtcaccagtttgcttgtgaaggttaattggtcgttaatgagcccagttattgacctaaaatagtactttttctccgtttcatattatataatttgtttgacttttttagtcattgaccaaattcatagagaaatttagcaatatctaaaatatcaaattagtttaattaaaaatcgatcattgaatatattttgataatatgaatgattgtagaaggaattggaatgaggccttgaacgtgcaaggataaaattctgaaatattgaatatgtaacactagataacctcacgatttatcaaacatcaattcagaaattagaaaaataaaaattgagagttcaagtatgaatacaatttagaaataactaaaattcagaataaaaaataaatattgaaaaaaaagttcatacataacacaacacgagattaattaaaacaaataataataataatataaattccaaaaatgagagttcgagtaccaatacaatctagaaataaaaactaaaataaaaataaggagtactaaaagcagttcatctagaatacagtggtggcaaatgctataaaagagcagcgtgatggcggttaatggaacatttaaaaactataaataaaacctctcaatgaaaattaggtttgattcttagtatctcaatgacgattagaggaaatacgatgggtaagctatgaagcagaagggtcacatcagttgacatgatttatagaaactaaaaaaaaggaccccgacgattatcaggctcaactgttaaaaaaacctccttcatatatttcccattagcccgaatgtattggccaaattccctagacccattggtagatgtaatttcagtcaaaatctacacgtatatttggcctatcaaaactgcttaaaacagttagttccatagcgccaacttagttcaagagtagataggccacaaaacaactctaacccaagcaaagctacgtgccagtaaaataatttagctttttggggcgagctggcttagcggggcaagaaaaatctagctagcagggagagcccatttagcgatctccttcgacggcaaactttgctcacgcgaaaatattggaacgagggcgacacacacttctctgaaatcagcgacgtaaaatcagtgatatttttcaacgactcacccaatcttgccggccttttcttccagttcttgttgcgaactctcgctcaagctttatcgaaaattgccctctctaccaaacccataaacacagtgaacaatcagtctggacctaaaagaaaaaaatcgatttacagaaaaaacttagcaacaagaggtgaactcatatgtagcagataaccattaatccttgccacatgaagtaaaaccatccaaaaaaaaaagccacgacaagactagcaagctggcaaagagatggtttagcactgccgagctaggctagctgggcgagtgaaccaaacgcatcaaaagtccgctaatcatgagcacacctgtcacacacggcgtgagtgacaaatacatggtgtcttaatccgtggtagagacggcaacaggtctcttcactctgccccattcccaacgaagaaattccgcgtacgccgcctaacatcagacacgtgtccctcccgatccaaagcaaagttttcgcccatccccatcgccttcccctcgattcctcctccacctcctcctcctctccttccccacgtcgatctcacgctaccctcgatcgagctctctctgcggcaaacccctccctccttcccacccaagggggaaagctccgccgccatcgtcgtgctgctccccgttcccgcggatccatccggggctctgggttgatctacctcgccggtgacgtacccttatccttagcctacactgctttgcttgttccgagattttatcatactgttaaacttttgttttcttacacaaatcctttgtctgggaaatgtaaccaaccaatgaatggaatccccaatctgtgcagtttcctgctgtttcctgctgattcatttgctgttttggtagtgtgcttatatttcatcaaaaaaaaaattctagaattttgcgggtgttcaactgaatcccatgccccttgttaggtcctctcctgatctgatctgggagaacacttcggattgcaattccctttacaaccaatggcatgtctgaagtgggacaacatttcttttctttattttttttaagaaaaaaaaagtggaaccatatcaattgttcactatcaatgcagtgataatggtgaagcaaggcatggaatgattaatttgaactattagatggatcttggactgctaacactgacgtaattaaaatcagaaatgaagttaggaaggtcagctgtttttttccttacctgactagctgacatttccatgattgcagtcatgacaccatcagttttgcacgctgtcagtaattctagaacaaaactgggctgaatggctgatgacctatatatgagtccgtttgctgaccagttcttgatgtattgcacttgacaataaattcatctgctgacccattcaagttgtattgcacttgacaacaaacaaatttaaaacaaaggttgatgcctttttggtagagaaattgactgaatactgatgtggttagtgcttctttgctcatgtcatgttctgaattgaggtctaggtgagtgcatcttttcaagccacttttgactaaatatgcattgcttgcatcatttgtcatgtgcagttgaaattcctgcagacataggatagcagctgtatgaaaacatatatattctctagactgttatttagatttgtacagcctagattatatatatatttttaaatgcttgtgccttttgtcaagaaaaaggcccaaatagactagtatcgaatctagttgttggaaatatttgaaggttgaactgcaatctgtgccaagcatgtctgtcctccatcctcattcaattgtgctcatacatggtattttgcaagatcattgtgctttataaaggcgtgtacttgtttggaaattcggtattaataatgggaacggtattgtttttatcatagactaatcagaataatatgaactcttcttgagctgaaaataaacatgcaatgtatgcatcccctgtttcctcttttcctctgattgaatgcttaacaagcttacagtgacaaacagtgagtcggcataaattttggtacagttgagaagttcttgtgttggacatatccctcctcccctagaaataagaagctggtattagtctccttatttattttatgtacttctgctttcttctattgcataaaggaagggaacaataaacatctgccttttattctgtttctttttctgagaaacttttaccaccctcatgggccatcaaatacattatcttccttttttgtgtatgttagatggttagcgcatactgtgtgctattaaatgattctttgcaccatgagcgtggacactgaaattgaagtcttctctgcagcttaagttcactatgtctggaatgccatctgatgaggcaactggtcaagtgaggctcgaaggagatgtttctg

SEQ ID NO: 28986 - DNA, 2136 bp, Oryza sativa
ccgtaaattcgtaaaccgtttattttcatcctgaacttctcaaattgttcactttacccccttgtgacgtttcctccttgcttcagtacatagtagtcaaggccacgttggctttgacctttgctgatgtggctgttggcttttggatgacgctggaaggcctctaaccattataagccatgttgtgagaccaaaaatcggttggaaatgatgcaacaccttatatagaggtgcaagccttctggtgttgtccacaatcaacagacacatcagcaaggttaaatccaacatgggctgtccactgtgtaccaaaactgggtggaaatgattcaagggaatagagtgaacagtttgagaaatttagggtggaaaatacccgattacaagttcagggtgaaaaatggagtcaggcaaagtgaaaaggatcttttgctacaccatttttcatgttactgtgtgtacttattcatgtggcatttattccataaatagtatgaatatctattaattagattactaatatttatatgcgaatatgttcaggaagcagccatcaagaaaaaatatggtggaatactgcccaagaggacgccacatataactaaggtcaatgccttctttattttagtatatttgtttttctctgttaaaatgatgattattgtataaaggtgaaacagatgtatggttaagttgcatttcttactgagcttatgtaatacttaaactggaataatctatcaggatcatgatcgggcttactttgattctgctgattgggctctaggcaaggtaatactaaagtcattatgaagttgaattgagtgctgcattaatattcaataattttcgaagaagaattcaattcttaccatgtttttccttttgcttgccgcagcaaggtggaagccacaaacctaaagggcctcttgaagcacttcgaccaaaacttcaggtactgacatttcagcacacaagatgcacaatttttttttttttgccatgtttttgtttcgctggaagattatggctgaatttaggggcggaattaggagtagggcaggtggggctagtgccctactcctgagtccttaacctaaacacccattgagataacacttcaaaatttaaaaattagaagaaaaaaaaggcaaattacactaattcagccctagtcttgaaaaaagtttggttcccgctcctggctgaaagtgaatacccagatcatttgcttttagcatgttgcttctgatatgctctcccctacatgttttgctatcaagactgacaacatttcttttatcactctgaacaagtatatgagaagtcatattgcattctatgtcatgctactatattcatttctttccttcggtgttttactgtgtcccaatccactttcagcctactcaacaacatgcacgtgctcggcggactccctatgcatctgctgacaatgatggtacttcttgtctgtacatgaatgcatctcaactccgtgtacgtgcatttcattttcttatgttgtatgatggcattgtttattgtcctgtagagtgtatgaatttgcctcctgaggatttgatccagaatggtgatcccatcgaagacaagaacaaggaagaacagtaacgagtagctgcaccctgtctatttggagcgttgccaatcctgtcctcgagccaaactgttgccttggtaaataactagagccaatgcctacacttgtggggttgagctctgcagtgtttaacttaaacgtaagacgtggtatgtctggcgtctaccacattcagctgttcagtgtctttctggcatctgtaacagctaggaatgaaaacttacatatgatgctgtgataccgatgctgtagtacctgatgtgcaaagaaacaaataatgcttcaaattcagctccccatgaatggaaattagtcaaattactggtgatgcactacgatattaacatgttcctttagcgccatcagtgttgctgttatctaggtactatgggcttgtttgaatttttgaattgaagccaatactgcaactaccacattactgaggtttgcagtcgaaactgagatcgagaaacggacatgttaaccggtcattatgggcccgacatataagcaaa

SEQ ID NO: 28987 - DNA, 1250 bp, Oryza sativa
  unsure (1)..(1250): unsure at all n locations
nnnnnnnnnnnnnnnnnnnnnnnnnnnnnnnnnnnnnnnnnnnnnataagcatttttaaggggtttaacaaaataaaataagattaagctgaaattattttgatggttctaagagcagtggttagatgcatggggaaagtacgatgagaaataaaagcactatcagtataactactatcgccctataaaaaatctaagatctattttatatttttaaaacttttgtaagtctaagatctatttataatctctatatgtgaaattaaattgttgaccagaatctaataaaccatcttattacttactggttaaatgcatatgtatagtttgttgcttttatcacatagtgaatgagttaattttttcttaagtttggtgacaaagaaatactccctccatccaaaaaaaactcaacctagtaagggatgtgaccccttctaggacaacgaatctggatgtgactagaatctatccaaattcgttgtcctataagggagttgagttttttttggaacggagggagtaggtcttagacttttggatgaaggcagtattaagcaatatggttgcatagattggaaaagtagtactctctattttaaaatataaggtgtattttgtttcataaaaaatattttgatcaataatcatttctattaaaatattatttatgtgatagaaaaatacaatcatattgtaagcaagtacttttaaatattaatctaatacattatttttttgacttaaaattatatctaacagactaattattggtcaaagtaactctctctctctctctctctatatatatatatatatatatatatataaggaagggatattaaacaaaatatactcccatcatcttaaaataacttctatcagcaatcatttatctaaaacaagttcattggggatcatggtctcacgatgtcacgcacaacctgcaaaggtcatggttacctcgaccatgcctcagctcaggagctaggaacccatagctcggggccacgtgttgggcaagtttgaagccctgtgatatgcttggtgaaaaagagatttcgggcgaggaggatttgccatggtcatcgccgctcaccgccaccaaggactgtcatgcaagtcatcgccgctcgccaccatggtcatcaccactctccacagcaaatccagcgagctcgcggcgagnnnnnnnnnnnnnnnnnnnnnnnnnnnnnnnnnnnnnnnnnnnnnnnnnnnnnnnnnnnnnn

SEQ ID NO: 28988 - DNA, 776 bp, Oryza sativa
atcaattgctctctatttttttcatagatatcatgatagttttcggcaaagtaataaattatgttatagattaaagtggctaaggcatcagaaatgttaccggttggattcccattaccatctctatcgggcaatggccttccttgatcatcccttttaactgcgcaaagaatctcctgtctttgagtttcatttaaataattattccaccatccttttaattgaccagaaaacccaatgacaatcatattggcagcttttctttctttgtttccattagctatgcaggcattagcatacataatcatttgatgacataaagtaaagatttgatattcagtaaagccatctaagttccattctacaatttctttgccattgtagtaagtcatattttgaatctgaggaatttcctcaaactgtaggtctgcataagttggttgagggtaataattcctagttgtggaagtaagagtagaaggtttaaaaatcttgttgaccatatcatatttttcattatcagaaatctcattgatatttttatttacttttaaattatttagttttaaggctagctcactgactagttcttcagaaattgtgggtccaaaagccttttattttccaagtttgatgttaggatcaattgttgggacaaacataggactaacagactgagaactagaagactgagaattagagcgaatatttatctttacctcaggtcttcctgttttgtagccttccataaggattgtctctattcgatctgtttg

SEQ ID NO: 28989 - DNA, 759 bp, Oryza sativa
  unsure (1)..(759): unsure at all n locations
nnnnnnnnnnnnnnnnnnnnnnnnnnnnnnnnnnnnnnnnnnnnnnnnnnnnnnnnnnnnnnnnnnnctcgagcttcctcaccttgaccttctcattggtcactggattttgtaacccaagatagagtattcctaccccaataaggacgaagcctacaaagaagagaagtcctgcaacaagccaaaagcgtatggagtattctgcgctcccggtatgccatcaacattgattccaaaaaggccagtgattatggataaaaccatgccgccacccccaaaaatagccaaattgtgggtgatacgaaggcttctatcctggagaagagcaaaacctggctatcaattacaagtcaagtcaacagtaagaatgaaaaatagctcggtgcatacttgtaaccatgctcgaacagtgctttgcataacatcctgaatagtgaacaagcggccacggacagcttcctgctcctccaacatttctcttgtgtcctttctaatgctatctaagataactcttgtggtatttcccctcaaatgtctaaggagctcaattatgatctcttcccttgcatgcagagaccatttaactctgattacctgtagcacgggcttatgatcattatgtatcaaaaaaaagagaatggcatgcacaatngccacgtggaacttgaatgtgctaacactattctgttcacaattgcacacttatctggatagaaagtcctacatgtaattcaatttctattttggatctaccctatc

SEQ ID NO: 28990 - DNA, 608 bp, Oryza sativa
ctgttttcgcgacctttttctccctattttatcctctcgccgttgctttaggtgtgcgaatcacatggccatatatatgaccaagctgatcgggttttcaggcctttttttttccttttttctctcatcgtgcatcgcccttgggtacgaagcttcgtgcgccgtgcgatgtaacatgataagatatcgcaattatcggtggttagatctggggtgttggttcacttgcccggggtggcgagatatataagacgataaggttttgatccgggaattctaaaatagtcgtgtatggcatgtgatgctaatcatgctcttttgcatgcactgtgtgtatatctgtttctccttttttattttctttctacgatacctttttgcaattattattccaattaaaccgtctatatgcatcacgtgtgatctccccgccctaacatgctctgtcaactttgcgttacaacccttacatgttgtcagttttcgatcaattacgatgggaaaccagagagtcgggttacttatattagtactctctccatcccataatacaagagttttttactttttgcttgtactgtttgaccactcctcttattaaaaaattg

SEQ ID NO: 28991 - DNA, 2153 bp, Oryza sativa
tacaccatgaaaaacaactaagggcgacataacaatatcggccattgtacatcggcaaaccacaaccgattacaccatgaaaaacaactaagggcgatataacaatattggccattgtacatcggcaaaccacaaccgattacaccatgaaaaacaactaagggcgacataacaatatcggccattgtacatcggcaaatcacaaccgattacaccatgaaaaacaactaagggcgatataacaatattggccattgtatatcggcaaaccacaaccgattacaccatgaaaaacaactaagggcgacataacaatatcggccattgtacatcggcaaaccacaaccgattacaccatgaaaaacaactaagggcgatataacaatattggccattgtacatcggcaaaccacaaccgattacaccatgaaaaacaactaagggcgacataacaatgtcggccattgtacatcggcaaaccacaaccgattacaccatgaaaaacaactaaagacgatacaacagtatcggccatcttaaggtgatgtaaacacatcggcttgtatgcattcgcaatagtagccgatcattgcgttacccaaacacttgggtaatatttcttcaaatatttgccattgagcgctcgctcataaacttcaccgtcatgtccttgcaacatatatgctcccttagacacaaccttatgaatttggaacggtccttcccaattcggcgaccacttgccgaatttactatcacgagtaccaatcggcaaaatcagcttccatacaagttctccttccgaaaaatctttaggtaccactttcttattataatgccgagcaacacgttccttatccctagtaaccttcgcaagggctcgcaatcgtgactgaaccaaatcctccctttcgtcagccataagattgtaatactcattggctgttaaatcgttttgcaactccgtttgtcgagagccgattctaacttcccatggcaaaacagcctcatgaccataaacaagtttgtaagggggaacttgaatctatccatgataagccatcctataagcccataatgcttcggcaaatcgagtatgccattgctgaggataatcagaaattttctgctcgatcaacttaataaaactcttattagacgcctcggcttgcccattagcttgtgcataataaggtgaagaattcaacaacttgatacccactctatcagcaaactgaacaaactcatcggacacgaagattgaaccttgatctgtagtaatagtttgaggaagaccaaatcggtagattatgtgtttctgaacaaattgaatagcatccccagaatcaactttcttcaaaggaatcgcttttacccacttggtgaaataatcagttgccaccaatataaatttatgcccttcactcgatgttgggttaatcattccgatcatatcaattccccaacctttgaacggccacggattaataatatggttcatagctgacgccggtgctcgctgaattgctccgaacttctgacatctttgacatccctgcaaatatctaaaacaatcctctagcattgtcggccaaaagtaccctgcacgccgaagcaaccacttcatcttgtgagccgattgatgagtaccatagatcccttcgtgaacttcgccgattgcaaccttagcctgatcggcactcaagcacttaagtaataccccatcaatcgtccgataataaagctcatcattcaatagtgtatactttaatgccttatatcttaatttcctagaagccgattgagatggattacttaaatactgatgcacatcatacctccaatcatcggctgacactgctgcaatttcaactttaacatctttgatcatcggcttataccccgatgccccttgggccaaatcattagcttcaagatattgttctcgagatacatgcttcaaagtaaccagtcgaaaccctttcattagttccaggcacttctcattataaaccatcaatgtatcgttcttgcattcatattcccctgccaattggctgattactagcaaggaatcccccatgatttcaatggtatcggctacaacttccttgagtaattgcaaccccttgagcactgcttcatactcagcc

SEQ ID NO: 28992 - DNA, 1364 bp, Oryza sativa
atcgatcggctgagttcgggcatctcatagtattcccaagcgaagcaatctctaaactcttttaagagctctatcagcttggttctaaactctggagacaaatttttgctaataaatgtcggccttggccgatcgcctggacctatgtctatttcttccaaatcatcggccgacataaaaccctgaccttgcttgtcatcgagatcatctactgtatccttagcatagacattcgaaccctccacgacgctctcaaagtaatagcttgggttctccatcttcgattggctgtatatcagaatcggacacttttagaacatctccatcccagacttttccagataaacaatcaaggccatccatctcccaaagggctaaatcggcactagcaacattaactgacctgtcggctggcacaatctctatcttgtcgccttgccattgaatcaagcattgatgcatagtcgaagggatgcaacagttggcgtgaatccaatcccttccaagcaacaagctgtacgaacccttcccatcgatgacaaaaaacgtggtaggaatagtcttgctgctgactgtcagctccacatttagaacactcttggtctctgatggattaccaccaaagtctttgagcaccatatttgttttgatgagatcctcggcattcctacccagctttctgaatgtggcataaggcatcaaattcaccgcggccccaccatcgaccatcatcttagacatcggcttcccattgacgtagccatttatatacaatggcttaagatgccgattctctgtcccctcgggtttctcgaatactgcatgttctggtgacaggaccaacttagccgattcctcttccaattcatcgacatcggcctgatcgatcccgaattcagctggcaatgtaaagaccatgttaattggtgccgctataacactcttcccttttgccaacctcttcacctcatcggctgcagcatcatcggctacaggaacctgattcttgacatgccactcctgtcttggttttggtttcctcagtcgatggttgatttcctcttcaacctcctgaaaacgctccctgctcctcaatctctggaccctccttttctgattctccgtgaaaataccagaaggacaccattgattcttcctgatcacctcatcctcttggccacgatcttgattcatcggacccaatctttgacgaacagggagtcttgcctgtctcagccgattatccctattacgtgatcggtttgagctctcgatgatatcactgcatccaaggcagttttcgatagatggcaacctcatcccttcattccagcagaatctgaagaactcgcaatcccaatgag

SEQ ID NO: 28993 - DNA, 718 bp, Oryza sativa
gcacgcaacaattcaactggcatttccctgcctaaaaatgctgccacaacaggttgtgtttgcaatgcatgaatcacactatcgaatttactcatgcaatactctgtaagcagcccaaagaaggcatcaaatgatgcttgccatagagctctgttttgcatgctgtaggtagaggccacattctgatcagtgagaagctctgttgctctgtccagtacagactttatgatgaaagaagccccatcacctgcagcatgtccaaggggtcgcagagggggttgcagcgaagaacacacaatagctgcaaggcaagcacttagtccactcaactccaaccgaacaacacaggttgatacagcagtagcaagttttgtcgttgtctcaacagcactactatcagatggcaaatttccaaatataaatcttagatgccggaagactgccatgcaagcaattctagcaagctcactgccagaactcacaagttcaaggtaacgagaaagtagcttgcggcccttcggaagagagactattcggagaaacaccagatcatcatttggtgagagaggtgcattgttactaggtgtaagtggatcaactagttgcagcgattctgccagctgctcaaggagggcctgtctcctgtttctcagttgcaagccaccatcttgctgctggctaaattgcagcaagcgatcaatatcatctacatcaagca

SEQ ID NO: 28994 - DNA, 688 bp, Oryza sativa
atcatttccaaccgatttttggtctcacaacatggcttataatggttagaggccttccagcgtcatccaaaagccaacagccacatcagcaaaggtcaagccaacgtggccttgactactatgtactgaagcaaggaggaaacgtcacaagggggtaaagtgaacaatttgagaagttcaggatgaaaataaacggtttacgaatttacggtgaaaaatagaatctggataaagttcaagggtcaagaatggacttatatgaagatagtacctcttcttgtggtgagggcattccacttgcttcgctctgctcttgagttttttcttcctttttgtcagaaacatctccttcgagcctcacttgaccagttgcctcatcagatggcattccagacatagtgaacttaagctgcagagaagacttcaatttcagtgtccacgctcatggtgcaaagaatcatttaatagcacacagtatgcgctaaccatctaacatacacaaaaaaggaagataatgtatttgatggcccatgagggtggtaaaagtttctcagaaaaagaaacagaataaaaggcagatgtttattgttcccttcctttatgcaatagaagaaagcagaagtacataaaataaataaggagactaataccagcttcttatttctaggggaggagggatatgtccaac

SEQ ID NO: 28995 - DNA, 611 bp, Oryza sativa
ggccaattcgagctcggtacccgcgtatgatgcacttttgcatggttgcccacccgagctctaaatttttttgctgagagcgaggaatagtagcagaccaaacggtcttaggtctcctgtcattgtgatcccttttcatgattagatttcctgtactttctcctcctgttgcagggaaaaggaaaacgatgaagagactggagaggggaagaagaagaagagaacaccacctcccgtttcccgatgccccccctgacgcgcagaatgatgcaccgtctccgaatggaaacgccacggggccccacctgccagcttgacccctgctgctgctgctgcactgcacatgttattccccctccgcctccggtgtcacacacgcacgcgacgcgacgcgatgccgaggcgtccgtaccaccaccgccagcatcagcggccgtcagctcgagatcggacggcacgggacagatggcagcaggcgtcacgctggcgtgtgccgcccccccgccgctaagggccccacgtgccaacgatggaggcaggcgccgtggggtggtcaaagggggcgcggggacggacacgtgtcggtcgccgcaacgtgtgaatgttcgacc

SEQ ID NO: 28996 - DNA, 895 bp, Oryza sativa
  unsure (1)..(895): unsure at all n locations
tattttgaaagtgcaagaagactcgtccaatgtactgtgcaatagtaatcattttttgcttctgcaagcccaacttgtattcagctatctcttcgggagtcttgtccttcagctactctgaccctagtgataacctcacggtatgttgtgtttgacagatcctaattggatccaggaatccgataagttcttttttctccttagcatccatgtattgcatcctacaaaagaagtttaaagaagtttgttagtaataatcacatggttttgtattgtacatatttttcatgtaattaatgtaaactcatactcacaggcacccagcagcgacatagttgacgtccatcttttcccgacgatatatggcgtggagatcttcaaaatctagccagaagtaaccgttgccgccgaaagcatctatcggtgatcgaactgttatattacttaggcctttcttgctagtgtccatataccatttatgtaaccttctcatctcccatggaccgtcatcaagtgcaaaatccggtcatatttctttcccatgttcgtatttttccgggcaatcatcaattgccaagtttttttttcccggctagtgcagcggccttcttggggtcatcttctctgaggttggcatgttccttaccccttctaaagacggataccatgaacttctccttttgatcatctttggacttggaattgtggctcctaagcactctaggcacttcagacttctcagtggccttgtcattgaccgggggttcttgcacctcagggtctttcgcaggattagggacttcaaagatttctagatctgtaccgtcccattccaannnnnnnnnnnnnnnnnnnnnnnnnnnnnnnnnnnnnnnnnnnnnnnnnnnnnnnnntt

SEQ ID NO: 28997 - DNA, 839 bp, Oryza sativa
  unsure (1)..(839): unsure at all n locations
cgagctcggtaccctgaatctaactctctaaagtacgatcgcatgcacagtacaagaagattttgccttaccagaattaacgggatatggtcaccactcgcccaaagtgtagtatatatttttctctcggttccgagcctttaattaaagaaaggacatttctgtcacatgtgtttcaaagtaaaagctacaattgtttttagccagttcttatctagctagggaattagatactccaaaaatccttgggtttgagatcatgtacttgtgtaattaatctggctggacacagtacgtaattctgtaaccagttgaaatgtttgacttcttactcgtacaaaccaacttgataatcaaacatttcaaattggtttacacgtgtaaattaattgcgtgtgaatatatatatatatatatatatatatatatatatatatatatatatatatatatatacacacatatatatatatatatatatatgtgtgtgtgtgccaatatccttatatgtagattaaatcagctggcacatataaggatgcaagactatatatctagtctcttccattaatttacacgtggctcacacgcaaatatatgtgccggttatcagcatgtactcctagctactagctagcagcctggcaccacatgttcatagcacatacatgaattgagcaaattataaatagaaagcatgaaaaatatatatatgattttccttgttgaaggcatatacaatatacgtatatatagttcataatattggggatagggggcttagnnnnnnnnnnnnnnnnnnnnnnnnnnnnnnnnnnnnnnnnnnnnnnnnnnnnnnn

SEQ ID NO: 28998 - DNA, 171 bp, Oryza sativa
gtaatgaaggcagttttttcctcatcttccctagccatgcggatctggtgatacccagagtaggcatctagaaaacacaaaaggtcgcaccccgtagtggagtcgactatctgatctgtgtggtaaagggaagggatctttagggcatgccttgttgaggtctgtgtagtt

SEQ ID NO: 28999 - DNA, 635 bp, Oryza sativa
tgagatggattacttaaatactgatgcacatcatacctccaatcatcggctgacactgctgcaatttcaactttaacatctttgatcatcggcttataccccgatgccccttgggccaaatcattagcttcaagatattgttctcgagatacatgcttcaaagtaaccagtcgaaaccctttcattagttccaggcacttctcattataaaccatcaatgtatcgttcttgcattcatattcccctgccaattggctgattactagcaaggaatcccccatgatttcaatggtatcggctacaacttccttgagtaattgcaaccccttgagcactgcttcatactcagcctgattattggtcgcatatggtttaatagtataagcaaactcgaaacatgcccccctaggggaaattataactaagccgatgccacaaccatgagtgcataccgatccatcaaagaataaagtccatggtactatctcaaccgagccgattgaatcatcacgatgttctacaataaaatcggcaatagcttgtcccttaatcgcttttggcgattcataccgaagatcaaactcagtcaaggaaaatatccactttccaactcgtccctttaatattggagccga

SEQ ID NO: 29000 - DNA, 447 bp, Oryza sativa
gcgtgggccccactcccgtggacccggtccgcgcgccctctctcccggctgacgcaataaatgagtttttaattaaaatttaaatgaagaaattcgtaaatatccatttaaagagcatataaacttcaaatggctatatcttggccatttgaactcggaattggaccgttcaagtctctaatttttccttaagaagtcaagaacccatttttgtgctttgtttctgctgttatgtggagtttattagagtaaaagccgttttttttccgttagtcgtgtagacgctgcagcttcgaaagatccgctcttcgtggaagttgaagccggtgtttgggaaagcgagcaaggcaagtctcatcagccttgagcatattgaatcacagttaataaaattattttgatttaaattattgcataaccgctttatttaaattccagcgttatcac

SEQ ID NO: 29001 - DNA, 749 bp, Oryza sativa
tttttaaaaaaatagattaatttaatttttttaagcaactttcatatagaaagttgctgcaaaaacatattgtttagcaatttgaaaagcatgcgcgagaaaaacgagagagaagattgagaaccctcagtagcaaacacgacctaagtgtgctagaataaactccttcttccaaaaacccaacctagtattagaatgtaatataatttagtataacgagagttttcatggtatggagggagtatctggttcggactcacgtgtccgattcgatttcaggcaacgaggagatcaacaccctgagaatgattgaccagtactccggcgggctgaagctggttcacgtcgacgacctctgccgcgccgagatattcctcgccgagaaagcgtcgccgtcgccgtcggggaggtacatctgctgcgccctcaacaccaccatgcggcagatcgcccgttccctggccgccaaatacccgcaccacaacgttgacatcgatgcgtaagacaaaatcatgaactggtctcaaagattatgcgtgtccactgcgagctgactccgacggtggcggcggaacatgcagactcggcggcggcctccctgagaagccgacgatcctcctctcgtcggagaagctgaccagtgaagggttcgagttcatgtacaagacggtggatgagatgtacgatgatgccttcgtggagtacggcatggcactcgggattctgcactactgacgccgacgacaatg

SEQ ID NO: 29002 - DNA, 5667 bp, Oryza sativa
  unsure (1)..(5667): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgaacaactctgcatgcacacggtatatgatatagcagcttggctcagtaaactaatttaatgagcatatatgcatagcagttttgtaacaaatggttatgccatgatattcagtagaaccaattgaacatcaaagatgaaagctccgaagtctaaggacattttctagacaactctatgtgaaattatcagtttaggcatccactttctctactttctattcctcaaaagacacttcgctttcagaattcagaacaactcagagaaaatacgaccatgggatgtattccaaaaatacatgcataaacaacacgtcatgagaccaaaaataggagaatggtttccttctttaaaaaaaaaacagagagaatggttacctggacatcatcaacatccacatagaggaacagtatctcagggtgtgtctgagctagctcctcaaacttgtagttcatggacagcgaagtcacacaccatgaagccccaaagtgggcaacaacctacacaaagtcgaggggtcaataaccaagttaacttctgagtgagtaaaaagaaatttctggtgcaactgcagcggataattatcatcaggaaaattttcaatttggaactcagtttgtcaattacagttacagtgaaagaaaaacgagaaagacccagaaagaacgaaaagaacatgattacagaaatcaggttgcatgaagcatccatccccacaaactattatacatatatcgttctaacaaaattataatctacaaacagcaattacaaaaatcgtgggccgaccaaaatatgacttgagaataaacaacatcaatattcatcatgagagacaaagcaggaaagatgtgggggaagcccggcgaaaaaaaaagaggtgggggaagaacaaggcaaggaagaaaaaacccacagggtggccttcgttgcttgcttgattgacgaacagatcccatgactcctccttctcaaccttcacaactttggaattgccaacccccttctgctgctggatctccatatggcctaagaagcaagaacagaaccctctccctttcactccgtgttcttggtctcctcctcctccttgctcctttccccaagaccccaacaagaagagaacaaaattatcacagactgtctacaggaaagagaagtggcaatcctcctgaagattagataagcatggggatttatattctaaagctggtgggtcctgccttattttggctggtagtttcttctggagtcagtatcctatgcagtacttcaaaagctatgagcttatatcaaccacataaaagatatgcccaacgggaataagggccgtgatgcagaaagggtagcaaattaatagagagcttatctcctagtggaaaaggaatgcttatcaggtgggtactagctctgaaatggtaacgtattctacatgagctggtcaatttattagcaatacaacaaattgtggatgttagaacatattggagatggtaaattacaaagcgatgtttttgtgttcctagctccttgaaatcggatatatcataaagtatcatcattttgcagagcgcacctactgcaatttccatatatttcttattgcaataatcgaataacaaagaacaataagtttgtattctcccgctctagagtaataagttttgcatgtggcaaccttgcaataacatccagtttaaagctaccaagtgaacaaattaggagatccatacggaagggaaaacgtagcttgttttacttaaggtagcacacatgtcacagaatcacctcaaaaacatggactgcctgaggttagaagattagtttgctgccattcctagaattcctgcaaagcaagtaataactgtgaattgtcattttctgcgttaactaaaagtagagacgagaccaagaaatttacaagtctggatgtgttcaaatttgatggacatcatagtaacttcatataaaatatctcttactcagaaaaataaataaaaaataaaaaatctcaagttcagtgttacggtttagttgaagactttgatactgaacagaaccatgagaaattaatccagtctctaggagagctttggcaagtttaatcgtttcaacaagatttggggtttaactgctctcacttatgaaaaaaaaaacagctttttgagagaggaaaccctctagaagttcccttgttccttcaagcaggccacgagtccagaatacttgaaaaagaaagataacatgatgatttgatatggtgcgagtttaataccaacaaccctatccattggtggtcctaattaaaaaaaaaaggtgatggcaaacagacatgccaaaatcaatcatacaaaaaaagaactaccaaaaagagatttatattccaatcccccattagcttgccaaccatggtgactgtagacggtagatacacaaaacctagaaagaaagggggaaaaaagcaccgatgaattgcaaaaccacacgcaatttctcacagcagtgaaacagaccactgatctacaaagattgaagcgtgcgagctgtgaatcaattggaagtacacgatgtagcatagcgtagcatagcatagcatagcgccattctactcaaaactactacacacgatttacttcgattcgagcatgtgggaagtggtaaaaggagatggaaactacagagggttttaacctgaacccgacaaccaaactccacgcacaccacgcacgcatacggaagaaggatccgaccactccgcgggctggggggcagcaaaaccggggattccggtagggaaggggagcgccgcagtcgcagatgagaagactggtggcggaacgccggaaaaagccgcgtccgaaggcctctgatcttcttgtgatgggctagctggcaatcgcatagtgggggcacctctctcattctcgcttttccttttttttttatttaagaaaatagatttactacttcctccgttctaaaatataatcatttttagaattcatagctaaaagttactgtattttgagacggatatagtcattgaacggattatgcaacggataggagcatatacttgcatataggaataaattaaatattttaaaaaataaatttaataatgacttcctctgtcctaacatggaggatacttccaaatgaatcctagtaatattttgagatagatgaagtagtttaaaataagtgatccggaagaaaatgatctgacacatatattaaatatcttaaaggtgctggattagctatcttaggcctcctccaacaaggatgagtcagctagctcataaatctccacatcagcttttgtatgatgtagaagagagagaagataaggagagagagtgcactatctcttcttcaagagctaagctcctaaacaaaatatgagaggggttgtggaacccaaagcattttgaacaatgtgctatgagacaacctattaaaaaggtaggctttttgctatctcttgtatgaggtggacaagcatgagctagtgcactagctcaaccattgaaggaggccttaaaggtgctagattagctgctctcctagcgatttggagaggcgcatccaatacggtgtggacacgttgtttcgttacagtggtcctgctaccatgggccagctgattgtttggcccagcgaccgacggccttttactggccatcgtggcatcggtggcgcggccttgcgtcgtcgtggtttggctgtatgctcagccatccgcgagccaccgctaccgtcttgacgcgtgcccattctccaacccatgtccggctaggattgagcgaaggctgtgtttctcgtccgctccgcttcagcgaatcggcaccgccgcgtgtcggccatcagcgagacagcgacacctccaaggctccaatgcccagcagcccctctctcatccatggtagtgctctgtcatggtgtacgggaatgacagggttggctgctccactaaaaatacgcgcggagacccccatgaggagcagatcgagggtacctgcatcgctcctttctttctttcattcgaagctggttctgttccttacttcttcctcttagttcctgttttttgtggagacggtactttccctagtcgcatcatcccgtatgctttgatctttttcagttgtgcttcgctctggatttcaccattgtgatgtcgatgttcttctgaccatgcctatgctcattgattttgatttttgttttctgccttctaggttgcgcggccaacccttaccgagacgtggttttactgctcgccgagccatccgcgttgcccccttccacttctcggcatccgctcgtcgtcgtcctctccgcatccgcatctcttcccaatttgtttgttcccctttatgttcttcactgtggctgcacgtacaacaagcttgaatagcatcacatactccccatcccgtcctcagcatcggcgtgccgcatggcatcgcagcgtcgccttcttcttcggcatcaaggtcgactcggtggctcactgctagcacagatggcgggcggggagtggatctttcaattcttcctcagcgacttgcccgacggtgttgctagctgacacaaccatttcctcaatggcagaaatcggcgtacggtctacctgtcctcctccggtacggtttcccttctcttatctctcatctagcataaattgaagataatgttctgaatttaggctaaatttatcagatgtttgtttgggaagttcgttcaaagattcagatagaacccagcacatttccgaatattggtgcctccagatttctctctctatttcttttttaaatgttgccttctgataattcgaactctgcgccaattcctcttatggaaagagagtcgatgtgatgtcatgaggcaaaacatgaactggtgagcttccctgaaacctgttgattccctggcaacattgatgttttattaggatgaattctcacattaatagcttccttccattagggctttcaatgttctaactttttttttagagaaatcatgttctaaacttttgattggtgaaagaagttacaattactaagaagctctcatcctctcctgcgaatgagattctattcatttttctgttcctgtactttaagcatgtcagtatgccactacttcattgtccaaaactgagctccaaagaaaggtcaaagtggccagcttaggattaaaacaagtttagcagaatcttcttacacaaattatttggtgtttttcagcatacaggtaaacagacggctagacttcatgatacatgctaatgttgggaggggcaagccactatgctcagctcatggatcttcaggaacggagctgccagcatattactgacaaacaaatacaaggtaaataggcagaagagatccttcatgtgctttgctctccgatgttctccgtagagaaaagaaaagttaatcatttcaattatttatttttattcattaattatatgtaattagtaaattnnnnnnnnnnnnnnnnnnnnnnnnnnnnnnnnnnnnnn

SEQ ID NO: 29003 - DNA, 1667 bp, Oryza sativa
  unsure (1)..(1667): unsure at all n locations
gagtggatctttcaattcttcctcagcgacttgcccgacggtgttgctagctgacacaaccatttcctcaatggcagaaatcggcgtacggtctacctgtcctcctccggtacggtttcccttctcttatctctcatctagcataaattgaagataatgttctgaatttaggctaaatttatcagatgtttgtttgggaagttcgttcaaagattcagatagaacccagcacatttccgaatattggtgcctccagatttctctctctatttcttttttaaatgttgccttctgataattcgaactctgcgccaattcctcttatggaaagagagtcgatgtgatgtcatgaggcaaaacatgaactggtgagcttccctgaaacctgttgattccctggcaacattgatgttttattaggatgaattctcacattaatagcttccttccattagggctttcaatgttctaaacttttttttagagaaatcatgttctaaacttttgattggtgaaagaagttacaattactaaggagctctcatcctctcctgcgaatgagattctattcatttttctgttcctgtactttaagcatgtcagtatgccactacttcattgtccaaaactgagctccaaagaaaggtcaaagtggccagcttaggattaaaacaagtttagcagaatcttcttacacaaattatttggtgtttttcagcatacaggtaaacagacggctagacttcatgatacatgctaatgttgggaggggcaagccactatgctcagctcatggatcttcaggaacggagctgccagcatattactgacaaacaaatacaaggtaaataggcagaagagatccttcatgtgctttgctctccgatgttctccgtagagaaaagaaaagttaatcatttcaattatttatttttattcattaattatatgtaattagtaaattgttgtgttgtatatgtgttaccattttgacaaaaaaaagagcactccgattgatcattttctgaaccatacaggaaaaatactccatgcttttgtatgagctgttcttagtctcttatagaatgtgctgtggtcttaatctctgaaggctgagctgtgttagattggagcactccgatccaactcttttgcccaccaaatcaacttaccaatgcctgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgncgncgncaacttcaccctacaaaccctaatccgatcgagagggggcgcagccagtgacgggaagcgccaccgncgcgccagacctcatcgccgggacatctacgaccgtcactcccgcagccgtcatcgccgtcgacctcacccgggccgcattcacgacaaccgagcgccaacgacgacgatggccggcacttttttatccttcaacaccttaaccggtcggtctatctaaaccctcttccgttttcaatctctatagttcaaacatcaaacccaaatagaaccacccgactagatctaacctatgtgatcctagtgcaaagttta

SEQ ID NO: 29004 - DNA, 700 bp, Oryza sativa
  unsure (1)..(700): unsure at all n locations
attcactgctgttttacacatacttattttgcaaagagccgtttggttgcaaagctgggtagtaacagcattgtcgtcggcgtcagtagtgcagaatcccgagtgccatgccgtactccacgaaggcatcatcgtacatctcatccaccgtcttgtacatgaactcgaacccttcactggtcagcttctccgacgagagaggatcgtcggcttctcagggaggccgccgccgagtctgcatgttccgccgccaccgtcggagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcagcagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaannnnnnnnnnnnnnnnnnnnnnnnnnnnnnnnnnnnnnnnnnnnnnnnnnnnn

SEQ ID NO: 29005 - DNA, 1002 bp, Oryza sativa
gagtatgcacgaaattatgaactgaagaagaagaatctcaccggggtttctgactgtcgtgttgacagcacatcccttctgcagcagcatcttgatgagcgccgaagcgatgtacccgttgccgccggtgacgcacgccgtcttcctctcaaccgccgacatcgctggtcagtcggctcgatttcctactagcagagaacgatcgagaattccttaacccaatagaacaccaagcactgatataatggtagtggtttgatgattgtgctaaggaccagtctcatcgaagcaacaagagggtgtactatgtccgtgttgaatccggatcagctgcagtcgctactgggactgcaatttaggcggtaccagttttcatcaacggatgtagatggaacggtccagatcagcgaggtgcactattcatcgtactgtagcataaatactgtagcacagaatataagttgcagtaatagctataactgcgcatgatctgaatccgtctgtgtgtatagatccaaagtttggatctaaacttcaattctttttcatcacgtcaacctgtcatacacataacttttcagccacatcatctctaattttaaccaaaatccaaaatttacgctgaaataaacacagcctatataggagaggtgaggttgctggcctaatcgaaacagtctcatcaaagcagaaacagagacagcatttatcatatcgtaattgtggctctcgctggagtcactgcaacgtatagacactgggccaggaggacacgtgatgctgaaccttctggatacgagtactgtccaaattcatagagcaaccactgtgagcgatgatataccggcttcattctctccactcacaaaagaatacaccagcacttgaaaaatcgatgatacacggtttgtgaaaccatatttgtatacgaaaatcattaactgaaggagtcaaaattttggccagtagaccacaagaattggcaaacgcaagtacaaaaaa

SEQ ID NO: 29006 - DNA, 946 bp, Oryza sativa
  unsure (1)..(946): unsure at all n locations
ttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcaagcgccccctcccctcccccaggccgcaacctgggcctgggccgggaaagccgccgccgcgcgctccccacttgggccgatttcggtccggccgccgccggacgtccgatcatagggtttcgatcggacggccgggcgccgagatcggggatcaaaaacccccctgccccggccggccgccgaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcgacgacggccggcgacgaggtaagaattagggttagggtttttggttcttttgatccgtgcggatcttgtgcttttctttctttggatttctttccccgaaacgatctaaacactagggttgctctgataccattgttagactttgctctaggatcannnnnnnnnnnnnnnnnnnnnnnnnnnnnnnnnnnnnnnnn

SEQ ID NO: 29007 - DNA, 677 bp, Oryza sativa
  unsure (1)..(677): unsure at all n locations
ttgtcctctgcttgcaaggggccaatgatatatactgtatgagaagaccaacaaaaagattcctgtaagagattctgggcaatgttcagagttcagagacttgcaaactctcagatgatggacagtgtcatcgaccataacccggtcagaatgtctctataccaattttgcacaaatctgacgacgtgatatatatcataatcgagctgaaaagattagcattggctagttacaaacagcaagttgacaggctataataatctcatactatactcctacttgaaaaggattcaaaagattgcttctttatactgtactgacgatggtagaactgtactacagtatagaattcagtctaggttcttcagacttgccaatggcttgaacaagaataaaaacagagacatctttcgaactgaagaagcaaccatcaaaataaaaaggctcgtgaattacaatatattggagctgaagaagcaatgttcagctttccatccacactagccgcgggaaccccctagcctccgccggcggcgngcccaccttttttcccgacgccgaggacgacgacgacgacagcgccacgtccaagtccccctccggtggttccccggccattcccgcttcgacaacggggccatgctttnccgcgncgagggatacgacggcgaggaccg

SEQ ID NO: 29008 - DNA, 770 bp, Oryza sativa
tgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacgcactttcggcgcttcatggtagtgtcagatccagtagcgcgtacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacataatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaactatgccctaaaaaattataaaattgtattttacccagtcttggagattttaatcttggataagtttcaatataaaaagatttgataactattgatatttataaaaaaaaatatagcacagtataaaatcgccctcccccaggg

SEQ ID NO: 29009 - DNA, 814 bp, Oryza sativa
  unsure (1)..(814): unsure at all n locations
aggtcgtggcactgtcgtcgtcgtcgtcctcggcgtcaagaaaaaaggtgggcccgtcggcgaaggctagggggttgccgcggctggtgcggtacaaggtgctggtgctcgtgctcgtgctgcagtttctgtacagcaggcaggcgtcggtgcggctcccaatagcgggccgctcccggggtgcggcgcctggggttgctggcacacgcggtgcggcgccgccgtcgacctcgccctcgacacgctggaagcttgtgtacgcgtcattctatcttgggaaacatggctgcagtgctgcacggtttgaacttcaggtttatctggtaaagatcaaatggtgaactgaaaacagtaggtgtccatcttgttcaggcagagatgtgtttataaacttcagaatctgtattactcctggtcgaggtagaagttgatacttggaaattggaatgataaacagatgatattctcgttgtttatacacaggacaagctacaggtttcgcagaattaaaatgcatacgaatgcaaagagaatttgtcctctgcttgcaaggggccaatgatatatactgtatgagaagaccaacaaaaagattcctgtaagagattctgggcaatgttcagagttcagagacttgcaaactctcagatgatggacagtgtcatcgaccataacccggtcagaatgtctctataccaattttgcacaaatctgacgacgtgatatatatcataatcgagctgaaaagattagcattggctagttacaaacagcaannnnnnnnnnnnnnnnnnnnnnnnnnnnnnnnnnnnnn

SEQ ID NO: 29010 - DNA, 737 bp, Oryza sativa
  unsure (1)..(737): unsure at all n locations
nnnnnnnnnnnnnnnnnnnnnnnnnnnnnnnnnnnnnnnnnnnnnnnnnnnnnnnnnnnnnnnnnnnatcggtcttggatggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgtgacttctggaggccggattcatccgcgaggtcatccatccggagtggctggcgaacccggtggtcgttcccaaggcgaacggcaagcttcgaatgtgcatcgactacaccgaccttaacaaggcatgtcctaaggatccttaccccctgcctcgcatagatcagattgtcgactccacagcggggtgcgaccttttgtgttttctagatgcatactctggttatcatcaaattcgcatggctagggaggatgaggaaaaaactgcgttcattacccccataggaacttattgttatacgacaatgcccttcgggttaaagaatgcaggtcctacttttcaacgtactactcgaatttctttgggtagccaattaggacgtaatgttgaggcttatgtcgatgacttggttgaaagacgcgcaaccaggaaacgtactttcagatctagcggaaacttt

SEQ ID NO: 29011 - DNA, 1207 bp, Oryza sativa
  unsure (1)..(1207): unsure at all n locations
catgctaactaaacagaaccactgaaacttgagcaaatgtatgtcactaattttcttttgatcttaatgcagaacactgggcaacaagtccaaggtgtccttaacttgattgatttagctggcagtgaacgccttgctaaaagtggctccacgggtgatcgtttgaaggaaactcaggtgagtgtgttcatcacaaatttacaatattcttatttgataatcacattgtcttatctgtttgttttctttatgtttcaggcaatcaataaaagcttgtcagctcttagcgatgttatctttgcaattgcgaaaggagacgatcatgtgcccttcaggaactcaaaacttacataccttttgcaggtgagtgacttgtgcaaatggatggtaatacaaaaacctgcaatccctgaatttatttgaaacatatttcttatatcaactttctattgcagccttgccttggaggtgattccaaaacgctgatgtttgtcaacatttctccggaggcatcatccgttggggagacgatttgttcactgaggttcgcttcaagggtaaatgcttgcgagatcggaataccaagacggcacacacaagcccggtccttcgattccaggctgagctatggctgaagttgctgtggccatcatgatgtgatgataatcgatcagcattggggatatcatttggctgaagctgatgaggccgcttgcttcttgtaacttgtacagtaggaaggagagtggcactgcgctagtgcgctgtgagcagaagagaacacgcatgcatcatgtgttttctttctgttgtagctgatttgagcaatattaactgcattgcaatgtattttctggagtaactttgtatgcaaccgtgggttccaaaatggtgtactacttttgcccggcagaacttcgctgctggctcctgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29012 - DNA, 743 bp, Oryza sativa
  unsure (1)..(743): unsure at all n locations
nnnnnnnnnnnnnnnnnnnnnnnnnnnnnnnnnnnnnnnnnnnnnnnnnnnnactcctaaatatagctcatgattttctaaaaatatataaagcgaactctcacagtgaatttcattttaactaaaacatataacaataataagattaaaatcgacttcacccgttgtaacgtacgggcatttttttctagtatatagaaaaatttaacctataaactattcttttctaacgcgccgtacgacgtattttcgacaattggcccacagacgagggccttaaagatggatttgtgaagggggtttggtgtaatgatgcttggcgtacgttgtcagctagccatttactatttctggtgctttattagttgggggaaaagagcatgaccgctgctgtcccctctcaaagctcctgagttttttcgccttaaaaccacgtttcgtccttgccaaacgtggtccactgaagtgccagtgctttgttgtttgagtaatcgagttataattggtacagtatctgcgagcttaatacagatgtcaccgctgttctggattgcaatcctgttttgattagggagtgtattgattaccttgtactcctacataatggcaccgatagtggcctagcgatgcccagtgatgcgttctcttgcagttcacgcaaaacgtgacaatggtataatcgatgttagaccgtgtaccctcttgcaagatgtatgtcaggagaacgccgtaccagactacca

SEQ ID NO: 29013 - DNA, 530 bp, Oryza sativa
  unsure (1)..(530): unsure at all n locations
acttagacttggtcaccgccgcttgggctttaacctaacaccagtggcatgggtgtaaataaatcgaaatcgaaggggtggggtgggtacccatgatgcgtcagcgtccaaaatatttcgaaagagatcgtccgcctagtcctcttcttctccttcctctctctctctcttctcccacacatctctcgctcagatccgagcgaggcgagaaatccatgaaaaatcgagggtaatctccgctcggtggcttcaaaaacttcgaatccttccccaatttcatcggctccgcagtttttttctcgaggtttttcggatctaaagcgcggctttgtcggcgcttgtaagccacgagagagagagattcttgtgccttcgagctcactccatccggccccaagaaagctcccctcctcccacccgccgccaccactgaggaggagagaaccctaactataacccctaatcctgccactaannnnnnnnnnnnnnnnnnnnnnnnnnnnnnnnnnnnnnnnnnnnnnnnnnnnnnn

SEQ ID NO: 29014 - DNA, 549 bp, Oryza sativa
  unsure (1)..(549): unsure at all n locations
nnnnnnnnnnnnnnnnnnnnnnnnnnnnnnnnnnnnnnnnnnnnnnnnnnnnnnnnnnnnnnnnnncagattaagttgatctatacaaaaaagaggcctgaaggccttagaagaaagaaaaagaaaaaactagagattagcgggggcctgggggctcaatccgatgcgcccgggtcgccggcctcgtcgtcactgtcgtctgcaccgctggcgtcgccctcctcgtcggagttgggggcgaacgcgagccgaggggccgagccctcgaagctgtggacgatgtggtcggcggcatcccggacctgcgcgcgcgcgctgtcttcagtcccaggagggaactcatccagcgccatccacggagagaagttggggtccctggcctggtagctcgccaggacgagctccacccgctccttgggcgaggtccctcgaggatgacttgacggtcttctcgagcttctcggggagctgctggagagccccggccatcttcgagaggtgctgagcgaggcctccntggttggtggagtacttcattgtctggccttt

SEQ ID NO: 29015 - DNA, 513 bp, Oryza sativa
  unsure (1)..(513): unsure at all n locations
nnnnnnnnnnnnnnnnnnnnnnnnnnnnnnnnnnnnnnnnnnnnnnnnnnnnnnnnnaatctgatcatgcgttgctatgtacgcagcatcgaagagcatcaccccgagaagccgaccatctcgctctcgtcggcgaagctcatcggcgaagggttcgagttcaagtacaagaacctggacgagatgtacgacgacctcgtcgcgtacggcaaggccctggggttgatccccaactgatggtgatgatgggcggcgtaattccactgctttggcgattacgaccaaacgtgtgttgctttcaaaaatactattgtgtctagcattctattgctacattgctagtagtactagtaccaagttccaatacatttggcggtttggctgtacttcgttctgttcatgtaagaggaggattgagaatttgagatcctcttagggggtaagctgtctaattctccggaaaggattagctgaaatcctctaatagtttttgcaataccaacgtactttccc

SEQ ID NO: 29016 - DNA, 837 bp, Oryza sativa
  unsure (1)..(837): unsure at all n locations
nnnnnnnnnnnnnnnnnnnnnnnnnnnnnnnnnnnnnnnnnnnnnnnnnnnnnnnnnnnnnnnnnnnnnnnnnttgtataagttttaccagaccctgtttgaccataagcaaatatgcaaacctgcatcatgcaaaaataacttaagcataccaaattgacaagtacttcaaaactgaaataaactagaaacatcagtcagagtttcaagataatggtgattatacaaatgcagaatgcaggtgatatatactagaaacatcaatgtaagatgttcacggcttttagcatgtatttgtgcttatgtggtggtgctgaagagataaaatttggggtgccaccatatcaattaaaacaactttcatttgttcttgaaataaaaaaaataaagttaggatatttgagttattagagacaggaacctcatgaacagattattcaccaatacttcattgttgtagtgaaatattcataccttgtacccatcaagtgcactttgaactagttgtgacatttccacaaacacatcttcttgtgaagcaccgtgatcgaaaactttgtcatatgagaaggaaaatctctgacctacatcaacacaaaacaataaaatgaagtctccgattaactttaccactgaaaacttagtgggggaaacatagtttctgtttagcttcaacaatgaatatgattttaccttggttcatcaaatcaataccacgcccggcagattcaactgatgttggatatgaaataagggcttcttctgcaccactagaatcgttgtcttgcaaaagtggtcggaccctacaaaacactctgatgtttcctttaagctcct

SEQ ID NO: 29017 - DNA, 513 bp, Oryza sativa
  unsure (1)..(513): unsure at all n locations
nnnnnnnnnnnnnnnnnnnnnnnnnnnnnnnnnnnnnnnatcggcccaaatcggcacagggttagcctcggggtcagagggcgataggtgcggccttcccgcagtggcctcggggccttcctgggggtcgggggctcctagcaccgtctgacaagcgggcagagggccatctccggtcgtcgggggccttgggccaccgttcggctcgggggcctctcctccctgctctctcccgggccaagtcggcacaaggtgggggtgcgcggaatgaggattgtcctcatcgcgttccacgaccaacgccgcactaaccacttgcggggtcgccgctaagtagagtagcaagggttcatttggctctggggcgaccagaactgggggagagctgagatacaccttcaactgagtgagggcacgttcaaccttctccgtccaagaaaacggccggagcgtttgaggagcttaaataagggtaacgccttctcttcccacctcgatatgaaccgacttatg

SEQ ID NO: 29018 - DNA, 587 bp, Oryza sativa
catgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctgactgaactgacacagttggcggatctgactgagctggtgccattagtgggggtggagtcgagttgtggttgcgctgcttactgttgttgtgactgccaccgttgtaatcgttgtcgaagttactcgggtgatagggacggtgctgacagacgatcagggtggaaggcccacctagctgtcccgtcatgaagcgaggcttctgattgctcccctgaggaaagctgatctgagctggctttctttttcggtccattttgttgcgttgctcttcctgacgaatagccctggacacaagcttatcaaagtcctcataaact

SEQ ID NO: 29019 - DNA, 563 bp, Oryza sativa
  unsure (1)..(563): unsure at all n locations
aattcgagctcggtacccatccgcagaatttcaaattgttgaagctgacaagctacgaaagaaactgcacaatacaatattggtaattgtttcagcatactagcacttcttactaaaaacaatttctctattttactgacagaagaaatttttgagtaaatactgaaattttttcatcttgctattgctacttgttactgattagcctttctatttgcaggagcttaaaggaaacatcagagtgttttgtagggtccgaccacttttgcaagacaacgattctagtggtgcagaagaagcccttatttcatatccaacatcagttgaatctgccgggcgtggtattgatttgatgaaccaaggtaaaatcatattcattgttgaagctaaacagaaactatgtttcccccactaagttttcagtggtaaagttaatcggagacttcattttattgttttgtgttgatgtaggtcagagattttccttctcatatgacaaagttttcgannnnnnnnnnnnnnnnnnnnnnnnnnnnnnnnnnnnnnnnnnnnnnnnnnnnnnn

SEQ ID NO: 29020 - DNA, 8927 bp, Oryza sativa
  unsure (1)..(8927): unsure at all n locations
gtgaccattctgacaccggtcatgtcgccagcagacagccatgattctacgtcgcgcctgctcccggcgaaagtggaggtaggtgcgggccgttccatcaaaaggtgactcgaacggcaaccatgcaaatctccgtctatttctgagaaggtgggggaaatccccacagaaaaaagagggaaatggtgcatgtggtatccccttaagatataaaaggaggaccttgaccactgagagaagggggagctttttcttggattgattttttccagattcggaacctagaacaagggagaggttggctcacactttgtagctgcttcatacacagatccaccaaaacacaggagtagggtattacgcttctcagcggcccgaacctgtatacatcgccggtgtcttctgtgcttccggtctcgcgaaccttccacatacagattgggagcttagagtctcacctagggtccccggccgaaccggcaaaggggggccagcgcggtctcccggtgaggagccccatgctccgtcacaggtgattgggatagatcggtcatcatgccgagaccgtataaatcacttagatcgaaatatacatctataacaggactatatatgtttatagcgtagccgatcagatagatctagcgtgtatcggctaatactccgatactactctatattaagatattgaagcaataataatatatcaaacaagagtttaacatatttagttatggcagtatcttaacataaatggcagatttaacatattaatgaagcaaataggataactgtagttaaatcagatacgatcggctgaaactccgatgctattctaatcaacaactaggtggcaggctagagatcaatattctaagcacgacttaatagatcaaactcgattgatgcagcattaagtatgaaaagaagaacaatatctagacaatcaagccgctagaagattcatagaatggtagatatcttatataatctaaatcaacgttgagatctaacctaatcggctgtcttttgcgtgcaaatgtctgccgaagatagattagacaatgatactgctatagattatgtaaaatatatgataacttgacgaattatataaatgagatacgagtgtcatgaagatggaagcgctaatccctaagaacataattcgtcataacgagttttacctcttgtcgaagatcgaaaccgatgcagctcaacccgaaagcaagaactcgtcgaaataaaactaaagcaaaaggtggcgatgcgccggaattatattgaatgtgtctgtctaaattacatagggctcggggtctatttatacccgaggattacaagatatgcccataccggacacgactattatctctaacaaactctaaactatcacaagtctttgcggcagactcttgcccacacttatctataaggaatttacataaataatcctaattaatagatacaattgatttcccaggactctatccatgcgtggcaatcatcttgaagcacatcaacctgagccggacgtcgcgcacaagttcttttgtcagaatcgactgtatcggcttatttagcttaacccgacattaggcgatcctagccatagccgatcctaaccgtagccgattcagactccagccgattcttgctctgttccagaactcgatctccgcctccaactcttcttgaccaaatcccctttactgatacgaatacttaccaaattctgttgttaacagtggcgcatacaactatacgatacgggggctgctagctggcgcgtgcgcgccaacagcgagcactccctcctcccctttagtcttaaccactatattagttaatatagttaacactaatggtggtaactaggaaagattctggagattttttgggagatttttttactaacagattgaaaatattttaggttagatttgaaaactttcgatttaagttttaaattttaaagtcaaattttgaaaactttcaactcagatttgaaaactttcaactcgagaatcgagattcaaaaactttcaagtccagatttgaaaattttgaaaactttcaatttgagatttgaaaactttcaactcgagattcgaaaactttcaactcgagatttgaaaactttcaactcgagatttgaaaattttgaaaactttcaaatcgagatatgtaaactttctagtcgagatttgaaaactttcaagtttaggtttgaaaattttcaactcaaaatttataaactttcaaactcaaaacatgataaagataaaaaaaatcagaaaaaagtaggaaagaaaaggaaaaaaaggttaaaaaaacgaaaaaaagcgcggagaagtcgcgcgtgcgccgacgcagcggcgctgggccttctgggcctgaaacgcgcgccgccggcagcacgcgcgctaactagcattagcgcggacttaccgggggttcctaggaggcgcgtgcgcgccgactgcttaattcgcgcagccgcgcgcgtctcctcgacgtcttgtccgcgcgcttccgccgctaattatggcaattagtgttaattactgtcattagtattatttttaaaacagtaacaacgtaaataattcagttaccagttttttttagaaaagtaatggaaagttttaaatttgtagtcaaaagattttgaaatttgagctgaaaattttaaattttgatttcaactttttaaattttgatatagaagttttcaagttgagttgaaagttttcaaaattgaagttgaaagtttttaaatttgagtaaaaagtttcaaaaattgagttgaaagttttgaaatttgacttgaaagtttgtaatttgatttgaaagtttcgaatttttagttgaaagtttttgaattgagatgaaaattctaaaattgtgagttgaaaactttcaaatttgaatcgaaagtttttgaattttgagatgaaaattctaaaattgtgagttgaaaactttcaaatttaaatcgaaagttttcaaatgctgagtggaaagttttcaaattttgagttgaaagttttcaaaattttcaatttaaaaatttaatcttctgttaaaaagtttagttaaatgttctaatcactgcgtgcatgtatgtacgtggattgtccaattacaattaggagatactattactaattgagtgtgttactcaacgtgcatatggggcatatatacgtacatgactgaatcatcgttaatcaccgttgaaaagtcactaggcccagcaggcccatgtcagacgcgaagctgaggcgctgccgtcgcgaaacgctcgctgacttgcgggaactagcaatcttgatacgggcgtcctgcactgctcgagccatgcgcgtacaaccagacgtgtataaacacatggtggacgtactttgacctgaaaaagaaatatacatggtgcacagtggagaaggggtggacaggacagaggacacacgggactagtttgtggatgcaagactctttcggtaatgaattacaaacaacgccttgcatgattgcatcatcgccctaaattgaaacagcgatgatatgataccatctctggttgttgcatttagcgacaggcgatcagatcagaggaacgccggtaataactgaactatcgtcgtcctagctagttctcaggcggactgggaggggtcgaagtaggcggcgtgtcctcccgacgagatgtcagcggttgagatgaagacggcgtgcgtgaccggcgggaacgggtatatcgcttcggcgctcatcaagatgctgcttcagaagggatatgctgtcaacacgacggtcagaaacccaggtggtattatttcccgttttaatcttctgttcatacgtattcagcccttgttaagttccaaacatttttatcaaacttccaacttttccatcacatcaaaacttttctacacacaaacttccaacttttccatattctaatttcaagcaaacctccaattttgacgtgaactaagcacagttaaagttttccttcctttcagattcaggggtggaatctttggtccgcagtagcatattttctgaattgtcgtcatgaacaacagaaagaaagtcctactttgtgataaaaaagattctagaaaaataataagatatataccaatccagagatatattcaaatttcaacttatacaattattagaacaaaaataacaaatttggttgcaaattacacgttttatttgagtcaaatttgtcgttttcatttctacttatgtaagctgattttgaacttgtattgtttgtgaaataatatatcacatattgatcaatcttgttaattttttaagaaaaataatgattttttttggcgaaatgcaaaataacgagagaacattcccgaggatgaatatttttttcgcgaacgcgcaaaaagattgcacttcaatatatattagaagaaaatgagtttttgttacacaacacaatcagccagactggcttatgccaaggaaagaggaaaaaagcaaaaaaaaaaaaaagtaaactaaagcttaggaagtactacggcggctaaacgcaactcctaacagcgggaaggggcatagccacgctacactcccaaaaaatccccaaaagtggcaccacagatgaccctccgagaggatggattccaggaccacagggactgaagagagcaccgagtcaaaaacccagaagttccgttccttccacggctgccaagagaccagagcaccagggtcctgaggatgaatagaattttcccttctacttagcaaatgccaaatgccactcttacctgcaccatgtagaaaatattttttttagataatgtagaaaatatttacatgttcaaaccgatagtcgcacctaattcatatagtgaaatatgctggaaaggatgcaaatcgttatgatctcaattctcaagacgacgctactacgagtttccagagttcagttctgcctctgaagatcctactcttgtgtattcagatgacatgaagaagacttcccatctcaaggacttggaagcactaggccccttggaggtcttccgcgctgacatggacgaagaaggcagcttcgacgatgccgttgccggctgcgattacgccttcctcgtcgccgctccggtgaatttccagtcacagaatcctgaggtgaacagctagctaattagcgcgctttctctaatcgacaccactgcatgttgtgttgtctcatctctgatgatatatatatatatatatatatatatatgctctctaagtctccagttctgaaattaatttgctcttgatttctacgatgacaaagctgcatttgtacgttaatttatggcagaaagagcttattgaagccggcgtccaaggaaccatgaatgtgatgaggtcgtgcgtgagagccggcacggtgaagcgcgtgatcctcacatcgtcggcgcccgccgtctccggcaggccgctgcaaggcgacggccatgtcctggacgaggattcctggtccgacgtcgagtacctgacgaaagagaagccaccagcttgggtcacgttctaccttttttgagcctccatctcatccctacaatttttttgataatgcatagaaatccatctctatatccactcaaacaaacgttacgaatagaagtacttaaactctaaaaagaagaaacaatgctactactagaagactagtatactccataaagatgatgacgccctaatgcttatagatggccatatggctcgagacccgcggcccagcccaaggcatgccaatttagcccggcccaagcacgtcacagcccaaccggggtcgtgctcgtgccggcctgacccgacagccgggctgtgcttgggccactcccttggcacggtggaccggtccggcacggcatgatcgaacaaaaatagtggagggatgtaaaatagacttatgctagcccaaagacaagaggaatacaaaatagatttatttttcagccatatgaacacagcccacagagtttaggtaggaaaaatagacttattctgtagagaagcacgataggttgtcgtgccttcgggctagcccagcacggcttgagtcttactgggccgtgtgtgtagcccgtgagctggcacggcacgtcccggtgtgtagggccaggccggcccgactgacctcaccctaggcatggctgtgccgggcgatctatttggcatctatactaacgttagcataccccattattgtttttcgcaggcgtatagtgtctcaaaggtgctcatggagaaggcagcatgcaaattagcggaggagaacaacatcagcctcatcaccgtgttcccggtgttcactttgggtgcagcgccgacgccgacggccgcaacaagcgtctcagctatgctctccttgctatctagtgagaacctgatcgagagacatgcgccaaattagtttaagaagatcagcgagcacaaattcgactgatcgatgctagctgttttctgttttttcaggtgatgagacgcagctaaaaaccctgaaaggcctggcagcaaccggccccattccgacagttcacgtggacgacctctgccgcgccgaggtattcgtcgccgagaaggagtcggcgtcggggaggtacatctgcagcagcctcagcaccaccgtcgtggcattcgcccgtttcgtggcaggaaagcaccctcggtacaacgtcaaaactgacgggtacgtacttacgtacgaactggcaatctggcactctcagtttcgagttatagcgacacaaacttctactacattcgttttaaaaaaaatccaattctaaatttgaatctggacataaattcaggattgggtttttttttacggaggtagtacggtgaatcagggaagagaactgacggtgaatcggtgatcgtctcttgtatgcgtatattggcagcttccaagggttccctgagaagccgagagtgtgctattcgtcggagaagctggtgagggaagggttcgagttcaagtggacggatctggacgaggtatttgacgacctcatcgagtatggcaaggtcctggggattctaccgcaatgaaccgctgatgatgctccttcactttggagtttggactggtcactcttgtgtgaaatgaagtcattgtcgtggtgtgttagtacttgtcacgacacacggtatggcaagatacgataagtacttctattgttatgggctctactacaaataaggaagcgatggatcggccgcacaaattaggcccatcacaatgcaagcgtcatatcccgcacgattctgaatcacaccacgcgacgcgacgcccgcacgggcaacagcgacaccgcactccgcacgcaggcacccgcgatcgcagcggaaaccgccacataatgctgttcgcgatgagcccccccgcgtaccggtgaatctgcgtgcgccacgcgcgcgcgacgccacgcgacgcgtgcagaatcgatcgcgcgcggccgggatgggatccggacgggacgacgattgatctcggagcgagtgaggtgcggcgttaagatccaacgcaggagtcgtgacatcctgcacgtacgtacacgtgctggacttggactgacgtggtggcagcagctactactgcatgccaaaacccttgagacgtcgcgagcgaatagaacgccactgcccgggcggacaccatgtgggactaaaaaaacgtacacgatcgtacgtgctcgatcgatgacgggagaattggaagggagcgcatggtggacacgaggaaaagagaagatttagaaggaacgtatggtgaagtattagtatataatttattactccttctgttctagattacaagacgttttaactgttttaagtttgaacaattttgtaaaaaaaatactaagacaaatttattaaaaaacatatttaattattgatttgatgaaactaatttagtattataaatattactatattacctataaactttgactttgaccaaagttaaaacgtcttataacctaaaacggagagtaattataaactatcttgaatttaaaaataagttaatatgatttttagaataatttttctatataattttcttaaaaaaatccatcaatagttcgggaaacgtgtgtgcagagaatgagagaaatcttttctcagtgtacaactgcataacacggtcttaaagagaaatcttctctcaatatatagctgccgaactaaataatcatagttctccataaaaatgaaaaaaaaaaaccttatcattagggatgtgtcgggcatggccagctatgggcacttgggcagcagtgcagcactgccccactccgatacatcgatggcaatccttttcttctcagccggataaagccttgtagatataaaaaattgacttctcaaatcatctggttggactatgagtagaccaaatacattacgcacatttctcttgagcatatatacgccactaataaacagctcaagacaaccaaacgcaggcgcccatatcagccacggcatgcattgccatacttaatccatgttagattcaaagtcgccttatcggataggtatttttgtgcagcacggcaacctgtccaaaaagcacacaagtactagtacatgactgtaaaatgcaaagccaatcgcaattacagtcttccaattccaacttgtccaaagatacttcaccttggagtgcgtttagtttacgttaaaattaaaaatttggttgaaattgaaacgatgtgacaaaaaaagttaaaattttatatgtgtaaaaaagttttgacgtgatgaaaaagttgaaagtttgaaaaaaaaaaggtttagaactaaactcagccctaatgcatccaacgatggtannnnnnnnnnnnnnnnnnnnnnnnnnnnnnnnnnnn

SEQ ID NO: 29021 - DNA, 1617 bp, Oryza sativa
  unsure (1)..(1617): unsure at all n locations
cggcgcgttagcatcgacgacgcgctggcgtggcacgcggggaagttcggggcggtggcagctgcggcacttcgtgctggtgtcgtcggcgtggctgctgaaggcgctgcacaccatggtcatcatcttcgccgaccgggagcgggccatggtgtgcgccgccggggacggccggttcggcgaccgctgcgccggcgccggcgcccccgcggggaccgggtgggagtgggccagcgggcgcgcctcgtcgacggtgtccgagtggggcctcgtctgcggcgagcggtacaaggtcggcctcgtccaggccatcttcttcgccggatgcatgattggtcagtgctccaattctcgtccaaattaccttcgtttccaagtagtttttttttttgacgaattacgcaacggaatgccaaaatgcaaaatactaagattggatgaaacgcttgccttaattgtggcatcgacgtgagaggcaatacgtaatatacgagactaatccgtgaaacaaaaataggctagcatttcaaactagattggacgatggattgcagaccgcgacgttccgggagatttcgtggtggtgcatttttgcagcccggaatcgtacgtgtggctccagctagtttggttgcatacggccgcatcttggagctagctagccagccagccagccagccaacatcccagcgtgtgctactgtagttcattgtcccatccgtttaatttttctactagtaacagataaagggtccgatttactactgaacaattgcatatttgcatcacactcgttaacaatttagattggttgtcattacacatgagattagatttgacaggtcaactttatgccatcagccactcagcattagcatcgtcgacataatggatgtaaattactgagcattatctgcacaagcggcgccgtgccaatgcctcccttatctttccgcggctgctggcggctgggagattaattaattaggttccggacagttcggtgttcagcttttgcttgactcctgtaccgtcttaacatcatctttcgctaactttaattccaaaagctgtcgatcgatcgaacccaatatgctgcctggaccctgttagccgtgggttcctgcatgcgtggctgcgctcactgtcgttatttgctttagcccaacctgtcactgttgttaacctactgtcaatataattgatcaggtcactgaattgattacgttatctcacggtgctcgatgaaaagctagccgtctagttcggctgatctgatctaaatcacgtggcaataggccgaatgcagattgtgtctcgcagaaatttccttccttgtttctcagcgcatgtttaaatagctgttattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29022 - DNA, 678 bp, Oryza sativa
  unsure (1)..(678): unsure at all n locations
nnnnnnnnnnnnnnnnnnnnnnnnnnnnnnnnnnnnnnnnnnnnnnnnnnnnnnncatgcatcatgtgttttctttctgttgtagctgatttgagcaatattaactgcattgcaatgtattttctggagtaactttgtatgcaaccgtgggttccaaaatggtgtactacttttgcccggcagaacttcgctgctggctcctgcatcaaaatgatggttatgccacgaaatgtgtatcggttcgtgccatatgatttgtaactctgtatttccctgcgttttagttctgtcatggaatgcgtattcattctccgtcgatgcatccactgaactgcagtgcaaatgcagtcagtgctcatgaagtttttcagttgcaaacttggaatatattccacagaaccacagaacttgcggtggacgaagattaactgcaggtacatgattaattgagggttattacctcaaatattaaaaaataatttatctaataatttaaaacaacttctatataagaaagttgacaaaatgcactgtctagtagtttgaaaaacatgcctataaaatgaggtaaatcaggatcactgtatcacaatgagaaatgaaccgactatgccctttttttttcttcttcaatcgatttcaagatgcactatggtaaacgactatgccatactcttt

SEQ ID NO: 29023 - DNA, 817 bp, Oryza sativa
gtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagagggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatgccaagccaattgagtgcagcaaagcacaaacaatatgggctttatagcctgtgcagatatagctctttcattggtgtgttctgccaccacataactttcaaagttgtt

SEQ ID NO: 29024 - DNA, 3323 bp, Oryza sativa
catatcatttggacactttggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcgtggcagagggttggtgccctgctgcttggggctcagtcctgcctgcctgtcccgggggttccggccgtaggcaggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgccgtttactgcaaaacttaacccctatcttattatccccttgtactcctttgcattaattgtgcatctccggtgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcttttataccatgtttgtgtggtgtaccccggcttttcctgggacggggattaatacactggcgttcgggaaaaggcaattttcccggtcgcgacacagactacccggggcggtccgtcttctttctcccttttgcaatggcagggctggttccgctattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttctttaccgtgcagtcggtgtcgccgccatcggtagtcggtggctgctacttccagccacgggggccggcgctgaaccgctacatcccctgcgccctccgcaagaagtgggacgactggaagagcgattggttctacactcccctcgccgacgaagcgcgcctccgacttccgagccagcccccggcgcaggcctccagttggcgggcgccggtagatctgggggatggctatgacgctgtcctcgaccgcctggcgggcctgcgatcccaggggctcacaggggccatggtgtatggcgactacctccgtcgtcggattgcgccgctccagcggcgcgctcggggcgcctgggagtacaccgggtccgaagactacatgaggacccaccagggagtgagatgggactgggctcctgaggacttcaagatattggtccaacgggctgctgaatctcaactccgtggaggcggccctcattccccaaggaatcctccccctctgcagcgatccagaccgcgcctccatcttgaccattatgacggcagtcggggcctcagaggagggagctccaaagggccacgacggcgcaggcgggagccgcaagggggatcaatctaccccaggagggggtcgtgcttctgggccccgcgtcaggggctcggggagcaaccgccctatcgacgaccgggggaagaggaagctgggacgaacacctcccccatctcctccccgagggggcggggcagtgcgtgccagcagcaggcgcccggagggggccgcgccaacatcacagcccgagggggagcgcaagaagaaacggctccgcaagatgggggagacagaaccatctcggggaaacctcatctcccctccaaagtggtcgttcaaccgaccccctcgcaggttcatctctcactcatcgtggctgtatccattctcttcaacgcgagttttcactcacccgtctttgttcgtcttctggtcttttcttctgttttagcgagatcccgtcgcgtccctcccgtcattccaagtctggccaatctgaggccgaggatccggcggccgcagaggcacggaggcgagaatctgaccggcgagaggccgcagatcgcctacgggaagctgaagaggccgcccgggaggccgcccgggctcgccaggctgaggataccgctcgggaggaggccgcccgagcccaccaggccgaggaagccgctcgggagaaagccggatttcgccaggacgaggcaatggtttcttccgaggcagctcgcgacgaggtcgcgggcgcatcgcttgggcccactccctcgggcgacgctcaggcgacaacttccggggcagctggcgacgaggctgcgggcgcgtcgcctgggcccactccttcgggcgacgcccaggaccaaacaggtccggggaacatccccgagtccggcacgtccattggcgggccgagccgcgcgacatcttctccaaggcagctcttccccacgccttccgtcgccccgctgagcgcagagccccttctgcaggccttagccgccgcaaacaccgcggtgttggatgggttaagtgcccaggtggaggccctgcaggcggagcgtgcggagctcgacgccgcatgggcgcgtgtcgaggaggggcggcgatcggtggaggccatggtggaagcgggccgcaaggcacaccgccggcacgtctcagatcttgaagcccgtaagacggcgctggcggagatcgctcaagaggtggaggaggagcggggggctgccctcatcgccaccaccgtgatgaacgaggcgcaggacaccctccgccttcaatacgggagctgggaggcggagctaaagaaaaagctcgacgccg

SEQ ID NO: 29025 - DNA, 1315 bp, Oryza sativa
  unsure (1)..(1315): unsure at all n locations
acttagccacccgcctcgcagctaccgaactcaccatcgccgacatgcagcgcgcgctagactcatccgccggggaagccgaggccctccgcttggcgggcgagatagggcccggcatgctttgggatgcagtctcccatctggatcgcgccggtcggcaggcgggcctctggaaaggccagacaatgaagtactccaccaaccagggaggcctcgctcagcacctctcgaagatggccggggctctccagcagctccccgaggagctcgagaagaccgtcaagtcatcctcgagggacctcgcccaaggagcggtggagctcgtcctggcgagctaccaggccagggaccccaacttctctccgtggatggcgctggatgagttccctcctgggactgaagacagcgcgcgcgcgcaggtccgggatgccgccgaccacatcgtccacagcttcgagggctcggcccctcggctcgcgttcgcccccaactccgacgaggagggcgacgccagcggtgcagacgacagtgacgacgaggccggcgacccgggcgcatcggattgagcccccaggcccccgctaatctctagttttttctttttctttcttctaaggccttcaggcctcttttttgtatagatcaacttaatctgcaatcaaaaatgatgaaaatttttgtgttaattttactttgctatacaaatgagatgaggatgatctgtgccgtggtccttttgtgtcttagcttgatttaaggactcgtgcccaagtcccagtcctcgaaaggcgcgggtcggggctagtgcctggggagatccacatgtcgaggctggccaggccgggaacgtggtgaccgagggttatgggtgacccgattgtgggtttttgccgattcccccccccggagttcaccacgccccagggcacggctcggttctgggccccgtttggcgattttagctgaccgaaccgagcccccgagggcaaggttgagcacgagtgatcttatttcaagtcaaaattcttcaaaaaggaaaaaacggcacagatacagcccttaggaaattgaaactgcttttattgaaatactgaaataagagaaaagagaatgtgcatgtgtggtagcccccggccaaccatgcacacccgagggggggggtacggggttggcccgagcccgaaacctgacacccgacccccccctcaggggtagaagcgacgaaggtgctcgatgttccatgggttaggcaactcagtnnnnnnnnnnnnnnnnnnnnnnnnnnnnnnnnnnnnnnnnnnnnnnnnnnnnnnng

SEQ ID NO: 29026 - DNA, 7850 bp, Oryza sativa
ggcaaaggttagcacgagtgttcttattccaagtcaaattcttcaaaaagaaaaaacggcacagatccagcccttagaaattgaaactgcttttattgaaatcctgaaataagaaaaaaaagaatgtgcatgtgtggtagcccccgcccaaccatgcacacccgagggggggggtacggggttggcccgagcccgaaacctgacacccgacccccccctcaggggtagaagcgacgaaggtgctcgatgttccatgggttaggcaactcagtgccgtcgcccatggccacccgtatggagcccggccgggggacgccgatcactcgatacggaccctcccacattggtgagagcttgctcaatctagcacgcgtttggacgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacaaagctgatcttgatcagcctcgcagtacatggtggcccgaggagacctcagggtgagctcggatgggagaaccgcttctgcgccgtagacgaggaagaaaggcgtttccccggttgctcggcttggtgtggttcggttcgcctagagcaccgctggcaactcctcgatccatgaatcgccgtgtttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcggtggaccaggtcgaccgcatcattgagagctgtcggccaatagaaaccttggcgaaaagctttaccaaccaaggtgcgcgaggcggagtgtgctccgcattcgccttcatggatatcggcaagaagcacaacgccttgttcccgaggagtgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggttaggcgcatccgtctcccctaaggggtcgggtcgcgccgacggctgggcaagcctttcttcaaaggcgcccggtggggtctgggctcgcgaggacgcgagccgtgagagctcgtcggccatcatgttatcccgtctgggaacgtgccgaagctcaatcccgtcaaaatggcgctccatacgccgtacttggcgcacgtaggcgtccatctgcgagtcagagcaccggtactccttacagacttggttaacgaccagctgggaatcgcctaacaccaggaggcggcggatccccagtccagctgccactctgagtccggcaaggagtccctcgtactctgccatattattggtcgctcgaaagtcgaggcggaccaagtatttgaggacgtctccactcggagaggtcaacgtgacccccgcaccggcgccctgaagagacagggagccgtcgaactgcatcacccagtgggcggtgtgaggcagctgcgagggacccgagccggtttcggggaccgagacgagctcgggagccggggtccattctgccacaaagtcggcgagggcctggctcttgatagcgtggcgtggttcaaagtgcaaatcaaactcagaaagttcgattgcccatttcaccacccgtccagtaccctctcgattatgcaagatttgaccgagggggtaagacgtaaccacagtgacccgatgcgcctggaaataatggcgcagtttcctcgaggccatcagaacagcgtaaagcattttctgggcctgagggtatcgggtcttggcatcccggagggcctcactaacaaagtagacgggccgctgcacctttcggtggggccgatccttttcgctaggggccgcatccctggggcgctcttcacccgagcggcctcgcggggcgcactcgtcttctgtgccgacgacctcggggtcggaggacgacgggggcggccttcccacagtggcttcggggccgtcctgggggtcgggggcccctggcgtcgtcggacaagcgggcagagggccatctccggtcgtcgggagccttgggccaccgttctgctcgggggcctctcctccctgctctctcccgggccaaatcggcacagggttagcctcggggtcagagggcgataggtgcggccttcccgcagtggcctcggggccttcctgggggtcgggggctcctagcaccgtctgacaagcgggcagagggccatctccggtcgtcgggggccttgggccaccgttcggctcgggggcctctcctccctgctctctcccgggccaagtcggcacaaggtgggggtgcgcggaatgaggattgtcctcatcgcgttccacgaccaacgccgcactaaccacttgcggggtcgccgctaagtagagtagcaagggttcatttggctctggggcgaccagaactgggggagagctgagatacaccttcaactgagtgagggcacgttcagcctcctccgtccaagtaaacggcccggagcgtttgaggagcttaaataagggtaacgccttctctcccagcctcgatatgaaccgacttagggcgaccatgcaaccggtgacgcattgcacatccctaagcttgctgggggggcgcatccgctctatagctcgtatcttctcggggttggcctcgatgcctcgggcagagaccaagaacccgagaagcttgcccgtaggtacaccgaacacgcacttatcggggttcagttttatgcgggcggagcggaggctctcaaaagtttccgctagatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggggtaatgaacgcagttttttcctcatcctccctagccatgcgaatttgatgataaccagagtatgcatctagaaaacacaaaaggtcgcaccccgctgtggagtcgacaatctgatctatgcgaggcagggggtaaggatccttaggacatgccttgttaaggtcggtgtagtcgatgcacattcgaagcttgccgttcgccttgggaacgaccaccgggttcgccagccactccggatggatgacctcgcggatgaatccggcctccagaagtcacgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccatccaagagaccaccgatccgtgtggtcttggacgggccgtcgcccaggacaacctccttgactgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctccccaggaccgcgttgtagggcagactgaggtccgccacatcgaagttcactcgctccgtgcggaaattggcgggtccaccgaaggtgaccgggaggtcgatatgacctagcggccaagtgtgccccggcgtcacaccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctccccgggcaacgcacggtgggtggtcggtctggtcgaaagttagggcaacctccgaccaccgcgcccggcgcgtcgcctcatgagtaggggccgcggccagaagctctcgcttcatggccttgaggctccggcgagaaatgtgagcacacgctcctccatcgacagtggcaatggtggccccaggctcttggaaacctaggtcatcatcgccgtcgtcgatgtcctcggcgggggccttcttcttggcctcacttcgccgattgccggaaggaaccgccggggacttgccctctcggcgctcctgcctcctctcttcctcccacttcctcgtccgctcagccaaacttttgactgcacggcagtccgcgaggtcgtgaagggaagtgttgtggacggtgcaccacttgccggctgggcgctccctgctgggagcgccggcctttttctttttgtcgctcgctggcctccccttttgggtggcccgcgaagcgccctcgacggcgaggacatgaccctcgtcgtcggaatggactgacctcttcttcctcctcctgtcacgccgccctgtctgagcggcggatccgggggcggccgaagctgccactccggaaccggaggggttccaggtccatgcctcctccttacgagccactcggtccgcgagctgaaaaagctccgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagatgcaggtggcaagttcattagccaaccccgcgcctgccccttcagggccatgggaaagaaattcgccatgaccctgtcgtcacccccggcggcctcaatcccggtcgtgtagacctggagaaactcggcggggttgatgctgccgtcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgccctccgttgcgtgggcagcacttcggtcattacgccggcgctcgatgctggtgcgggcgtcctgctccccacgcagatcttcccgggtcgaaggagtcgacgaaggagtgacggccgaacggcgaacagcggctgccgctcgtcgtgccctccgtcttgacgacgcggagccggtggtagcagcaccagaggccttggtggcggaggaccgcccaccagcatctaggcgctgccgcgccgtcatgaccaatttggccacgtcgtccagccatcgttgggctggagactccgggtcagggacgacaggcgggtggcgtaagagcgcgcccgtagcttggagcgcgccctggggcgtgctgccgtcgccgtagacgaggaggcgacgctccccatctcgccgttcttttccatcgcccgcgatcggtgaagtcgcggatctttcgaccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggtgcacacgaaagagcgcaagagctcagaagatcactcgcagagtcccctacctggcgcgccagatgacggagcgtggggctcctcaccgggagaccgcgctggcccccctttgccggttcggccggggaccctgggtgagactctaagctcccaatctgtatgtggaaggttcgcgagaccggaagcacagaagacaccggcgatgtatacaggttcgggccgctgagaagcgtaataccctactcctgtgttttggtggatctgtgtatgaagcagctacaaagtgtgagccaacctctcccttgttctaggttccgaatctggaaaaaatcaatccaagaaaaagctcccccttctctcagtggtcaaggtcctccttttatatcttaaggggataccacatgcaccatttccctcttttttctgtggggatttcccccaccttctcagaaatagacggagatttgcatggttgccgttcgagtcaccttctgatggaacggcccgcacctacctccactttcgccgggagcaggcgcgacgtagaatcatggctgtctgctggcgacatgaccggtgtcagaatggtcacaaatcggtcattcttgtccaccacgcgtcagcttagctatctgcacgttggctctccttcacactacattttgcctgtaatggttaggatgaagcctggcatatatctgatcagggctaacgtgccatctctgggaggtaacacgctagctccagctggggacgagcgcctagaagccctcgacctgacgggatggggcgaggcgtgcgtcagaccgcctgccgccacctaacccgcgatctgaccggtctgtgactggtcacagaccggataaacgagtgcactgcactgcgctacatgcggtgtgacacgctcagccaaaccgcaattaatgtggttaggtgagccccactgtgctcacctaacccatacacgcggagcgaaaacccacgaggggtcagggcgcctcggccctcggggccgaggggggtgcagcccgaccccctcggggggactaagaggagggcgaacacatcaccctcgggcccgacgtcccccgagggtgccaggccacgtgggcgattgtgtctgcctcaaacctctagtcatgatactcccgatcccatgtcaccgacagtagcccccggcgttatgccagggcgatcgccctccttaagggaagcggtcgggcgtgacgccactcctaaggcctggtgacaggtgggaccggtctccacaattgggcagaaaaccaaacggtcacaaatcacgcacatcggcagtggtaattcggctgtcaacaatgagcggtctcttcaagactgccacattactcgagtagcacacgaatctggacatggcgattcgtttcatctgaagatatggtaacgtcgcttcggttggcgagcgtaattaacgcg

SEQ ID NO: 29027 - DNA, 9371 bp, Oryza sativa
cctaacccatacacgcggagcgaaaacccacgaggggtcggggcgcctcggccctcggggccgaggggggtgcagcccgaccccatcggggggactaagaggagggcgaacacatcaccctcgggcccgacgtcccccgagggtgccaggccacgtgggcgattgtgtctgcctcaaacctctagtcatgatactcccgatcccatgtcaccgacaacctgatttaagtatacatcgacataagaattatatatcgttaatatctacagccgatcaagtagatttagtttttccttactcattcacgattgccgatcgatacacagatgacatcggctcggatataaatgatatgtcatcggcatctggccgatcggctatcatttatagatttaaccacggttcttttgtctttatttcttgttgattgcaggatcaaatcaactgacacgctcacacatccgaaggcgagttttggacctgcactggagttaagtagatctcccaggcctcgtgttttctgtcaacagccaccccttctccccaccgaccaccgccctcctccacgctgtccgtcggccgttgcgcctggagggaggagaagagagaggagagagatacaatgaagagagggagatggggagagaggtggaagaagaggattgtgagaatgacatgtggggctcacgtgggccccaccggtcttaattatttttttctaactaacatgtaggctaacagtttttattattttccaaattaaattgccacgtaaatgccacgacaatgccacgttatccaaaaacctaattaaattagccacgtaggtgccacgtcagcgaaaaatgagaacaatgttggtgatggatcttgtttgcactggttttgtaagttgagggacccatcatacctagtttttccagtacaaggacgaaaatcagattcaaattaagggactttaaatgaacttattctaaatttgctatgggccaccttgtttacgggttagagagcccataacaataatggttaattggatccagccatgcatcgagcctttttatagatcgcaagtggtctcaaaggtgtggtttttaaaatgggattggtgctggagcactcattggtgccgcatccctagtgtcggttgagaaaaccgataccttaagaggtttttcacatgttctgtggtagtgaaagggtccgtatcataaagagattaccataccgtaacacacaacaatgacttatttcacaagacaagaggactaacaatttcacaagagaatttttatgtccaaaactccaaattgacggagcaaccatcaattcagtgcggtagaatccccagggccttgccgtactcgacgaggtcgccgaatatctcgtccagatccgtccacttgaactcgaacccttccctcgtcagcttctccgacgaatagcacactctcggcttctcagggaacccttcgaaactacgagcaaacaaagattatcgctggctcatcaggttctctcaagaaatgcatgtgtcgatcgatcagtcacttgaaagttgaaactgaaagtgccagttcgtgtatatgtaccagtcggtttggacgttgtactgagggtattttgctgccgcgaaacgtgcgagcgccatcacggtggtgctgaggctgctgcagatgtacctccccgacgccgactccttctccgcgaggaatatctcggcgcggcagacgtcgtccacgtgaaccaccggaatggagccggtggccgccaggcctttcagggtttttagctgcgcctcatcacctgaaaaagaaacaacgtcaatcgtaacacataatggaagtacatactctcttaattctaaaataaacaaatcaaatataaaatgtgatatatcttgaatctgaacaaataaaagagtagcttcttaaatttgacgtatgtttctcaggctctcaccagacagcaaggagagcgtagttgggatgcttgttgtggtcaacggcgtcggcgccgcgcccaaggtgaacaccgggagcacggtgatgaggctgatgtcgttctcctccgcgaatttgcacgccgccttctccaaaagcaccttcgagacaccatacgcctgcaaaacgcaaacgcaaaaacaatggggtgtgctagcatcagccagccgtcattttcatcagcccggtaaaaaatgtatatgaatgatttgatggaggaccaaaaaagaaaggagtagaatgtgacccaagatggtggcttctctctcgtcaggtagtcgacgtcggaccaggacgactcgtccaggacatggccgacgccgccttgcagcggacggagggcgacggcggccgccgacgatgtcagaatcacgcgcttcaccgtgccggctctcaggcacgatctcatcacgttcagggttccttggacgccggcttcaatcatctctttctgccatcaaacgttggcaggaaacccagcttaatttgtcatcgtagaagttaagagcaaattaatttcagtactagagactaaagagcatgcttatcatcagatgacacaagacaactgtcaactgtgacgtcgattagagaaaaccggattaattagctaagctagctgttcacctcaggattctctgactggagattcaccggagcggcgacgaggaaggcgtaatcgcagccgttgacggcttcatcgaagctgccatcttcgtcaaggtcggcacggaagaccttcaaggtgcctagtgcctccaaccccttgagatgggaattcttcctcatgtcatctgaatacacaagagtaggatcgtcagatgtgaaactgaactctgaaaattcgtagcgttgtcttgagaattgagatcataaagatttgcatccatcgtttccagcatatgtcactatatcagttggaacatataaagattttctatatggtgcagatagaagaactttttctattgttcatgacgacagttcagcaaataaactacctctgaccaaaagatttttgaatctgaatgggagaaagactgtggccctgtttagatttcatttttcttctttaaactttcaactttttcgtcacatcgaactttcctacatacataaatttctaactttttcattacatcgttctaatttcattgaacttctaattttggcatgaaactaatcacagcctgtaactgaaatcatgaacaacaaaaaagggggaagaatctcaccagggtttctgactgtcgtgttgacagcatatcccttctgaagcagcatcttgatgagcgccgaagcgatatacccgttcccgccggtcacgcacgccgtcttcatcccaaccgctgacatcgccgtgccgccggctacttcgtcccctccaggctccactacgtcctcctgagagaaatagcttactggaatgaagacggcggttgtaagagtacaagagtacagtcactgtcactgacgttcatctgataggatatgcttgtcagttgtcaccaataagaaatctttgttatttagatgcaaaggtatgtttgtattcagggagtaaactttattccatgtcacattggatatttggatgctaatttagagtattaaacatagaataattacaagactaattgcataaatgagagttaattcacgagacattttttaagcctaatcaattcataattagcacatgtttactatagcatcacatagactaatcatggattaattaggctcaatagattcatctcacgaattagtccagggttatgtaatgagttttgtcattagtctacgtttaatctatctattaatctaaagccagtggttatgccagcttttgattgggccacgtggcgcccctagcttatcaaataaatcatgaattttgtctaaggaaaaaaatacagaagatcaagcaaaatagaaaactacagtgttatgtgataattctaaaagcaagtagtaccttagcagtttcttttaagaaaaagttgtaccttaacaacacagcatccagaacatctagctgttcccacccggtaaaaaaaaaaatcagcttccagaagcttctaactgtacatcacttcgcaataaacatagagactttctagaaccactcaaatataaatcataatttaagataagtctagttaaagtatctagatccatagacttatacatctagattatagtcctttgcaacaacatcactcctagaggcattcaaatatccgatagaagaaaactcagaattattaaaaaaaaaaagggaaatccaataaaaaatatgagcaacagggtcctcagctatcgtatcaccgtgtagcaccaagtcaattgaccatttcaattcctccttttttcagtttccagttaccatcgtatcttatgaaccaagtgtacttcctccactaatataaaatattcccaatctttttcttagagagataagtatggagtgaaaaaactataatgccatttattaaataaaatatagttgaaaaatgacagaatggttagaagtaagacatgaagaaaattaaatcaagaggtgagtgatacgacacgcagtgctcaatttggcaggaccttccagcttttctgtagctaaagctcaacaaagttttttctgctctataaaaaagagagtggagcagactatagtgacctagaaaaatgaggggtggagtgaacacaaagaccgtcaataggccactacttaacttcaaattctacttctagcatttaggagttggatccttccacctaatatttgtggacatcaagagtattatggattattgagagcaagctttgtaagtttacgattttctgtaacttttttttattacaatcactcctttttttaaaaaaatattaatcttctaatatttttttcagagaaccttctattatttaactccacctactttctactttcttaatactttatagtatttaattatatcaaaaatttgttagaaactcaacatctataattaatcgtccaccagaaacatagagaacacacaatcccaaattaacattacaggagattatgctcagaacgatatgcaagagaatacaatatttaatggaacatagaagttgaacgaaatgctaaaaatatcttacaaaattttcatgtttcaaacacacgctaaacaatgtatcgggctataaagaaagtgtgccaaccggcacactaatgttctggtacttctaattagtgtccaaacatccgatgtgacatggcttaaagttttagtccctgatccaaacatttcaaattattttaggacgaggatgcaacactatgtgcggggttggaccatctatggaaagaaggatggaccatttacggaactgtccttacagaactgttcagttgatatgaaagtgggtggttgtttggttgatatctgattgaggagtactcctttcgtctcataaaaaatcaaccaagtatcgaatgtgacacatgctagttgttgacgagtactacaaataaaaaccaaatctatgaccggatgtatagatggccatccgggcggcacggcccaggcacggtcgtgtttaatgaaatatatttaatgtagtgtttaatgaaataaattttgtgttgtaaatgttgctaattttttctataaacttagtcaaaccttttactgaaaatgtttgacaaaaaaagttcaaaatgatttataatatgaaatggatgtagtattaactactataaatatgccaaatggttttattagattttttaaagaaacttaaaaacatgtccataatatacatcttttaacagtttatgaagcggctaaaaaaacaagtggcatccctaacagaccaacgaacggagccttaggtccctcaaaatggacatcccctaatttcttacgtatcaaccaaatgattcttgttaaatttttttataaaaaatatataaatgacatgcaagaacgaaggatatgctctaagggtattaaacttcattgccattatccactgtgtattaggctcatcttaaaacactgtactatttttttttctttaaaaacactgatcacttatttcgcaagcgcatactccagttcggtcctcgtgacagctaggttgaaggtagagcagcatcagctattcgttcaatgtggtagaattcccagggccctgccgtactctacaaggtcatcgagtatgtcgcccatattcgtgtacttgaactcgaacccttccctgatcagcttctccgacgaacagcagactctcggtttctcaggcatcccgtcgaagctgcaaagatacagagacgatcactcgctcgtcagatcgaacacaacaatatttatctattttggatttccaagttggtcaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacggagccggtgacccactgcaggggcttcaggacttcgagatgcgtctcatcacctgagaagtagtagtaaaaaaacagcagccaacttaaactgtgtaacacgcgttgcaaagagtgttgagacttggggtctgtttggagttttaagattacaatctggaaaaattgtgtttcccagcttcattttttggattttacaattatatcttcttataatctaaatcaaaagctgaactgtttagagcaacttctaattctagaatatactgcagcagctagaagctccccccaaacaggccctttgtgggagctagcttgttgatttgattgctgttgctggtgcttctagctcaccggatagcaaggagaggatgccggggacgctcgtcctcgccaccggcgccggcgctgcgcccaaggtgaacaccgggaacacggtgacgaggctcatgttgttctcctccgcgaacttgcatgcggccttctccaaaagcaccttggacacactgtacgcctgcaaacgcaaatgccattgccaattgggtgcaagcttattttcgttggtaaatttaaagaacttttcggtccaatatactgagtattttaagaatttttatcaaattaaaaatggtattttagtaattttcattctagtttgcaacagcgcagtgtctcatggtggtgaaaataatgcctatctctactccctctgtccttaaataactcaacctcttatgacacatcctactattctagtaaaacgaatctagacactctaggatgttacgagatttttttttaacggagggagtatttcgctataagttgtgagtttacataattaccctcatccaatagtatggaaagacaattttaccccctttaattttatactataatatattaaagcacaaggaaatattcataaaaatctttgaattgtttgtactggcagcacatactagtagtagcatatattagtatatattgtacggtaaaagttttcttgaatttatggataagatggagatgtgaaaatgtcaagagagaggaacgtcacccaggctggcggcttctctgttctcaggtagtcgacgtcagaccaggactcctcgtccagcacatacccgtcgccttgcagcggccttctggagatcgctgcgtccgacgatgttatgatcacgcgcttcaccgtccctactttcgcgcacgatctcatcgcgttgagcgttccattgacggcggcttcaaccagatctttctgccaccaccatcaacatcgcaaaaaaaaaaaaaaaaaaaggaaatcaagattagtagagcacatcagttacagagtatcagagtcaatagtgatgttaattagctgttcacctcaggattctctgaattgaagttcatcggagcggcgacgaggaaggcgtagtcgcagccggcgatggcatcgtcgaagcttccttcttcgtccatgtcggcgcggaagaccttcaaggggccaagtgcctgcaagtccttgaggtgggagttcttcgccatgtcatctgaatacaaaccgcagcaattagtggaatcttcagagatgaaactgaaactctgaaaattcacaccatcgtattgataaagtcgcatcatattttgatccatcatatgtcacgatatatatatgtaactatcggttggaagttggaaaaggataagatttgacaacttctccctttcgaaagatatgatattgtccacatgtgcggctaagcctgccatttgctaatgagtggttaagcgaaaacactcgctaattagctcatatggtactagcaggccgaggatatgatcatatgaatggaagaaacactgcaaaaaaagtaaaaaacacgaactagagagtgaaaaaaggaggagaatcttaccggggtttctgaccgtcgtgttgacagcatatcccttctccaacagcatcttgatgagcgcagaagcgatgtacccgttgccgccggtgacgcacgccgtcttcctctcgaccgccgacatcgtcgtcgtcgatcggtcgctacaacaacccaccagcccagatgagacgaagaggacgaggaatttatgtttgttgctgtactttgggaagagttcaatttgtctagtgaggtggtctggcgtgcttatcagtaagattttttttaagtactaccgaaaagaaacatgctgacatcatgcactatatccagaatatcaccttattgtaaaataaaaccggtgcggtgcgagttgggtggttgattgagacatgtatagagaattagctaagagttattttaaaaactactaatttttaagaaaaaaatagccatccaataaaatagtctcaagttgtttagatccaagggttattttaagagctatttaatctttaatgcactttctcatggagagagataaagagaaaagacattttttagtgggccccacctgaaatagccctaattagtattcttaagggggatagtttttttggatgtgttattttcaaatagccctgaaatagctcacctatttataacttttagattatttgcagctatttgaaagaggactgaaaagtaacccatgaatctaaacaggtcctgagtcggagcgtcgattacgcacgtcagctgggttaaagtgtcaatatggagtggacaacaagatcgtcatatcacgctctcagcaatggtatgcgtagctggtagagtcaaaggagcatgcgtgcgtctggaccgatggattcatggccgtccatcggcat

SEQ ID NO: 29028 - DNA, 8750 bp, Oryza sativa
  unsure (1)..(8750): unsure at all n locations
gagaaaattgcatatgtactactcattaaaaactggcttcgctataatatcattctcaagatgggatttgcccaaacgccactcataatatatgggtattcgctgaaatgccacttcaggttttcttccatttcgaaaatatttttcatcaatttcaatttttctcagactattatgcccctgagactctttcttctcctcggttcaatctagcgagcgtgagaaggtgagaagagaatcggcagcgacaccggcgccgcccaccaccactgcgccaccgctacctcagctccagccgccgcgccgaggtcctccccagctgtgccgctcgtcctagtccgcgcaattgtgccgcctcctcggtgacatacaccatgagtccatgacatacaacctcaattcatgagttcatatatataacttgcaagcggtttaattttcatttaatttcgcatcaagcagagctgccgacttgtttaattttgtatgagcaagttcgttcgctttggttaacccaaacgaactttaaaaagaagttgcaaaatgtttttcgaacatacaagaagatactactagaatagaagtcgctttgtgcttgaaaattatacacagttgttgatttcagaatgtaaaatcggcacatcattgacacaaaatgtgaacaaaaatatttaccaggcaccagaggaaattacacaggaggcaaaaaaaccactatgaattcagagaagagaagaaaaaaaaatgaaagctaagctcaggggtcctcagtgatgcacgagaggtgcggctgccacggcgaggcatggctcccggtgctcatgcgccgccggtgttggtggtggtgttgcttctgcaccctcatcatccttgtcgtctccggcgacgcgctgcactggctgcccaaccaatcggcgacggcggcgttgccctccgacttgctgcggacgtggtgcccgtggccggcggcgccgccggtgctcgtccttctcttggcgtcggggacggaggcggccgggatgaggaagtagatctcgccgcactccagcttcgactccggcgacacgatgtgtatccggcccatcgccccctgctgcgacgagcactgccggctaagcacgtggttggggtgcgccgccagcacctcaccggcggacacagcacggccgtacgcgtcgatgcggccggctcggtgcctagggtttcgctgaggataggcggcggctggggaggagactcaccggggagaggcggcggcgcagctgttggggggcgggaccggtgaggcacgccgcggcggcgatgcagtggtggtgggcggcgccggtgtcgctcccgcttctcttctcgacttctcgcgttcggtcgctagattgaaacgaagagaagaaagagtccgactgaatcagttgactcaggggcataatagtccaagaaaaattgaaattgatgaaaagtattttcgaaatggaaaaaagcccgaaagtggcattccagcgaatacccacgtgttaagagtggcgtttgggcgaatcctatcttgagaatggcattatagcgaagccagtttttacgagtggtacatatgcaattttctcgcgagggaggggatcgggaatgggcgaccatgcgccgagagcctgggagtgaacgggaaggaaagcttacgcggcgccctcatgcgcttttttttggctatttttttgcgaattttttattttagaaattgaatctttcatcttcaatttcatttggaagttttgaatttgagttgaaagttttaaattttgaaatgaaagtttcaattctgagttgaaattttcaaatatagatttattttttttcaaatcatggttaaaagttatcgaatttgatttgaaagttttaaatcttgagttaaaagttaaaaatccttatttgaaaatttttaaatctgacttgaaattttaaatattaatgcgaaaattttcaaatcttcacatgcaagcttttaaatctgagttaaaagtttttaacaagaaaggaaattggataaagtgttgcactacgtactttgctagcgcatatacactaaataaggaacccccgaggctgcatagcacgtttctttttgggcaaagtggatggccactatccggataagctcttttgggctgagtttggatgtggtgctagaaatttaggatttttcacaaatgctaaatgagactaaattattagtgtcaggttaattgaatactttctccattttcatagtattgttgttttgaattttttttctattctacctttttaaatttaatcaagtttataaaaaatatagcaatattttaaaacaaaacaaacacattattaaaatatctttaatgtagtatttaatgaaattaattttttttacatgttgctagtttttttttataaacttagtcaaaccctttacttaaaaggtttaactagatgatttataatatgaaacggagggagtattaattactataaatatgacaaatggttttattagattttttttaaagaagctttaaaacttttcataatatacatcatttaacagtttgggaagcggctaaaaaaacaagtggcatccctaacagaccaaatgaacggagccttggtccctcaaaatggacatctccttatttcttacgtatcatccaaatgaatcttgttaatttttttaaaaatatatataactatttaaatgacatgcaagaccaaaggataccctataaggtattaattttttttgccattatctactgtgtattaggctcatcttaaaacactgtatttttttttctttgagatgtttaaaggcacagaccacttatttcacaagcgcatatatagtttggtcctcgtgacatctaccccctctatcccataaaaaccatcctaaaccatcctagtactgaatgtgacatatcttagtattacaaatctggatatacacctgtccagattcgttgtactagaatatgtcacatccagtcttagtttcgtttttttggacgaaaggatatgtcacatccagtcttagtttcgtttttttgacgaagggagtaggttgaaagtagagcagcatgagctgttcgttcaatgtggtagaattcccagggccctgccttactccacaaggtcatcaagtatgtcgcccaaattcgtgtacttgaactcgaacggtcgaacccttccctgatcagcttctccgacgaacagcagactctcggtttctcaggcatcccgtcgaagctgcaaagataacagagatcatcactcgctcgtcagatcgaacacagcatgcatgtatatctatgttggatttcgaagttggccaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacgtagccggtgaacgattgcaggggcttcaggacttcgagatgcgtctcatcacctgagaagtaataaacagaagccaacttaggtgtgtttatattcagagacgcggtaaagttttggcgtgtaacatcggatattatatagggtgtcgtaagagttgttggggcattaataaaaaactaattacagcatcgctaataaaccgcgagatgaatttattaagcctaattaatttatcattagcgaatgtttactgtaataccagattcgtctcacaaattagtcgtaatcttgtaattagttattttctagcctatatttaatattttatatagctgttcaaatattcgatgtgacggggtgtaaatttttaaggtgggatctaagaaccacctgcaagtgttgagactttggtgggagctagcttgttgatttgatcgctggtgctggtgcttctaactcaccggatagcagggagaggatgccggggacgctcgtcctcgccaccggcgccggcgctgcgcccaaggtgaacaccgggaatacggtgacgaggctcatgttgttctcctccgcgaacttgcatgctgccttctccaaaagcaccttggagacacagtacgcctgcaaacgcaaacgccattttcaaccatacaatatttatttttggtaaacttataaaaaaagtctatgtttagtttattgctaaatttagtcaatatataagaaatcctgccaaaattttgataatattagcatcttgccaaaattttaacattgccaaaacttggtaaggtttatttttgttacaatctaaacaggccctaaatttagagaacttttctatacaatatactgagtattttaagaatttttattaaattaacaatggtattttaataattttcatccattgtgctagtttgcagcggcgcggcacctcatggtggtgaaaataatgcctatctctactccctccgtcctaaaaaaaacacaacctcgtactctctccgtattttaatttatgacgcggttgactttttgactaacatttgaccattcatcttattaaaaaaatgtatttatcatttattttattgtgacttgatttatcatctaatgttctttaagcatgacatagatatttttgtatttgcacaaaaattttgaataaaacgaatggttaaacgttgataaaaaagttaacggcgtcacacattaaaatactgagggagtgctagaatgtgacatatggttttttagacggtgggagtatttcactataaattatgagtttacagaattaccctccaccaatagtataaaaagacaattttatcccctttaattttatactatattatattgaagcaggaggaaaaaataatatttttttcgattatttgtactgtcagtataatactgtaaaagttttcttaaatttatggataagatggagatgtgaaaatgtcaagagaggaacgtcacccaggctagcggcttctccgttctcaggtagtcaacgtcagaccaggattcctcgtccagcacatgcccgtcgccttgcagcggccttctggagatcgctgcgtccgacgatgttatgatcacgcgcttcaccgtccccgccttcgcgcacgatctcatcgcgttgagcgttccattgacggcggcttcaaccaaatctttctgccaccatcaacgtcggaaaaaaaaacgaaatggagagcagtagagcacatcaaagttggatgaacatggattggaaacggacgaaaactagctatctcgtagtcagtagggatcttaattagtggtgccaagtactaccttgtaaaaaaaaataaattcctatatacaatcttagatagacacatgttttcaggtttgtaggtaatattagttttttttttttttaagacgaagggtgtaagcttttcacctcaggattctctgaattgaagttcatcggagcagcgacgaggaaggcgtagtcgcagccggcgacggcatcgtccaagctgccttcttcgccgatgtcagcacggaacaccttcaaggggtcaagtgcctgcaagtccttgagatgggagttcttcgccatgtcatctgaatacaaatcgcagcaattagtagaatctttgagaggtgaaactgaactctgaaaattcacaccatctttttgagatcatataaagtctcataataattcgatccatcatatgtcacgatatgtatatatgtaactatcagttggaagttggaaaaggataagattttgtcctcatgtgcggctaagcctgccatttgctaattggttaagcgaaaacactcgctaaaaagctcatatggtactagctggcctatgatttcacacctgaactgaatggaagaaacactgcaaaaaacatgaacttagagagtgaaaaaatgaggaggagaacctcaccggggtttctgaccgtcgtcttgacagcatatcccttctccaacagcatatcttgatgagcgcagatgcgatgtagccgttgccgccggtgacgcacgccgtcttcctctcaaccgccgacatcgtcgtcgtcggtcgctacaacctctccagcccagatgacgaagaggacgatgaatttatttttgttgctgttctttggaaagagttcaatttgtgtagtgagccagtgaggtggtctggcgtgcttatcagtaagtattcctaaaagaaacattctgacgagcactatatccagaatatcacctttattataaaataaaaccggtgcggtgcgagttgggtggttgattgaagtgtcaatatggagtggacaaatagatcgtcatatcacgctgctctcagcaatggtaagcatagctggtagagtactacacaatactacggtggtgtttgaatattgaagatgaagatggagattaaggggctgtttggttcagatactaacattgactaggtttaccatgctttcttaaccaaacttgccaaagatgaggccatcaaaatccaagccacactctagccaacaaaatgaaaccatgccacactttttagagacacttacatgtgggacctagattacaaaagaggaatcttgccacacttgtggaagccaaccaaacaatcatctaacatggtcaaacttgtctaaccttaagtatggcaaagtgtagtaacttatggccatcaactaaacagcccctaagtttttatgcaaaacaatatgctattaacgtatgattgattgagttttaattcttacaaacttgaaaaatagattaatatgatattttagtgcaacttttatataaaaagtttttgtacgaaacacatcatttatcatttaacagtttgaaaagcgtgtcacgaaaatcttaatatttatctaagtcttgtggaagaaaagaactggacctgagtcatgcattcgtgcgtctggactgacatgtagattcatggccgaccatcgacttacaactgacgttaatccgggcgtgcgtcatacgcattgtccgtaagccgatcgagagaggggacggtaggtaaagtacaatcgcgccgtgtgtcgtgtcgtgcaccgtgttaattgggggaaaaagtacacccaaggtccctcaacttgtcagcgagataaaaaaacatacttaaaccataaaaccatatatatatatagtcccttaactaaacaaaaccgatcacccgagatccttcggtggttttgaccccgatttcggtctatgtggcggctgagtcagcatgggaccaacgtgggtcccatatatcaggatgccatgtcagccggtcctcggttcctcctctctgttgagcgcgagcgcgaggcttgcaggcgagcagatggttgaggactctgcgagctcggaccggtgcacgacgcggaaggggtccgggtgaccggcgagggcgcggtcgacggctgcaacgcccacggcctcggcggcggagaggaggagatcggcgaccagcgccgccgccgccgcgctttcttcacgcgctagccaccaccgccttcacggggacctcgccgtgggcggcggccatcgtcgacctcgccgcccctagggccctccacgccggcgcacaaggggcttgccgcggaggatgagcggcgtggagctccagacgcgccgccagcgggaggcgagcgcggcggtgcgagtcgcgcccttgaagggaggcgggcgacgaggaggtcgtcggggagcgcgctgacgcggtcctcgccgtcgtatccctcggcggcggaaagcatggcgccgttgtcggaggcgggatggccggggaaccaccggaggcggacttggacgtggcgctgtcgtcgtcgtcgtcctcggcgtcggggaagaaggtgggcgcggcggcggcggaggctagggggttgccgcggctagtgtggatggaaagctgaacattgcttcttcagctccaatatattgtaattcacgagcctttttattttgatggttgcttcttcagttcgaaagatgtctctgtttttattcttgttcaagccattggcaagtctgaagaacctagactgaattctatactgtagtacagttctaccatcgtcagtacagtataaagaagcaatcttttgaatccttttcaagtaggagtatagtatgagattattatagcctgtcaacttgctgtttgtaactagccaatgctaatcttttcagctcgattatgatatatatcacgtcgtcagatttgtgcaaaattggtatagagacattctgaccgggttatggtcgatgacactgtccatcatctgagagtttgcaagtctctgaactctgaacattgcccagaatctcttacaggaatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgaccaggagtaatacagattctgaagtttataaacacatctctgcctgaacaagatggacacctactgttttcagttcaccatttgatctttaccagataaannnnnnnnnnnnnnnnnnnnnnnnnnnnnnnnnnnnnnnnnnnnnnnnnnnnnnnnnat

SEQ ID NO: 29029 - DNA, 4567 bp, Oryza sativa
  unsure (1)..(4567): unsure at all n locations
cctctcccctccccccggcggcctcctcccccacagcgccgcccgtcgccggctgagaaaagtgagagagagaaagggagaagaggggaaataagagggaagagatgaggtggcgtgggttccacgtgggtcccatgctgactcatccgctataaaccgccgaggaatctcgtatgatcggttttgtatagttaaggaatcccgcatatctggttttgcggttcgaggatgattttgtatctcgctgacaagttgagggaccttcggtgcactttttccgaattttttttatttttaattttttttattaaaagttttacaaaaataatttttcattttgaaaattgacagaagtggtcgcctaccgccctctgggagggcgatttttaaaaatcgccatcccagagggcggcgaaaatgacgtggcagacggccgttcgctctcgggcgacggccgtcaacgaaatttgcatgcggcccccttgccgccctccgctagggcgattttgtactgtgcggggggccgcctgcaaatgggcggcgagggggcatggaattttgcaggcggcccccttgctgccctgggggagggcgattttatactgtgctatatttttttttataaatatcaatagttatcaaatctttttatattgaaaactatacaagattaaaatctccaagactggtaaaatacaattttattattttttagggcatagttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattatgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtacgcgctactggatctgacactaccatgaagcgccgaaagtgcgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaactcgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggactatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagtgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtgccgtaggtcgaggtcctgctccgacggtaggcacgcgaggccgtggttgcaccggaccagctggaggtacgacgtccatggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacatgtgaagagaggtacattatatggctcgatgatcgcttaattatcataaaaatttagaaatgaacaatccgaactcacgagtggtcggcaaggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggcaggagacggtcaaactcgaacacgaagtccgggtaacctcgtctcacctggacgtgagcgtaacgacgctgcaataaacatgatcggaattagacatgttatgtgaagaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgtggcacgtcctgtggctgagcatccgcgatgaaccgtgcgtagtggaccagccggaagtccacagcgtgcccgtgggtgctagtgaacatcacccacccgaacaacaacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacacagtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtggaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaacagattgatcagaaacatataaataattagttcaacataagtaataaatgttcataagcgaattactaacacattcctgcacaagagtacaaacaaacaaaagtgtcaccatacggaatatttctgattacaacaataactgcagttacacgatatgagtacttagtccgaatactcatcacgataacattatgatacaacaccgaatagttcgcaatactactagtacaacaatagtcggaggtactcattacaacaacattcaattgaaattacacgatagaannnnnnnnnnnnnnnnnnnnnnnnnnnnnnnnnnnn

SEQ ID NO: 29030 - DNA, 2214 bp, Oryza sativa
  unsure (1)..(2214): unsure at all n locations
nnnnnnnnnnnnnnnnnnnnnnnnnnnnnnnnnnnnnnaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaacagattgatcagaaacatataaataattagttcaacataagtaataaatgttcataagcgaattactaacacattcctgcacaagagtacaaacaaacaaaagtgtcaccatacggaatatttctgattacaacaataactgcagttacacgatatgagtacttagtccgaatactcatcacgataacattatgatacaacaccgaatagttcgcaatactactagtacaacaatagtcggaggtactcattacaacaacattcaattgaaattacacgatagaaatatttagtccgaacactcattacagcacaacagcattttatttcctaaatcgatagcattgttacaccatggaatcgcctgctgcgcgacgacgccttggccttgcgcgcctgcttgttgttccttcaccaggtggtcgcctaccctcacttgcctgtccagatggactagcatctgcgccgcttggaacttctgcattctttgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgctaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccaataccagctttcagtgttctcactctctacaaatgcaaaagccataggtagaacctggttgttcccatcacacccaattgctgtcaatatctgacctcggtatttacctgtcataaaagttccatctatgcatagaacaagtcgacaatgcacaaaagcattgatgcaagcacccaacgagaaaaaggctctttgcagcacactctttgttcgatcatcaactgatgtaaatgtatgtaggtcatagtaagtattattattccctgggtaccgagctcgaattcgc

SEQ ID NO: 29031 - DNA, 35325 bp, Oryza sativa
  unsure (1)..(35325): unsure at all n locations
nnnnnnnnnnnnnnnnnnnnnnnnnnnnnnnnnnnnnnnnnnnnnnnnnnnnnnnnnnnnnnccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccaataccagctttcagtgttctcactctctacaaatgcaaaagccataggtagaacctggttgttcccatcacacccaattgctgtcaatatctgacctcggtatttacctgtcataaaagttccatctatgcatagaacaagtcgacaatgcacaaaagcattgatgcaagcacccaacgagaaaaaggctctttgcagcacactctttgttcgatcatcaactgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcactttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctacaaatttcgttgacggccgtcgcccgagagcgaacggccgtctgccacgtcatttttgccgccctctgggatggcgatttttaaaaatcgccctcccagagggcggtaggcgactacttccgtcaattttcaaaatgaaaaattatttttgtaaaacttttaataaaaaaattaaaaataaaaaaaaatccactttttcctaattggggctgatgccgagcaggcaggggcagcccatcgcgcgcgctagaaagctagcaggccgcggtgggccgcgagcccgcgagggaggggatcgggaatgcgcgaccacgcgccgggagtgagcgggaggtcgcatgcgcgatccgttgactgatttctctgcactaatttccaccgttcgccttgtcccacgtagggatggcaatcgggcgcgacgggcacgggtagtgcctacctatacccatgcccgtgagattatttgtgctcgtgggtatacccattactacatgacgggtaaggatggttacctatgcccattgcccgcgggcgtgcccgtttacccgccacaacaaaagcagtggaacaaaaagtctacaagctactaagttcgaatcgaacttaaaacatcaaatattctccacctcggtgtcgtgtctctcctctggcggcgatagagtaagaggagagaaataataagggaaataaaagggaaaccgaagaaatcaaagaactgggcttatgtattctagtggattttgctcctagcctacatataagttagatttcgtgggtaaacgggcaaagcgggcatgggtagtgattacccatacccatgcccatttactcatcgggcatagcttttgacccaataagatacccatgggtataaaatggagaacaaacccaaccctaatagggtttttacccgcgggtaaacgggcaaacgggcacaattgccatccctagtcccacgttgacgaccggcggaggttgatgccaaggatattgtcgttgccggcttgccgcgcatccatcgccccggtgcctggttacgtgcccgtcgcgctcaaaaatctcgtccacgcactgcacaaaagatcaggccggccaccgtgcccaggtgaaacacgaggtggccagtacgtgacagagccaggcagcgtgtgacgtctgtggtttttgcatgctcgcattgcccgcatccgcatgccgtcgtgtagcgtgagcaattgaccgatcgatttgtggccttggccttctcaacctgctcggctgcacctgacagcagcagcagtgtcgcagcaggtagaaacgctgttcagagagttttttttttttcaacgcgtgccagaccacaacattcccattacggattcacatggatccatagtaaagagggcccacatgttagtgactcaaagtcatgtggcttagtccgtgtttagattttttttttttgctaaaaaggtcacatcgaatgtttggacacgtgcatggagtattatttgtggaaaaaaaccaattacacagtttgcatgtaaattatgagacgaattttttgagtctaattacgccatgatttaacaatgtgatgctacagtaaatatttactaatgatggacacattaggcttaataaattcgtctcgcagtttatatgtggaatctgtaatttgttttgttattagtctacgtttaatacttcaaatgtatatccgtatactaaaaaaaatttggccaagaaactaaacacaaccttttttttgtggcagaagtttttaccggttctccgggaaaccgggaaagtacgttggtattgcaaaaactattagaggatttcagctaatcctttccggagaattagacagcttaccccctaagaggatctcaaattctcaatcctcctcttacatgaacagaacgaagtacagccaaaccgccaaatgtattggaacttggtactagtactactagcaatgtagcaatagaatgctagacacaatagtatttttgaaagcaacacacgtttggtcgtaatcgccaaagcagtggaattacgccgcccatcatcaccatcagttggggatcaaccccagggccttgccgtacgcgacgaggtcgtcgtacatctcgtccaggttcttgtacttgaactcgaacccttcgccgatgagcttcgccgacgagagcgagatggtcggcttctcggggtgatgctcttcgatgctgcgtacatagcaacgcatgatcagattcagataaccaaatgcacgaatgcataaagcttaatttcttaattaccaatcgcatctgacgttgtactgggggtacttggccgccaggaagccggcgatctcggtgaccgtggtgttgaggctgccgcagatgtacctccccgacgccgactcctcctcggcgacgaagatctcggcgcggcacacgtcctcgatgtggaccatcggcatcgaccacccggacgccttctcgatgcccttgaggatgttcatcatctcctcgtcgcctgaaaaaaaaaattcacagatcatcgatgcagcgacccaaaaacgttcagaagtcgagttcttggattgcttcttgtttcattcattcggtgatcgctagatagttcctcaccggttatcaacgagaggcaggccgggacgctggtatcgaccctcaccgccggcgatgctccgacggcgacgaccgggcagagggtcaccaggctgagaccgttctcctccgcgaacttggtcgcctccttctccgaaagaaccttggagatcgagtacgcctgcagtgcatgcagcaacaatggcgccgaactcatgttctacgagacattgctgtggttcagtgacatggaacagctcgtgtgtatatatgtgtacctgcgtcggcgacagcttctccatggatctgaggtactcgatgtcggaccaggacgactcgtcgaggacatggccggcgccttccagcggccgcaggctggagacggcggccgtcgacgacgtcaggatcacgcgcttcaccgtgccggctctcgcgcacgacctcatcacgttcagtgtgccctcgacgccgccttggactatctctttctgccatggccaagttcagaattcagtaactaactaactgactacagatactaatcgagcttgcaggttgcagcagtggtcacctcgagatcgtcggacttgtggctcttgtcgtacaccggagcggcgacgaggaaggcgtagtggcagccggcgacggcctcgtcgaagctgccttcatcctccaagttggcgcgaaagaccttcagggggccgagtttttccatgtccttgaaatgggagaccttctccgggttatctgaaattcagagttacaaaagcagtttcagaggccaaaccaaaattgtactgacacaatcaatcccaaaactgaacgtgcaaatactcctctgaaacaaattatgaactgatgacatgttcttcgattttcagttaaaactgaacactggaaaaacatgtaacaagaaagaaagggagtagaatctcactgggatctctgacgcttgtctgaacagcgtatcctttctccaggagcatcttgacgagcaatgaagcaacgtacccgttgccgccggtgacgcacaccgtcttcctctcaacctccgacgacatcgtctctctctctctctccggtcagttaatacctctcctgtgacagagaaggtgacttgggtttactcccaggtagaatccgagcagcacactgatgatgaggtttcttttgctgattgcgctgttgtggcacttgccaggacaaatcccggagagcaggaacataatacatttgacttagccaacactattttacaagcgacgacgccagtcgccagacagagaggcagaacaagaaatgcttttcgtgatgcatgcaccatacctgctcttctgattgattttccttccttagataatgacctgcactgatcgattatgtcgatcgatgaacatctcacgcttcacatttttaatgcggtcgatcgtgttttcaaaaggtaaagcttttgctccaagaaaaaaggatcatcttatcttcccagatgacgtgtgtacaggttcattcttagaattgaacttttttttttaggatagaggtagtacatctgacgctgaagcctgtgacgatttaacatcgttgaaaatgataggatccgtttctttctctatgcaaacaaaagcgagagaggaacagcacacgcgccattgaaaagtaacccaacgctgcatgcctgcgaattggacttctcgtttgtgtgtgtgattaatcataccaaaaagtaattcctgcgatgcccgcaaagttgagctgagagagctagcataaaaaaaaaagctagcaagttagttcatgttattagtactccctatgtttacaccattgactttttagcacatacttgatcattcatcttattcaaagaaatttgtgaaatatgtaaaactatatttatacatgaaagtatatttaacaatgaattaaatgatagaaaaaaaataataattacatattttttttgaataagacgaatgatcaaacatgtttaaaaaaatcaaacggcgtcaaatatttagaaaaggaggaagaagttgtcttcgcatctctgtaataactttcccacactaaggttgtgtttagttcacatcaaaattagaagtttggttgaaattgaaatgatgtgatggaaaaattagaagtttgtgtgtgtagaaaagttttgatgtgatggaaaagttgaaagtttgaagaattattttggaactaaacacggcctaacacgacctgatcttcagatgctgaactggggaccttgaaagaccttgtgaggcttcgttgttccaccagaatattttctttgctacttaatgaaatgacagatctcttgcttgtttcaaaaaagaaaatcatagagccacaattaggttgtgttctttagtgagggttgtgaatcctttcctcccgacacataaaacggagtgacggattagcgcatgattaattaaatactatttaactgaaaaacttgaaaaatgaattgatatggttttttaaaacaacttttctatacttttatcttgtaaaaaacatattgtttaatcgtttggtaattgtgcatgtgaaaattgaggggtagaaattgagaaaatgttgaaaggagcacaattttattgaacagtttgacgtgtcaataggcacgtttttcataaaagcggatgggaacaaattcactgctgttttacacatacttatttttgcaagagccgtttggttgcgaagctgggtagtaacagcattgtcgtcggcgtcagtagtgcagaatcccgagtgccatgccgtactccacgaaggcatcatcgtacatctcatccaccgtcttgtacatgaactcgaacccttcactggtcagcttctccgacgagaggaggatcgtcggcttctcagggaggccgccgccgagtctgcatgttccgccgccaccgtcggagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcagcagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaagaaggagtttattctagcacacttaggtcgtgtttgctactgagggttctcaatcttctctctcgtttttctcgcgcatgcttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccgttgccgtctccttgcagcggctggccggagacggcggccgccgacgatgtgaggatcacgcgcttaaccgtgccggctttcacgcacgacctcagaacgttcagagtgccttggacgccggcttccaacagttctttctgccattaccaaataatactctagatcgttatttcagctggttattatggagaggatttactagacaaaccaagtaaattaatcgtgacgatacaagtaaaagtactctcccgtttcaaaataaaacaacatagtattggattggacacgtacataataaagttgtttattattattattattattattattattattattattattattattattattattattattattatttcagagacaagatttttatgggaggaaatattattccttccgtcctataataaattcagttttagacttttctatttatcccaaaataaatttatttttaaagtaatcattacatcatgtgaaagtatgataagcctctcccatttatcccaaaataaatttatttttaactaatcattacattagagttcttgaaaatatgatagtatatatgtattgagaataaataaaaatagaaataattatattgggatttaataaagtgagtatattataggcttgtaggtaaatattggtttgtgtgagataggtaaaaaacaaacttattttggaggaaggaatagtaattaatgtgacataattgatatctaatcaacagtggcctggcagcgatcagagacttgacaagtggcaattactacctaggacaagtggacaacatcgagtggcacttggccccacaatggcactgagtttggtgggagatgtgctacgtgtctgcatgcatttacctcaggattctgagacttgaggttcatcggagcggcgacgaggaaggcgtaatcgcagccggcaactgcctcgtcgaaactgccttcctcttccaagtcggcgcggaagatcttcaaggggcctagtgcttgcaactccttgaaatgagagttcttctccatatcatctggaactcaaaatcacaatgcgctgcagtttcagaggccaaaccaatggtgttcttgtgaattcccgaaatagttttcttcggtcatatcaacttgaaacaaatcaaacatcagcatttatcttctaccaaacagaacaccgcaaaatcttctatgcacacagcatgctgttactgcccggatctatcgtcaccgcatacacacaaaatcaatgaactgaagacgatctacagaccattgttggggtgagaagtaagaagaatctcaccggggtttctgactgtcgtcttgacagcgtatcccttctgcagcagcatcttgatgagcgccgaagcgatatacccgctgccgccggtcacgcacgccgtcttcctctcaaccgccgacatcgccgcggttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaatagttaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaatccgggaacagcaattaagccatctaaccaacatcgttgctcctctccccacccaccctatagacttaggggctgcttgaataggaggcacttatatttctgtgaaatcagtctctcccattcaaatagggcattatgttctaacgagccatttggttctgatcaaggttttgaatatcagttttaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccggcgagggggcccgcggcggcgccgccatcttcgtagtcgccatctctctctcacacggtgggggttagagacggtggggggagcggagaagagaaaagaaaggagcgccggccatggctcggcggcgcgaaggtcccgggcgatgccaacgcagtcacatgcggtcgcgtgagagagagaagagaagagtagttagggttttcggcggccgaccgggagaggggggtttttgatcatgcgatctgggcgcccggccgtccgatcgcaaaccctagctgatcggacgtccggcggcggccggacagaaatcggcccaagtggggagcgcgcggcggcggctttcccggcccaggcccaggttgcggcctgggggaggggagggggcgcttgcccgcgcgcaaggtggccatgggccgaccggcaaaggccggaaaagtccatattaggtccctccggggccgaaaatgaataaaagagaacagtagcaatttttccattttattttgtcgattttcatgcaaatttcaatagaattttgaatagatttttgcatgttttacctctgtttaaatttgaaccaacgggagaattttcacagagagagaattacagagatttagctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgattttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaagaaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcgggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacaggaagagtaccctcgctaactcacctccgtgtgtgggggagtcctgcagaggccaaagtatttaacccaaatattgggaagttggaccccaaaacagtcagctgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacaacctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatggaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccaaaaggttttgtcatgaaaggaaacgaaaatatgggatgtcgtctaaagagatccatttatggattaaagcaagcttcgagacagtggtacttgaagtttgatgggacaataaataaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatcaccaccagagaaacagatgatatacgaggggaacaacatcgttatcagtatggcagaatcccgagggctctaccgtactccaagaaggcatcatcgtacatctcgtccagcgtcctgttcttgaactcgaacccttctccggcgagcttctccgacgagaggcggatcctcggcttctccgggaggtcgccgaggctgcatgaaagttcaccatcgtcagagctctcgataagatcatggagacgcatggggaattattactcagtgagatcagctcgatcttacgcggcgacgtcgacattgtactccgggtatttggccgccaggaagcgggcgagctgcagcatggtggcgctgaggccgcagcagatgtacctctccgccgccgccgccgccgccgccggcgggggcttctcggcgaggaatatctcggcgcggcagaggtcgtcgacgtggaccagcattagcccgccggtggccttctccatgagcttcacggtgctgatcatctcctggtcgcctgaaagaaaatcaagagatgaacaaataaatttcacaggaattgcttttcgttgccgcatttgccatggaccggccggttcttgattcgattagttatcaccggagagcaaggagaggacggcggcgacgcacggtttggcctccgctgccggcgccgggccaacggtgaccaccgggcaaacggtcaccaggctgatgccgttctcctccgcgaccctgctcgcttccttctctgaaagaaccttcgaaagcgagtacgcctgcattgcatccatgtcttaatattttcgatatgcacaaatctatcagggacccaaaaaagtttgaaatttaaacaaatcttgaccgaatttaaatatttttttctaaattaaaaaaaatatgaaatatttggatgaagtaaatgcttgccggaaatttcgaaccgaaattgtaaacgctgattgcatcagcacacggagctgttctcatgtggccgatttaatgggctctgagcctctgattgactgacctgtgttaaataaaatctgtaattttgtgtgtacctttccgggagatgtcttgttggctggtgagctgaggtagtcgacgtcggaccatgacgactcgtcgaggacatggccgtcgccttgcagcggcctgccggagacggcggccgccgacgatgtgaggaccacgcgcctcaccgtgccggctctcacgcacgacctcatcacgttcagagtgcctcgtacaccggcttccaccagttctttctgtcattaccatcaggctgaccaagtaaaaaacaaaactactcccttcgtacaaaaaaaaaatctataactgattatgatacatttagtataacgaatctggatagagatatattcagattcatagtattaggatatgtcacatctagtactgattggtttctatgagacagaaggagtgcgtgtatgtgattctgtgtatgtgtctgtgtcatcgcaacagaaagtagcattgtttcgcttatttaaatcgcttattagtaaataaaaataaactatgatgagaaaaagatcaaacttaaaattaagttctaaattttaaatgttagcttgtaaatgtaagcataagccaacaatgaagagtgaagtgcaaagagacatttttatggaggaatacttagtatcattaatggcctggcaaccataagagacttgaggagtggcaaccaccatctagctaaatccataaagataatcttaaaatatgtttccccttcctccgttttatactataagatgatttaactcttttctaattatgttttattatgataagttcataaaaaaaatacagaacatttctcacatataacaaacataccatctaaatacattcaaagttatttttaatgaaactaatttgatgttataaatattattaaattttctataaacttaatcaaattgttgtagacggctatgtaatacctgagggttctctgacttgaggttcaccggagcagcgacgaggaaggcgtaatcacagccggcgaccgcctcgtcgaagctgccttcctccttcaagtcggcgcggaagaccgccaggggaccaagtgcgtgcaagtccttgaagtgggagttcttctccatgttttctgcgactcaaaattgcaatgtgtagcagcagtttcagaggctaaaaccaaattcctttttaaaaaaaaaaagaaaagaaaaacgaggttaaaaccactgatgctactgcaaatctatgcacgagtatgcacgaaattatgaactgaagaagaagaatctcaccggggtttctgactgtcgtgttgacagcacatcccttctgcagcagcatcttgatgagcgccgaagcgatgtacccgttgccgccggtgacgcacgccgtcttcctctcaaccgccgacatcgctggtcagtcggctcgatttcctactagcagagaacgatcgagaattccttaacccaatagaacaccaagcactgatataatggtagtggtttgatgattgtgctaaggaccagtctcatcgaagcaacaagagggtgtactatgtccgtgttgaatccggatcagctgcagtcgctactgggactgcaatttaggcggtaccagttttcatcaacggatgtagatggaacggtccagatcagcgaggtgcactattcatcgtactgtagcataaatactgtagcacagaatataagttgcagtaatagctataactgcgcatgatctgaatccgtctgtgtgtatagatccaaagtttgatctaaacttcaattctttttcatcacgtcaacctgtcatacacatactttttcagccacatcatctctaatttaaccaaaatccaaaatttacgctgaaataaacacagcctatataggagaggtgaggttgctggcctaatcgaaacagtctcatcaaagcagaaacagagacagcatttatcatatcgtaattgtggctctcgctggagtcactgcaacgtatagacactgggccaggaggacacgtgatgctgaaccttctggatacgagtactgtccaaattcatagagcaaccactgtgagcgatgatataccggcttcattctctccactcacaaaagaatacaccagcacttgaaaaatcgatgatacacggtttgtgaaaccatatttgtatacgaaaatcattaactgaaggagtcaaaattttggccagtagaccacaagaattggcaaacgcaagtacaaaaaatccctcatttccacgccttccgtcctctgaattgctttcccgagcgcttttgcagttttttcttctcctgtcgagaacgcgctgccttcgctctgcttgcagcgaggggcattttcttcttgtgttgtttctgcctattgctcaagccaccggtctaaaacgcaatgagaagcatataagtagagaaggaataaaagcaactacgaaagaacaattcatgatcagatttcacaaggttgtgccatatagccaacataggtcaaaataagcaccaaaaaggaggatcatataaacgaatacctttttctgtttcacagctgttcttgcttggtattttcctctatcctctcttccagccttcaccatttctaatctctcctctttcgtaagctttctctttatgtgagcctacataaaggaagatgttcatataagcaaagtgtggatgtgtgtgcatgagcgcgctggcacgagtgcaatgcgggaggggaagagagaaaatgcacctcaagcttggatgggtcaacccgtttcagactaagctgatcagaagaaggcattttaaaggttactgattttgtgtcatggcccttgccgagtccatgttgtgccagagccagttttgcttctttttttgcctgaaactcataacaatgtcagatatacacaacttcactttctttcccaaaagaaagctccacagcatgaactacagctggaaaaaactcccatacctttagctccttaatacgcttaaaatcttcatcagataagattttaccagcttcatcgcacgaagcttcagccttcttggctcctgccaacttcttcagagctcgaaggcttgcatctgcagcattaagttgccctatataatcactcaactttctcttatttgccttgcgactgctgttttttgacttatcatcctggtcactgtcatcatcctgatcagagccttcatcagaatcatccaatttctcactgagttcctcatcatcatcagattcagatacatcattctcctcatccatatcagagtccaattctagctcatcatcattttcttcactatcattgtcagagatgtcttgatcctcatctagttcctctgtatcatcttcatccccagatagttgatcttcctctttcataccttcatctgtgtcaagcttgtttgcttcagacgaaccatccaaattttgtttagtaccacgagcagattgcaactctttctcatcattagaatcaaaagcatcagactcatcgtctgagccttccccttctgatgaaaaatcttcatctagcaactcagctccaggcacatcagaagcgatagttgcttcgccgaatgcttttggtcgagccttcggatcagcaggacgcccacgatctttcttgactagcagagaaggacagatctgaacccaaaccaaaagaaggtttagctgaagtgaacaaaaagaaatcacagaatatgcaaaaggataagaactgacctcccggaataaagtaattagagaacgagcggcaatggaaacagctttttcatgggactttttgtataaaacaaggtcctggagtagatcttcattcatcaactgcaggtataacagaaggattaacagaggcctgctagatgaataaaataaatagaccaagaatatcttcctaaatatcttacaacccgcacagtacctcaggtggtaatgtagtatacaaacctgcatgtgtgttctcaacttctcatgcataagtgactaacgtgtcaggctacacaagactaaatgtggcctggtaaaaccatgtttataccttttcaattcttcattaagttacacttatatgcttaaaacctgtagcaatcgactatcacatccttttggagtttggactacgcaaccagtcatttaagactagtaaaaaaatgaaatcacaatttctactagagcatgtccagggcacaggaattaggtacaacaaaacatgaccaccataaaaatttaatgaatccatcacacaaatttaaggggtgtctggtcagaggtcagtagcactagaaagcaagagtacagatttgagcaaggtaagtaccaaaggtattctcatgcagatctctcgcacaacattcaagccaacagcaatagcctaaaatgagattggttagaaatatgccatgttagttggaaaatacttaaatatattagatatgtgatgagtgttatgcaaacctctgggcgagaacgatcatgcacaaattgatttactatctgcttaaacagtggttcaactgcatcaggaggcacctgaaattgaagcatattaatttagctgaatttggacaaagcaaaagaaatgatataagtagtgaaatataggagaagagcaaaagtgtttcaaccatatcatggcaagcctgtactgctgcagcaagtaaagttgttacatctcgttgatgaggctgcatcacagaaaggtagaaaacttattatcaaaactagtatgaactagtataatgcacgtgaggtgcaacggtttttttttctaattgtctattatattatcattatgctaattttgctgtcatttcgtaaagatgaaaattttcataatattctattgtcatattttcctttcgacgggatctatggcatgtgggggctaagagatacgcaactcacagtccgtgggtccaccaccactaccatcttttatattagtatagagtatagataaacattatatctaccataaggttgctacaagaagaacacatgccaagttaagaacatacctgaacgtatctttgaagatatggatagaagttcaacaaaaccaagtgatgcagcccaatagtcctcgctataacctttaacatcatcatccttacctgcaagcacccaaccaacattctctaaatttgaattaacgtttattttcgtttaaccatcggatggaactcacaacagacattgtgtttaaaaaataaactattgcacatctgggttccaattctcctacttgaatgctggttccaactatatacactcatgtataaaacttcagcagaaagctaaaagtactaagtaatgatagttctgacaattatatataactttttaaatctttacagaacaaggaatcttcagaacaaggaatggggccaacctcaaaccgctcattgcatttctggagccgagagaagagcttctcagcaaaaccctgtcagccaaaaaacgaaagcttcaatataacagtcaatatgtaaatgataacactctgaacaattatgggattacaccatttcccacctgaggatcctttaaatacgtcagtggtgaataataattggagccagtgtcctcagtggatttacgttgttgccttttcatactacgaatcacacgctgcaatttagctttcttctttttcttagtagcagcagtgcccttgtgatttgcctgagaaagtaatatgacaataaaatacattatatcagaaggcacgtaacagaaaaaagatgtaaaacactataaatcgaaataatggtaaaaattcaaataaccttgtaaacatcctctttactaagaataatttgagggttttgagcttcatcttcactgctggatgcatcactatcatcttcttgctcaacgttttcatacccaagaaggaatgaaatagcggctatcataattctgcatgtaaaagatatattttagatcaacacctattaataaacacaaagatgctggcagtatgtacctagaagaaccatggaaacaagcattgcatatagcatttgctgtgcggtcatcaaaccagaccctccgacggtgaagatcacatagaatagtaaaggccctctttgctctcgactcttcctcgccctgggaaacagcgaagcaagatgcataactaaacgaggtaggaagagaatcatgaatgtattcttgccactatgttaaacccgataatactaatcagtgcaagtgtggtatagtggtatgtcacaaacctgtaggaatgtgaaaaggatgttttgcagtttacgattcctggcttcattcttgtgggtctgattcattctcctgatactgtgtacaatatgtgagaatgctagttttttgacagcccggtcccctataacttgaagctccataaataactccattgtgtcctccagatcaacaatctaaacatcaaaaagcaatgtatacgaggagaatttactctacagtcatacgataatcccgttccaatccacacgatttgaacaaaatttaacttaatgtgaaatgaacagatgaactaaacaggcgtcaccttccgattcaccagtagtatcagcgcctgcacgaggtgcacacggagcccggacggcagcgcgcgcgcgttggtgtcaagcaggccaccaatctggtcgggcaagtcagcgaggtcgtccgggtagaagggcgcgacgtgggcgaggaacagcgcgaggtcgccgagctccttggccacctcccctccgccgccggacgaggacgtggaggccagtgccgcctgctgccggaagaggaacaccgatgactcgaagtggcgccgcagctggcggagctcctcctcgtacccctccgggtcgcgcttcatcttcgcctgcagcgccgggaggctctgccgctccccggccccgccggtggccgacgccgacgccgcctccggcgtgaacgccggcgcgtgctgacgaggcatcggagcggaaaatccggtgtcccccgccgccgccgccgctgaggtgagaatgctaaaaccctaggccgccgcaaaacttcccgggagaaccgatggcaagaggtagtcgacgatgcgagtgactgggctggccagttacagtacacgtccggcccattaatctagctaaatttggaccagtaaggcccatttttcctccctctagcaaagaaaataagtctaatttgaaagacctcggtcaaattgcatcaatcaaccgcaaaaccgggtatatcgcactctccaacttcaaaaaccggtataaatcgactcctttgatggtttgaaaatcgattttctactgatgtgttaaattaaccgtgatcaaacttattatatccgaattttactattgaaggagacaattcaattagaagcaagagatgagggaagaaaaatatacttagagcctctttatttagggaattttttcttggatttttaagtcgcctttttagtttatatgatttataggctaatggattgaagtactaagtttaatagtagggtcataactctatctagcgtaagaaaaaaaaacttcttcaacataatttttgatgatgagtacaaacgaaagaactgcatatttgttaagcttagactttccagctcataaggttaagagcctactataagcttcaaataatctatagtcaatctaatagttaatttatacaatagttaactataaatatacactaggggtgtgtttggttggacttttcaacctgcttttccttttgcaaaagtcaagagtcaaccaaaggacccaaaagcataagtgcttttgctccaagtgcttttgagggaaaaattacccacctctgccattatgaaaaaacggtccgatattcttttcctcgtctcctccttctcgcgagtcgtgacttcatggggcgagcgtcggccatcgggcgcattgggtgtccgccatcggcgccgcccccgcccttccccaaccgacgccgcccaacctgatgtcggcgcagcccccgcccttccccaaccgacgacgcccaacccgacgccggcgcagctcccgtccttccctgatcgatgccgcccccgcccttcctcaacagacgccggtcaacgcgacgccagcgccgctcccgcccttccccgaccgacgcctcctcctcccgacgccgccgccccttcgctcgtcggccatggaggtgggagacgaaggtggtgaggtggccgacagcggtggcgtcaccactgcctcatcctcctggcgccaccgctcctcaccaccgtgcgtcctcttcgtcgctgaaccgccgctaccgctcctcctcgccgagacgccgctgccaccgctgaggccgacgacaccgccgttgccatatccatctctccctcttcttttatttcaacgtgtgtatgacatgtgggggtcgctgtcagcgggactagttatttcaaaagccacagctattgaaccaaatgagcttttccaaaagccaccgtacatattccccagctacttttaagaagggagtacctatacatctttcgaaagatttttataatcgtatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgaatgagaaaatcgagtgagagataagaaaaaaattttcgagtgagatatagcaaaatcgtttaagaaaactacagcccacagatatttttttcaaagccagagctcaactaaacacaccttaagagcttagactttccagctcataggcctaaacaaagaaggccttcttcctctcgcgaaccacgaggcccagttggctagtaatcgttcgcggctagccggcccaccggaccagcgcttcccccgccggcgtcgcgcgtacgtaggagacgacacgacgacttctccgtgagatcgcgcgaaaatcacgacctcaaccgtgcgacggggggcgcaagcgcgacatcacgcagcgtttcctccccacccacccgccacgcgcggcaccggcaagcggcgacgcgcgacggctgcgcggtcgttttcggcggcacgccctgcgcgcgcacataattcattctgctcttcccccacggtcgcgtggtcctttccgacgcccccgtccgtgacaaagccaggtttggtggcgagcgaacgagtgactcgatcatgccccgggtcgccgtcacgcagcagcgccctgtgtctgcccccgctccggcgatcgacggcgaccgatcgatcggcagctagcgacgcccgagcttacatgcgcgcgccgcgtcaccttcccgcgaccgatcgatccgtcaatcttccgctaccgtgtatacgcagcagtgtcggctgggacatgtacatacattatactaaaatacagtactacgagccgctttctgaaaaagaaaacgaaggccattattttcctctgtttcttctcttgtatttttctggttgcagcacagacgtcgtcgtcatcgttctatggagtcatgtacaaacatatttaaaaaagtcaacggaaacattttgagaaggagggagtattaaatcagcccgcttgatcgatatgggacctgttttctttttctagaatctatcattaatcagaaacgtacgcttagctagcagaaactggtagtctggtacggcgttctactgtacatacatcttggcaagaggtacaccggtctaacatcgactataccattgtcacgttttgcgtgaactgcaagagaacgcatcactgggcatcgctaggccactatcggtgccattatgtaggagtacaaggtaatcaatacactccctaatcaaaacaggattgcaatccagaacagcggtgacatctgtattaagctcgcagatactgtaccaattataactcgattactcaaacaacaaagcactggcacttcagtggaccacgtttggcaaggacgaaacgtggttttaaggcgaaaaaactcaggagctttgagaggggacagcagcggtcatgctcttttcccccaactaataaagcaccagaaatagtaaatggctagctgacaacgtacgccaagcatcattacaccaaacccccttcacaaatccatctttaaggccctcgtctgtgggccaattgtcgaaaatacgtcgtacggcgcgttagaaaagaatagtttataggttaaatttttctatatactagaaaaaaatgcccgtacgttacaacgggtgaagtcgattttaatcttattattgttatatgttttagttaaaatgaaattcactgtgagagttcgctttatatatttttagaaaatcatgagctatatttaggagtctaatcatctcaagttagcatgcaagttttttaaaacaaatttcttatatgatttcttctgtattaccaaaagtggacgattttaaaaaccgaatcaaatacggatacatatttttaaaagcaaacaaacttaaaaactgacgtatacacatatgacgtaccaaaataccgataaaaacatcttaaatttttataatagtagagatatgttcaatgaaaaaaattaaaataaactctaaaatttaaattttgacagcggttaattctatatagaggaaccaatgggagcctaagctcttttcagttactgtctgttggcttatgatgacacgctttttatactgtttgtaaaaaacttctctatatatatttttaaaatagtcttttaaagaaactataataattaagtatttaattaattataaactaatgatcttctcgtattgcgtaagacaaataagatttgaatacgctctaccgaacgcaacctaaaccggtaaggcacaaggcaattaagacctaatctcgcaacttgacgagacgagacaccaatttactaatactaacaaacagcaaatttctaattagcatcgcgtcgattgtccgatcattctcaggttccagtgcgcgaggtgactgacaagctagcttaactattcgttgagatttcaggaagaaaaagctgtcaaaagcttaataacaagacgtggcacctctaagctgttgattcccgaaaaggacaaagaaaacgaggagagcaacgtcgcaacatgccccggcccggcccggcccattatcagcaaggcccaaggcgacgcgaatctcgaagcccacaacatcgaagttgaccgttcaacagaaataccgaaaatacccctgactaaccaatcatattacgcgaatgaccctgcccgagccggccagccacttagacctggtcaccgccggcttgggctttaaactaacaccagtggcattgggtgtaaataaatcgaaatcggaggggtggggtgggtacccctgatgcgtcagcgttcaaaatatttcgaaatagctcggccgcctcgtcctcttcttctccttcctctctctctctcttctcccacacatctctcgctcagatccgagcgaggcgagaaatccatgaaaaatcgagggtaatctccgctcggtggcttcaaaaacttcgaatccttccccaatttcatcggctccgcagtttttttctcgaggtttttcggatctaaagcgcggctttgtcggcgcttgtaagccacgagagagagagattcttgtgccttcgagctcactccatccggccccaagaaagctcccctcctcccacccaccgccaccactgaggaggagagaaccctaactataacccctaatcctgccactaatcccagttcatggcctcctccctcacgccccgtagcccttacccggtaattttctctcttttgtggaaagaaatcgcctattttgggggagggttgattcatgggagcttagttcttgcgatttgtggggtgtggttgttgttgttgttgttgcagaagaaggagaacttgggcaacgcgcggcgggggatgggggtcaagcctggcccgcgccgcaatgtcctctcggcaatcaacaatggcggtggcacgaacagcgacacggcgtcggtggacggcggcgagggcggggctgggccggcggcgcctgtgatcgagttcaccgggagggaggatgtggagcggctgctcgccgagaagatgaaggggaagagcaagaccgactacaaggtgggttcttttgggggatttcttggcgttcgttctgtttgagaatttttggggggcgggtttcctgaatttggttggacctgtgcaggggagaactgagcagatgagtgagtacatcaagaagctgagagcttgcatccgctggtacattgagttggaggacggctacttggtcgagcaggagaagctccgtagtacgatggatgcagagaatgcccagcacgccaagttgggtaatgaattcgaatgcacttctcttttttttgtatttatttgatcacaccaagagaacaagatggtactcttttgggttttgagcattcatgtgtgctgtttggtcatcagagtaccatctcatcgtagtgactgagtttattctggtcatttatgttcttggggtactgtacttccagaggcccagcttagcagtgatctggaagagctgaaagctgcacacctgaacttgacgcggcagtgcgattcgttggaggaaagcttcaacaaggagaaggccgacaggatggttagaactcatctatcgcataataagctgcatagttatgtactgttgctgtgtgcctgtgtgattggtttcagccacggcttacacttgttgacctttaaactggcagcttgctgtggagtcctacgagaaggagaggcagcaaagggaatcggctgaggcgtccctcgacttgctgtcggtggacctggaaagagtcagccatgaagcaaaacggtttagtgagcaagtacgtgttcagaaatgttctattagtcttacatgaatttgagtcatatataatgttcctttctgatggatggaaattgtgaactagctgaaaatggtccaagacacgaacaaaagactgcaggagtacaacaccagcttgcagcaatacaacagtaatcttcaagctgatgcctctaagagtggggacatcatctcaaaactgcaaaaagagaagagtgccatgatggaaacaatggcttctctgaaagatttaaacaattcaatgaagaaccatttggattcttctagggtgagttgtgttttttcgtgaattgataatttttttgggcagtatagttcttgtttcacttaaacatttaattgttttgatttctgttagacttctcaacaagaggccattagaatgaaagaacaacttatgaaagaagtggattgccttagaattgagctacaccaaattagagaagaccgtgatcagtctgtttctcaagtaaataccttgagtgctgagcttgctaattacaaggaactagcaggcaagtctacaaaagactgtgaaagcttgagtgtaaaagtgtcagcctttgaggttagtggtttcagattaaccaaatcaatactttctgtgcgcaactatttggctcaccattatgcttctgctcaggaaacatgtagtatgcaacaagaacagattcaaactttgcagaaacaacttgcagttgcaacaaataaactgaaggttagaaataatattttgtcagtgctgatttacatgtgagatatgattatatgacatttgatctaattgtttacttttgcagcttgctgatgttactgcaattgaggcgatgacaggatatgaagaacaaaaggtgataataaaagatctggaagaacgtttggcatccgcagaatttcaaattgttgaagctgacaagctacgaaagaaactgcacaatacaatattggtaattgtttcagcatactagcacttcttactaaaaacaatttctctattttactgacagaagaaatttttgagtaaatactgaaattttttcatcttgctattgctacttgttactgattagcctttctatttgcaggagcttaaaggaaacatcagagtgttttgtagggtccgaccacttttgcaagacaacgattctagtggtgcagaagaagcccttatttcatatccaacatcagttgaatctgccgggcgtggtattgatttgatgaaccaaggtaaaatcatattcattgttgaagctaaacagaaactatgtttcccccactaagttttcagtggtaaagttaatcggagacttcattttattgttttgtgttgatgtaggtcagagattttccttctcatatgacaaagttttcgatcacggtgcttcacaagaagatgtgtttgtggaaatgtcacaactagttcaaagtgcacttgatgggtacaaggtatgaatatttcactacaacaatgaagtattggtgaataatctgttcatgaggttcctgtctctaataactcaaatatcctaactttattttttttatttcaagaacaaatgaaagttgttttaattgatatggtggcaccccaaattttatctcttcagcaccaccacataagcacaaatacatgctaaaagccgtgaacatcttacattgatgtttctagtatatatcacctgcattctgcatttgtataatcaccattatcttgaaactctgactgatgtttctagtttatttcagttttgaagtacttgtcaatttggtatgcttaagttatttttgcatgatgcaggtttgcatatttgcttatggtcaaacagggtctggtaaaacttatacaatgatgggtccaccagggcgtgatcagaaaggcatcatacctcgttctttggagcaaatttttaagacaagtcagtctcttgaatctcaaggatggaagtacagtatgcaggttagtatccatagtgcaatgcagattctgaagtgtacattctatgtagtgttgctgagagtttttcctatgtgcaggcatcaatgttggaaatatacaatgagacaattcgtgatttgttagcacctggtcggtctaataactttgatctgtctaccagtaaacaatacaccataaagcatgatccacaagggaacacaaccgtcactgaccttactgttgctgatgtttttagtagcgccgacgtaacttctcttctagcgaaagcatcccaaagcaggtaaatacgctttattcatttttaatcattcacttgtgccttgtaactgtttgctctaagggtattgaccattatcagtttaatgttatatttgaaatagcaatgctttggatatgtctagatgattctctcatctatcactcaaatatattagagagagcagaaacataagagggtttaccttttatacaagctagcacttattatctgaattcacatgtgtctgttagccacctagtctacatatcaacagtgagtctaaattttttttcaccacattgaaccaggtctgtgggtaggacccaaatgaatgaacaatcttcccggagccattttgttttcacactgaagatatctggatcaaatgaggtactcgcttcacccatattttagaatattaatcacagtgctgaaactttacaaactggtcacaatattttttttttcattttcatgctaactaaacagaaccactgaaacttgagcaaatgtatgtcactaattttcttttgatcttaatgcagaacactgggcaacaagtccaaggtgtccttaacttgattgatttagctggcagtgaacgccttgctaaaagtggctccacgggtgatcgtttgaaggaaactcaggtgagtgtgttcatcacaaatttacaatattcttatttgataatcacattgtcttatctgtttgttttctttatgtttcaggcaatcaataaaagcttgtcagctcttagcgatgttatctttgcaattgcgaaaggagacgatcatgtgcccttcaggaactcaaaacttacataccttttgcaggtgagtgacttgtgcaaatggatggtannnnnnnnnnnnnnnnnnnnnnnnnnnnnnnnnnnnnnnnnnnnnnnnnnnnnnn

SEQ ID NO: 29032 - DNA, 2193 bp, Oryza sativa
aagttgctgtggccatcatgatgtgatataatcgatcagcattggggatatcatttgcctgaagctgatgagcccgcttgcttcttgtacttgtacagtagaaagaagagtgcactgcgctagtgcgctgtgagcagaagagaacacgcatgcatcatgtgttttctttctgttgtagctgatttgagcaatattaactgcattgcaatgtattttctggagtaactttgtatgcaaccgtgggttccaaaatggtgtactacttttgcccggcagaacttcgctgctggctcctgcatcaaaatgatggttatgccacgaaatgtgtatcggttcgtgccatatgatttgtaactctgtatttccctgcgttttagttctgtcatggaatgcgtattcattctccgtcgatgcatccactgaactgcagtgcaaatgcagtcagtgctcatgaagtttttcagttgcaaacttggaatatattccacagaaccacagaacttgcggtggacgaagattaactgcaggtacatgattaattgaggtttattacttcaaatattaaaaaataatttatctaataatttaaaacaacttctatataagaaagttgcacaaaatgcactgtctagtagtttgaaaaacatgctaataaaaatgaggtaaaatcagtatcactgtatcacaatgagaaatgaacggactatgccttttttttttccttcttccaatcgatttcaagatgcactatggttaacggactaggccatactctttttagattactagagtgagctcgcgcgctacgctgcgcggtattgtagcatgtaagactgtaacgcacagaaagaaatgtacgattgcaaggtttgtctaagaggattacctaacaacaacagtcaattccttgtgtacctactaagaacattatttaacctgtatagttttttttttaataactgaagtcgccagaaacagttcctgatagttaataatttaaacaataatttcacaatacatagcaggggtggcaagcatagtatgactcatccaatatcaatgggcacaagatgcagttcgttatgtcaactaactgaaaatggaacatggttaaatttctcgtagttttgtttgcgaggactgcagtattaagataatatctgtaaactctagaactggccaaaaacccagtcagatgagacaatagtattgcatttatcaactatggtatgaaagaccgactacatatttcagattcattagttttaagaagagacttgacacttcactatgagaactttctgttcaagaaacatatccgcctcagcaattcagtcaacttagatcaccaggtgcaatggcaagcatctgctaaaatcatttcttgaacactaagaaaatatgtgccaagttaaatcattcctaagttaatagtttggagaattaacttagcatattgagagatgttactaagtcagtagaactcaaagtttggagaattaagtcagcacatggagagatgttactgagtcagtagaagaaactcaaattaatgaacagatcctcatttcagtcagtgttatgttactaatcagagcagtggactcttaaaatagccatgtaaatgaacttatggttcctgaaaagagacatttaaatgcaacaactgagtatccactgtgaatcaatggacgatgtatacatttacatcacctgtctgattaattagctaccaaactactttgagagttgaatatttgtatagctaaggcagttgtagatgacaaagatgatggatatacctgccttacagtatttcgaaaagaaaaagatcatcatggttaacacatgtgtagggatatttccataggtatttcaaatggttttcctgctttccgtaaaaaaaaaatggttttcctgctaagcatgagcttcaatcttgtcgcagtccttgaggagaatctatatgatattatgaaatatgttaagataaaaaagtgagcgaagtacatcaattatgcaagtgagaaaaggcagtcactactacatcagtgcaggaaacaccaattattcaagtgtgggattgaaccaccactgcagcatgaattttagcttggaaacaactttggaagtgatgtggtggcagacacaccaatggaagagctatatcttgacaggctattaagaccatat

SEQ ID NO: 29033 - DNA, 627 bp, Oryza sativa
tagcaaactgaaaaccacaaacatggctgctcattttgattccggagagatatagctggcattgttctagtgactgcatcatccttgattggttctgtgatgatgtgataggactgcataatgctatcattcgcaggagaagcttccttctgattgctggttgaagcggatgacggttttctgcttggtatcgccctcctgaggttgattgccctttgcttggcctggagtaggtcggggagaagacacaacttcttccatcgacgacaactctttgctgaggctgtcggtgcagagaatggttggtgctaaagatattattgctatgatttattgcagagttaggtggagcaggaggagcattggtgttgtggatgatatcgtcgatgttgctgttggagctgactagctgacgagacaatcgtagggtcgttcgttggatttctgcggtcttggtcaacaacacactgagttggcaatccttgggcacatgatttgtaccttcgcacagaaagcatgtgaccttgcgggtggtacactcccctggtggatggtcttcttcacaataagcgcagagtgtgagacacatgctagcaatgtgtcctatttatccacaacggatacatg

SEQ ID NO: 29034 - DNA, 598 bp, Oryza sativa
  unsure (1)..(598): unsure at all n locations
ttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctnnnnnnnnnnnnnnnnnnnnnnnnnnnnnnnnnnnnnnn

SEQ ID NO: 29035 - DNA, 444 bp, Oryza sativa
  unsure (1)..(444): unsure at all n locations
nnnnnnnnnnnnnnnnnnnnnnnnnnnnnnnnnnnnnnnnnnnnnnnnnnnnnnnnnttagataatgacctgcactgatcgattatgtcgatcgatgaacatctcacgcttcacatttttaatgcggtcgatcgtgttttcaaaaggtaaagcttttgctccaagaaaaaaggatcatcttatcttcccagatgacgtgtgtacaggttcattcttagaattgaacttttttttttaggatagaggtagtacatctgacgctgaagcctgtgacgatttaacatcgttgaaaatgataggatccgtttctttctctatgcaaacaaaagcgagagaggaacagcacacgcgccattgaaaagtaacccaacgctgcatgcctgcgaattggacttctcgtttgtgtgtgtgattnnnnnnnnnnnnnnnnnnnnnnnnnnnnnn

SEQ ID NO: 29036 - DNA, 1001 bp, Oryza sativa
ccccttaagcccaacggctcaaaagggcgttgaccgcgccttgatcgggggcgcccagcccaatgggtggtgggccccggtcacactgcgccatataaaaaaggggtgaaggccggcccggcacatggtacaagattcaccgccgccgccaactccaccctacaaaccctaatccgatcgagagggggcgcagccagtgacgggaagcgcccccgccgcgccagacctcatcgccgggacatctacgaccgtcactccagcagcagtcatcgccgtcgacctcaccggcgccgcatccacgacaaccgagcgccaacgacgacgatggcgggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatgccaagccaattgagtgcagcaaagcacaaacaatatggtctttatagcctgtgcagatatagctcttccattggtgtgttctgccaccacatcacttccaaagttgtttccaagctaaaaatcatgctgcagtggtggttcaatcccacacttgaataattggtgtttcctgcactgatgtagtagtgactgccttttctcacttgcataattgatgtacttcgctcacttttttatcttaacatatttcataatatcatatagattctcctcaaggactgcgacaagattgaagctcatgcttagcaggaaaaccattttttttttacggaaagcaggaaaaccatttgaaatacctatggaaatatccctacacatgtgttaaccatgatgatctttttcttttcgaaatactgtaaggcaggtatatccatcatctttgtcatctacaactgccttagctatacaaatattcaactctcaaagtagtttggtagctaattaatcagacaggtgatgtaaatg

SEQ ID NO: 29037 - DNA, 383 bp, Oryza sativa
  unsure (1)..(383): unsure at all n locations
nnnnnnnnnnnnnnnnnnnnnnnnnnnnnnnnnnnnnnnnnnnnnnnnnnnnnnnntataggacggaaggaataatatttcctcccataaaaatcttgtctctgaaataataataataataataataataataataataataataataataataataataataataataataataaacaactttattatgtacgtgtccaatccaatactatgttgttttattttgaaacgggagagtacttttacttgtatcgtcacgattaatttacttggtttgtctagtaaatcctctccataataaccagctgaaataacgatctagagtattatttggtaatggcagaaagaactgttgggtaccgagctcgaattcgccctatagt

SEQ ID NO: 29038 - DNA, 995 bp, Oryza sativa
aaggtgcacaggaatacgttgaatgctaaatgatgacaacatgaagagaatagcggaaagtaaactgaacataaagaaagtgaatctgagttgcttgttcgtgggagctattcccagttatgaaacaagtgatatgttcgaagatagtctacagaggtcagagtaaaatcacatctaacaacgaagcttcaaatttggccggataacgaccagacaataagaagtccagcagtaaagccatttgggaagacgtcaaagcatgtccagtgggataagttggttctcttgggaagcataattcaaaggcaaagttatcgacccttgcatcaaatagcagaagtagctatcacccggagaccaggaaagctaatatgaggcagttggtggcgagttagaagcaaatgacaagcatggtatcttagtaatgacgagctgatctcgacgcatgacatgaagtgggtaacttgtatgaggttgactccaaagatatgaactatgcaaagttctggaactgaagccccatcttcaagtgccacaatccagtcgaagtcagctagaggtgcaaccagggaaaagtcaggtgaagagaagactccatctgcaacaggagattgagccaagcagtccagagtggagaagttttgttaggcaagttcgttataaaagatgcgacggaagaagtcggacaagaagagaagaccgcccaacctatcttcttgctagcctcctcgaatctcggggacgagattcttataaggggggtggatttgtcacgtcctgataaattcatcccgaattaaaaatcattcgctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagtt

SEQ ID NO: 29039 - DNA, 758 bp, Oryza sativa
  unsure (1)..(758): unsure at all n locations
nnnnnnnnnnnnnnnnnnnnnnnnnnnnnnnnnnnnnnnnnnnnnnnnnnnnnnnnnnnnnnnnnttttaattaaaatttaaatgaagaaattcgtaaatatccatttaaagagcatataaacttcaaatggctatatcttggccatttgaactcggaattggaccgttcaagtctctaatttttccttaagaagtcaagaacccatttttgtgctttgtttctgctgttatgtggagtttattagagtaaaagccgtttcttttccgttggtcgtgtagacgctgcagcttcggaagatccgctcttcgtggaagttgaagccggtgtttgggaaagcgagcaaggcaagtcacatcatccttgagcatattgaatcccagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactttggaattgttggtttatggtggaattggacatacacctctcttcccctttcaaaacccctaaaacctgttttcggtggggtttgggtgcatg

SEQ ID NO: 29040 - DNA, 8796 bp, Oryza sativa
ctaccccatacacgcggagcgaaaacccacgaggggtcagggcgcctcggccctcgggcccgaggggggtgcagcccgaccccctcggggggactaagaggagggcgaacacatcaccctcgggcccgacgtcccccgagggtgccaggccacgtgggcgattgtgtctgcctcaaacctctagtcatgatactcccgatcccatgtcaccgacagtagcccccggcgttatgccagggcgatcgccctccttaagggaagcggtcgggcgtgacgccactcctaaggcctggtgacaggtgggaccggtctccacaattgggcagaaaaccaaacggtcacaaatcacgcacatcggcagtggtaattcggctgtcaacaatgagcggtctcttcaagactgccacattactcgagtagcacacgaatctggacatggcgattcgtttcatctgaagatatggtaacgtcgcttcggttggcgagcgtaattaacgcgcgcacgatatgatctacctcgaccgccacaaccgcatatccacctcatgcgccgcaagcgggcgaatgggattagtggaagcgtgggcgcgagaaacgagggggcgaaatagtgggcgcgagaaacgaggagccgggcatagcgttggcaagggtataaaggcactgaggaagggacttgtttccttcctttcgccattattccccttgtctttgctgcttgcgccctaactcctcctttcctgcgccctaccctcgccacacgcgctcgctcttaatcttctcttcctccggcgccatggcacggggctccgctctgctcgatggtagcgtgctgccgccctcccgcatcgtgagcgagaggcaggctgggctgccgcgccgcttcatgccggaatcggccaccggccgggagatagtcacgctgggcgagggacgcccggcgccagactgtcacgtcctgataaattcatcccgaattaaaaatcattcgctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaaaggtttataaaaagaaaaaccctaaaagaagtcttcttcccccccttcctctcttgggccggctcggcccacctcgctctttccctctctctcctccccgcggcccactcggcccctcccccgcgcgcgcgccgctgacaggcgggcccgcccgccaccctcgctgacgggtggggcccacctgtcatcgccttcctcgcgccgctcccgccgcccgcccgtgccctagcgccgccgccgccgcggattccgccgcatcccgccatccccgcgcgcattaaagagggggaaatcactccccgtgattccctctccgtttccccccgcttttccctctctctctccctcggattcgctcggaatctttcccctaaacctcgccggcatcaatggcgcccgagatcgccgcggccgtttccttcccctccggcctctctctctccctcccggcgctatataattgttccccgtgcctctctcctccgtttccgccgctcgccgctcgctctccccgtcggattcgtgctcgcgccgtcctcctctctctccgccgtcgccgccgagctccggttcgccgccgtcgtcgccccggacttcctcccgtctcggcgtcacctccatcggcttcgccgcgtcgtcgtcgacctcgtccgctcctccgtttcgcccgccgaccgccggagcaccgtcgtcctcgccgtcccgaaccgcgccggcgctttcctccactccggtcgtcgtttccgccgtcctcgtcgtcccggggtgagccgtggaccgcccctttcgcttccctctcttctccgatctctcgggcgccgctccgccgcgccggtggtcgccggcggtgaccatcggggcgcgggcgcgccgtctcccgtcggccgtgccggcgaggccggcttcgggcgcgccccgcggctgccaggtggggcccggccgtcagccgcccgcgcccgcgggtgcggctgacgcgtgggacccacggcgccggccgccgtcagccgcgtgcacccggtccaccgtggaccgagaggctgacgcgtgggccccactcccgtggacccggtccgcgcgccctctctcccggctgacgcaataaatgagtttttaattaaaatttaaatgaagaaattcgtaaatatccatttaaagagcatataaacttcaaatggctatatcttggccatttgaactcggaattggaccgttcaagtctctaatttttccttaagaagtcaagaacccatttttgtgctttgtttctgctgttatgtggagtttattagagtaaaagccgtttcttttccgttggtcgtgtagacgctgcagcttcggaagatccgctcttcgtggaagttgaagccggtgtttgggaaagcgagcaaggcaagtcacatcatccttgagcatattgaatcacagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactttggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcgtggcagagggttggtgccctgctgcttggggctcagtcctgcctgcctgtcccgggggttccggccgtaggcaggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgccgtttactgcaaaacttaacccctatcttattatccccttgtactcctttgcattaattgtgcatctccggtgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtacctttgtaataatgtaaatattatcgatataataaagatgtgtcttttataccatgtttgtgtggtgtacccggcttttcctgggacggggattaatacactggtgttcgggaaaaggcaattttcccggtcgcgacaagatggtatcagagccatctcgactgtaggataagccaagtggataaaacctaaggacatattttataaataaaactatttgcgaaagttccttttttttctccttcccctaatgctatttgcaaaaggtttactcccttcttccttcttcggatttccactagtactagatggttagtttgcgaagaagaagatgtcgccaattgttcgccgaagctccggaagactgcaggatccgctagcgaagtggaggaagcagtgaagccagctgtgaagcagtgaagatcttggagaacccgtcgcagaacctaagccaccctgtagggtagtgttgttagtcgtgtgttccttgcttgtgtgtgtagcgcgtggtttgcatcggggggttgtgatgtaaccatgctaggttgtttgcttaatcaacttgcagaataagtgaaacaaacaacacatcaacaaagagagttagttcctttaaggtcctgtccctagttctggtctattctttcctagcttgtttcctctctcacctcaatccctgtaacagatgtttaacagagaaaaaggaaagaatgtcagagggtatgcctccagtaactcaagttttcaactcaatccaccactggcctcaagagagttaaccagggcacacccttggtccattccaagcatgccgcttagttcacagctaccattggttggaagtcaagaccaaaatcagtatgtgtttgatcgagcatttgccacccaggtcaatgagcttccaatgccagaagaggatgtccccttttgtcacgattgtagagaacaaggacactatgccctgaattgtccatgggtatatgccaaagaagccccttcctttggtttaacagggcagacatcgctaaaccagcctcctcgcaccaagtcaagcttgcagcctagtgtgcaaagtagagagcccaatggagagaatccattgaatcccgggaattgctttcctcctagcccttcgtaccacgtggggtcacgtactaagcaagccaaaggcaagaagagtaagaatcagaagagaaaagcgccgatgcgaactgaagaagaagtacgtaagatggctattagcagcaccgaatggcctcccgcagggataactattcctagacgtcaaagaggaaataccttccgaggtgcacgacagttgacccagcaccttctaagccatggtggcagagtatctgatagtgaagggtcagatcaagtctcctcggatgatgaagatgagtctccccgacatctcggtgaggaagagatggaatcaaaagcatgtatccgttgtggagaaattggacacattgctagcatgtgtctcacactctgcgcttattgtgaagaagaccatccaccaggggagtgtcccacccgcaaggtcacatgctttctgtgcgaaggtacaaatcatgtgcccaaggattgccaactcagtgtgttgttgaccaagaccgcagaaatccaacgaacgaccctacgattgtctcgtcagctagtcagctccaacagcaacatcgacgatatcatccacaacaccaatgctcctcctgctccacctaactctgcaataaatcatagcaataatatctttagcaccaaccattctctgcaccgacagcctcagcaaagagttgtcgtcgatggaagaagttgtgtctctccccgacctactccaggccaagcaaagggcaatcaacctcaggagggcgataccaagcagaaaaccgtcatccgcttcaaccagcaatcagaaggaagcttctcctgcgaatgatagcattatgcagtcctatcacatcatcacagaaccaatcaaggatgatgcagtcactagaacaatgccagctatatctctccggaatcaaaatgagcagccatgtttgtggttttcagtttgctacttatcattgtgtaatcgaaagtatgcagcaatcatgtaataaacaaatatattcatgattttaaacaatgagcttgctatgtttagggatgattcatgttgaggatacaatgtaccaatgataagcaccttccctttttgtttaaggcagtgccttgtattcgtgtaataagggagaaatgggtaatacagacaagttctaagaggattcttgtggaagatgcggatatgtgatcatatgtataattgtttactgacaaggagacctagggtctcgtgtcagaagaactatattataaactcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaacgtatttccttgaaggtagtcagtgcagctttttgacgaaccacatcaaggtttcacggaaaggcagcaagccaaaggacctcatcgtccccagaagcgtccgcaatccacattaaagaataccacctgttagagataagccgaaagatgattgataaaagagattggcaaagacgttctccagcatgaaagaagtaggccgaaaggtgattgataaacagaaacatgctctgcatcgctcaaggaagacccctgatagtaattgccccgcaacagtcaccttgtcattaagtaagcaagatgacctaggtaaaagtgtttctatgaaggcaaagagtgaaatcttcaactcggtatcagatgctgcacggagtgaaaagtgcaagcaccggttaccaggcaacaccatgtcttgggagattgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgacctaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcattggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaactgcggatcgacgaaacgggcgaaatctacgcgacaaacaaagcacacaagcaaaacatgctataagactactgaaacaggaaacaaaaccatttttaatggattctacacatttttcttgatttactgagacttgaatggacttaaacggagctcggatgaattagttatgaattttagaagattcactgtgtttttactaataaagaaaaagtccttaattaattattgcgcaatatattccagggctgacgtcagcacggtgtggcgcggc

SEQ ID NO: 29041 - DNA, 1704 bp, Oryza sativa
tagggaaagagaggagaggaattagggcggaggaaatcccccactagcgaccatccacgccggccggagtcggaggggagagagaactcaccgacgacgcgagggaaatggggtttcggtggtattccggtgacgcagagcagcggccgggaagggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcgaaaaacgagagaggagggcatggggagcattttataggcggagggggaggcggacgtggccgggaggcgctccgatttcgccggcgacgtgggggaggagagagagaaggtggggggagattcaaaatcgaatcccgcccctctcgtgcgctggcgcggccgggagacgcggggagagggcggcgacgtggcgtgggcgcggcgacgtggcgtgggcgcggggaaagcggaggaagtgggtgcggcggcagcggtttcggcgggacggcgcgagcgggagaggcgggaggtgggagacgggtccgacaggtgggccccacctgtcggcgaccccgggagggagggaggcggacggccggctgggcctcggcctgcggccggcccagcagggaggagggggaggaaaggaggagatgggccggcggcccatccgaaagaaaggaggaaaaagagaaaaaaaaagaaaaagaaaaaagaaaaaggatttttttttcctggaattaaaattgcactttggtgatttttaattggttaaaattatttctagggctctgaaaattccactaaaaatcctgttagcatattttgacatgtagaatccaagaaaaattccacatgccgattccgattattatttgcatttattactttagggtttctctctaggttaaattaaacaatttcttcggacgatttattttatgaatttagagcaagggaggggaacttcagggcgtgacaaacctaccccccttaaacagaatctcgaccccgagattcggaagagctggcgaagaggtgcggatgggcggccttcaattcatcttctctttcccaggtggcttcttcttccgagtggtggctccactgaactttgcaaaacttgatcaccttgtttctggtccttctctcactggtctcgaggatacaaatcggcttctccacataagtcagatcttcctggatgtcaatgtgctctgagctagcttgttcctcaggtaccctcaaacacttcttcagttgagacacatgaaacacatcgtggataccaaccatattagatgggagctcaagctggtaagcgacttcacctctgcgttccaagatcctgtatggtcccacaaagcgtggtgccaacttgcctttggtttggaagcggtgtactccccgaagcggagtgacacgaaggtacacataatcccctgcttcgaaagtaagctctcttcggcggttgtcagcataactcttctgtcgagattgcgcaattcttagcctttctctgacagtcctaactttctcctctgcttcggttaacacttctgtcccaaacagtggcgctcaccttgttgatcccagaaaagtgtgtgcggactttcgtccgacaatgctcaaacggtg

SEQ ID NO: 29042 - DNA, 5554 bp, Oryza sativa
  unsure (1)..(5554): unsure at all n locations
nnnnnnnnnnnnnnnnnnnnnnnnnnnnnnnnnnnnnnnnnnnnnnnnnnnnnnnnnnnnnnnnnncttctccacataagtcagatcttcctggatgtcaatgtgctctgagctagcttgttcctcaggtaccctcaaacacttcttcagttgagacacatgaaacacatcgtggataccaaccatattagatgggagctcaagctggtaagcgacttcacctctgcgttccaagatcctgtatggtcccacaaagcgtggtgccaacttgcctttggtttggaagcggtgtactccccgaagcggagtgacacgaaggtacacataatcccctgcttcgaaagtaagctctcttcggcggttgtcagcataactcttctgtcgagattgcgcaattcttagcctttctctgacagtcctaactttctcctctgcttcggttaacacttctgtcccaaacagttggcgctcacctgtttgatcccagaaaagtggtgtgcggcactttcgtccgtacaatgcttcaaacggtgccatttgcaaactggactgataactattgttgtaagagaattccgcataaggcagacttttatcccaggctccgccaaagtcaagcgcacaggctctcaacatatcttccaagatttgatttactcgctcggtctgaccatctgtttgcggatgataagccgtgctgaaattcaaacgagtccccaattcttcttgcagtttctgccagaactttgaagtgaactgactccctcgatcagatactatcttcttaggtaccccatgcagacacatgattctcgagaggtagagctccgccaaccttttgcccgtataggtagtgtgtactggaataaaatgagcaactttggtgagtcgatccacgaccacccagattgaatcgtgccccgacgacgttctgggcaaacctgttatgaaatccattccgatttcttcccatttccattccgggatctgaaggggttgtagcagtcctgcgggcctctgatgctctgctttgactcgctgacaaacatcgcagagtgcgacgaattcggctatttctcttctcatgctggcccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccattctcatcctcatggaaatctcgagcttttccaaccctcatattctttttcagctcagctatttcaggatcatttacttgagctgctctgacttgatccacgagcgtaggccgggcctctagggcagctacgtacccgtgttctacgatgcccaaatttaggtgctcaagatcttgctgcaatttgtcacacatgacttcggtatatactgcattgcaatagctctttctgctcagagcatctgctaccacatttgctttgcctggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactgctgccaactcaaggtcatgagtgggataattggtctcgtgtgggcgcaactgtcgcgaagcatatgcgaccactctgccttcttgcatcaacacacatcccaatccttggcgagatgcatcacagtagacctggaagtctttcgtctgatctggcagaattagaactggtgcggagactaacttcttcttgagttcttcaaaactttggttgcactcagctgaccatttgaatttttcatctttctttagcaactgtgtcatgggcctggcaatcttagagaaattttcgatgaaccgacggtaatagcccgcaagtccaagaaaactccggatctgagaaactgtctttggtggggtccactttgtaactgactccacatttgatggatccactgccacgccttgagcagaaatgatgtgacccagaaatttgacctccgataaccagaagtcacacttgctaaacttggcatatagttggtgctccttcaatatctcgagtaccaggcggagatgctgctcatgttcctcttctgattttgaataaataagtatgtcgtcaatgaataccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactgatgatagcctgatcgtaggtctatcttggaaaacaccttagctccttttagctgatcaaacaggtcatcaattcttggcaacggatatttgttcttgattgtgacctcattaagggcgcgataatccacgcacatcctcttggtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacgctggggaacggaaggtgatcttcccccctttgtcgttggttagggtgatggtgcggcttgcgcagtcaatcactcccttgtttctggtcaaccaatccattccaagaatgacatccaggtctttagattcgagaaggatgaggttggatagaaacggtgatcttttgatctctatagtcaccgaggggcagtagtgtgctgtcctcatatcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctgactgaactgacacagttggcggatctgactgagctggtgccattagtgggggtggagtcgagttgtggttgcgctgcttactgttgttgtgactgccaccgttgtaatcgttgtcgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcttcctgacgaatagccttgtccacaagcttctcaaagtcctcataaactccggagattagctggttggtcaattcatcgtcgagcccaaacaaaaacttctcctgcttctcagcatcggtgcgcacgtcctcaggggcgtagcgcgcaaggcggttgaactcatgcaagtactctgtaactgacatggttccttgctggagcgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcgttggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgcccctggcgtcgctggagtcacggggatcattccttgtcttcaccatctggaggggataggtagaaataagagaaaggaagaaaacggatggctcggaaactaatttttcttatgaaattaagtgccattatcttaatctggattaaaacactgaaaaagaggcacacaattcctaattaaggctgtcataccactcacacatgatatcgaccgccgactaacccacaagcaacaaacctaagcacggaaactagcaagcaaacaaaactaagaagacgataaagctaagggcggcgactctgaagcttggagcggcgcttgcgatcgaagaacaggtctgacatctaaagagtacagagggataggaaccaacacatgctcaaaaccaaattaaataaagcaacaaatgactaagtaactcgccgagcatgatgatttttatgcatagaacatttttcatgaacccggataaagacactaatgcgactgactaaaccatagcttaatgcataaacttgttgcatggaaaatgatgcgcataaaattgccccatcgaacatagacacgacctaatgcatatcacccgataaattcccaactgactgtcaaataaactccaaataaacttttaccaaaccctagactgtccctagtcgagaaatccaattaaataagcgaccaagatttttcccacaaactcagaagaacaaaaccccaaaatttttcccgaaacaaatccaagtgcaaaaagcatatgcagatgaagaggggttcagagggctcttaggtttccagttggcttgtcctacggtcaaggtcggctctgataccaacttgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcattcttgacggcagcgacgaaaccaacctcttcgagacatcttcaactgagaaggacttcaactctggtgtgggggaaaagagagcaagactgagtactacccactgtactcagcaagt

SEQ ID NO: 29043 - DNA, 681 bp, Oryza sativa
tttattacatgattgctgcatactttcgattacacaatgataagtagcaaactgaaaaccacaaacatggctgctcattttgattccggagagatatagctggcattgttctagtgactgcatcatccttgattggttctgtgatgatgtgataggactgcataatgctatcattcgcaggagaagcttccttctgattgctggttgaagcggatgacggttttctgcttggtatcgccctcctgaggttgattgccctttgcttggcctggagtaggtcggggagagacacaacttcttccatcgacgacaactctttgctgaggctgtcggtgcagagaatggttggtgctaaagatattattgctatgatttattgcagagttaggtggagcaggaggagcattggtgttgtggatgatatcgtcgatgttgctgttggagctgactagctgacgagacaatcgtagggtcgttcgttggatttctgcggtcttggtcaacaacacactgagttggcaatccttgggcacatgatttgtaccttcgcacagaaagcatgtgaccttccgggtgggacactcccctggtggatggtcttcttcacaataagcgcagagtgtgagacacatgctagcaatgtgtccaatttctccacaacggatacatgcttttgattcc

SEQ ID NO: 29044 - DNA, 329 bp, Oryza sativa
caagctggacggatggttccgctcccgcgccctcgcggatctcggggagcttagtttcagctacaaggtggagcgcgaggcgcaggcgcaggcgtacccgctgtcgccgtccgctctgcggttcgcgcccaccctcgtcgtgctttacctcagcagttgcgggttccccgacgagatgccgccgacgctgcatttccctcccctcaaccagctcacgctgtgcagcgtcgctatctccgagaacgccatccatggcgtgctgtcacgctgccctgcattgagagcctgctgctgcaggggaatttcggcgttcgccgccttcgcatcaa

SEQ ID NO: 29045 - DNA, 380 bp, Oryza sativa
ttgtactttaagtcctcaaccaaagctacattcttcaattcaaatttttcatttaccttaaccaaacctgtagcgagaatgacacttgtagaagcatcaccaaagataatcgattcagtcttggatgcctttttaagagaggagaaccaatttttatcaccggtcatgtgccgcgaacaaccggaatccacgatccacacgttctccttccttgccaccaaagcctcatgatcttcatattctatatccgattcaccacgcgccatgaagcaaacaccggagatgttctttcccttatcttcatctccagtctcaccacctacatcacttgatggttcaaatgcggcgtagacttgatcaaaagcattcctaagattctc

SEQ ID NO: 29046 - DNA, 201 bp, Oryza sativa
agtgggtgggaagaaggagcacacggcgatggtggcaggtcagggaaattcggcggcgcgggggtgtggcaggaaggggttcgagagcggtaatagcgagtagcacgggagaagtcttcgcgtggtgatgggagcgaaaatcacggtgaagataggatggagttgctgtgcgagggtgaatcgtagtggacggtagggatg

SEQ ID NO: 29047 - DNA, 891 bp, Oryza sativa
tttgtaacaatcagaaatcacaatgaatcagtgcagtcaatcatgatatggaagaaaataatctcattgtaaaccagagcctgtgcacctaacaagaagtatagtagtaggcgatataagatccacttggcaattttttgatgagcaatctaagagaggggacgagagagacgagaagcgggtgactaattagttgctagcctccacgctcatccactgcactcttcgcatccgtccaccgccgtcatcctcatttatcatttagtcgcggctatcatcgatgccctctgctgccaccgccgtggtcctcgtccacctcggctacggtcctcatccaaggctgccgctgccgccatcgtgttcgtcgctacagcttgtccactatgctcgccacgtcgcgtccgccgccgttgccctcatccatcaggcgccgccatcgccataaccctgttccgctgcagctccgtcctcatccaccctagccgccgcgagcgctgccatcgtccaacgcatccgtgtgcagtcatcgtcgttctgaagagaagagatgagtagaagagatggtactatttgtgttcatagtactatttgtgttatattatttattcatacttttgacattagatacgctatttattatttcttatagatgacagatattttctgaactaacaacatgctctcttattgaccttgctatgaaggtccgagagttggtgccattatgctaacaagatcactgccaaatcggtgtcatagtgcagccttgcctctatcccaattcacagaggaaaatttactatttgctatcctcctaaaatacacatggccaaatatcactctcctaaatttttattcccaaatacacgtgtactagcttcgatggagtac

SEQ ID NO: 29048 - DNA, 676 bp, Oryza sativa
acagattccctgactttgtgcagtctgcagttgtgccactgatatgtggaccttagtttggtatgacccacatatcagtggcacaactgtaaactgcacaaagttaggggagtctcatccgtccccaccacctacgcaaccgccctctgcactgtggactcagatcgtctgcattggctcttgtaatgcagagaagttctctgcattagcccagatctaccgttcatccaaaatccaacagatatgctcgtttggtgtctcttcgtataaaatcagcaaaagctcctgagtttatacagtgagtgagctaaaaaatacaaatttaataagatacaaaatggattccagataatatatttagcacgtaaatattgttgtttgctctcaccttcctccttgctacacttgaaaaaaggatacacttcctccgttacagaatataaagcatccataattttacaaaaaagtcaataatagtaacttttgattaatgttcaggctaatactagtaatatgtatgttcagtgttatatatgtgatatcattatattcatattttaaaatggtttcatatattgttaattttatagtcattgataatatattataaaaaaattaatggtaatatcgaagacagtgtaaaaaacataagctctttatagtttgggatggaagg

SEQ ID NO: 29049 - DNA, 692 bp, Oryza sativa
ccaaagctttacaattgaacatagtttccaaatgactttttctctgatatgttaccttcattcttaaacagatgacatttttgaacatatgcaagctgtcaaatattaaaggaaaaggtttattctacaaccttgcgcttttaaccatggtttagaaattcaccctgtaactttctaaaccgttcatcctaccgtcataaactgaggtagtgatgtggttttggcttattcagtatagtcccccatccccatgccgttcccctattttcttcttgctcctctcctcactccccttccccactctgcttcagacccccaaccaaagtacccaatcactgtgtctcagatcatccaatggaggcaacagcggaaaatagtccatatgccacatctttgttcggagttgtatttcgcctatggcttaaggtacgggagaaatttcggtactatatatttaagaaggttgggtaagttttggtgaaatggtggtgaagaagttgtggcattatccaattattggttatgagtaaacctccttttgtatattattttagtgctcttggttgataatatagtttattatgccttgtgcaccaataaccctctatgtagcttggttatcgaccgttgaataaatggttcttcagtttatttgtagaattttagctccttggataaaattgatgggggcc

SEQ ID NO: 29050 - DNA, 1055 bp, Oryza sativa
tacctcaaagtatggctaatccatgtttttagcaataatcacattacttgatgtggtacagagttttttttggcaattattgataacaaaaaataatcatcaatgagaaatcattctgctaaactattacatttcaaacatcaccatttttagggctgtgctttgttaagatatacttcattggccaatatttcccaatctttttatactatttcagggctcagccgttttattgccaaaattaatattagcctttgttgtttatcttgtcattcattcttgtatatctcaccatttattgtttccatatcaaacaagaactcaaacatatctgccaagataatatctattaatagcctaaaaaaattttctatttcccttggctttatcctcatcgtttcctccacctacatgtacatctcaccatattctccccaatttccacaaaacaatttagagagaaaaatacagatcagaagaatgcttcaggttcaaggctctcttcgtgtccacactttctcctctgctgccatcgtccatgccgttgaaacctctgatgaagattctgatccatcccacttctgcgccgtgccgcagaacggtaagaaggcatcgaggaaggagatcaagaggaggataaagaagcttctgtcatcgctggggcagaaacaccacatctctaaggtgttcttcagatcacgttctgaagctgccaatagcaatgctgtcattgacaacagaggtggtggtcagagtgacatggagacttttgtgtccgcgaagagctccgagttgtgttcattccgtaccgatgatgacgactccgagtcacgatcgtttcgtctcagcccgttgccaatcttcccaaccggaggtattgaattccagccacccgcctctccagtgaagataatcaagaagctcccatttgggtatatcatcggccgtcagctcgacggcgcccccgcagcagcggcgccatcaacgaagctctcattgagcttcaaaaagttgatgcataggttggttgataagtcaaagtcgaagatgatcaa

SEQ ID NO: 29051 - DNA, 298 bp, Oryza sativa
atgcaccgccgcagccttgctctcttactagtgctatgagtttctcgtgcatcagccacctccatggctctatcagggtaggggaagagagggacggatagagagagagagagagaaagaaaagcgagaggagttgataagaatggctctatcacggtggggggaagggaagcaaaggagtggataagaagtgagttgccagcgtgcatccggtatattgttttcctccgaactaccgagacgaagccttttcggaaaatttaactcgcttctttagatgccatgttattcttcataa

SEQ ID NO: 29052 - DNA, 904 bp, Oryza sativa
tttcattattatggcttctagatggatactatacgtatgtaatactattgtgtgctactaatgagacaaattggagataacttggtctcggaatatggtttctttgtttatttcatgtgtaggtgactcgatgcactagagggtttcctaagggttttaggacttctagtatgagtttggttcgttactttaggctgcctacctcgggtataaatagagggggagcgtgaggcttccggtattgctttagagagcaattgagttgagttttgagttagggttttgagtttagtcgaatttttttgtaaggagtgctgttggtgcattttgtaaacacagagagaatcaataaagtcgttatccactttaagagttcttcgatttgtgtttaccgggttttggcggtgtaaccgacgatataccggcggcatacgggcgatcagaccggcggcggcaacagtaagcggcagctgatctcggcggtcagaccggagatctaatcgcggtcagaccgatagcaaccaggcggtcagaccggcagagcaacttcggtcagactgcgatctgtcgaattcgagggtaacttttatttccgctaaaagtttttggttttttggatatatcaaccattcacccccctccgggtggcttagttattgtgattcgatcctacaagtggtatcagagccctgttttctgctttggatttttatcgatttagagtttttgccatggctactcctgctaggttttgaactaagcctcatgttttcgatggaacggatttttctcaatggtgtagtaagatgcaattttatatttggagaaaagtttctcattcttatgtgattcctgaagctattaatactgctgctgaaaaaactgcgtttgaacaaaattgtga

SEQ ID NO: 29053 - DNA, 2588 bp, Oryza sativa
caaaattggatctatagcaaagttatcttttttttgttttgtagcatcgaaagttcattgttcactttagtagaacataaattcctgccttttccctacatagcatttccatcgctccaactccctttctagttttctttgactgaaatcgacaaaaatggcaagacaattgacactatagggccaatttattcttgtccctattttgatgttcaatattaattttgcctctgctttttagggtttttgtttatgcccctggtttcttgaagcgaagccaagttttatctctactttagaaggagatgttagctgtgttaaatttttagcaaaaagacatccatacccttgcttgctactgtacattccgaactttggcagattcaaatcatcaaagaaaatctgacagattctagcgcagcaagaagtggcataagcaataaagcaagcaccagctccacatcttttcttcagctagcaagcaaccagcaactcctcacctcttcagcaagacagttgggcgttggcagcgatgccgcgaggccgtgagagacaacagcatgacgcctcaccgacgttgtgccgccaagcaggaaaggccacgccgaagccatccacaccacgatggttggacgtaggggtgaaaatggagcggattcgaacggatagtagttataccatatcctaaaccatattttttaagcagattcggagcgggtgcggatagtgtacggatgtggagcggattgtttcggatgtcggaaatggtgcaaagtcggtgcggaatcggtctggaaacagattaaatttatcggatgttacgtgtgtatgcaatcaatacaacatcgagttagcaatccaaggaacattaatacaataatcaataaatgacccatcgtaataattatatgattaagtgctaaacatcatgaatacatgatgtccataatataaaaactagtaatcgtgcacgtgcaaggcacatcatgcaaatataaattaacttgagatcagcatatcaccgatatgacaacaataataagtttattaaatttaaagtgtacgattcatttcacatcaaataaagaataaataaacatatattcaagccatgtttcattgaaatacaaaagcataagataaaataatacaaggtcctacgttgtatgaattaaggattagacagaaaaaaaaaacctcaaggttcaagagaatgtggaaaatggagataaaaggcactttgatcatccgatgctatgggtcataaaaacattgtgcttacaattgtataagaaatggccacttttatgtgaatgtgtgatcctcaacttctcctagaagttttaaataaattagagttgcagatatatattatgatcatttgaacctgacaaaacagcacaacatggtcaatcagctttgttagaaaatacaaaaaccctgcaatatttctagaaaatgaacagctaacttgtaactccaagtagcatatattgcaacctgctcttagaatagctttcttttttaaaaaaaaaaaacttacacttaatgatacttagacaatgtaatcccaagcttactgacagtgaatcgataagccaatatctgattgaacatagagagattttaacgaacaattgtgcagaatatgaagaatgagaagaactgaagatacaactaactcgtttgttttgaaacaaaccattccctcaagctagctagcaacattgaaaaactaacacaacttgcactgtacttatgaagtgcatgcatcgtatcgatcaccagattatgctaaagagatccatcaagcaaggatgcatttagaaaacattcagattaaaatcagttatgatatatagttcagctgctaaaacttttattgaggtcaacaggttacaggtagcgaatgactcagaaccaatccaatgggccaatccgtgataaaagaaaaggtggaacccgtagatctttatattagatgaggttttatactggtgtgatactggaatatcagttcaagctattttctgctagctatgtcataataaggtgtgagatttgggtacctgttacactttttttaatagcagcctaaaatctttttatcatcagcaaattgatccatgtacacataaggaccacttaggtaccacgaacctgcagcacaatgataatattcttcaacacatcattgatttgcttgctcagggatggaagaaaaagtcaagggggacaacataagagcaatcagacaacaatatcaagaaaaacagtagttacctttttgtatttgtgaaatttaaagaactactactatgctggaccatgccaatcaaggttgaaaataacaagccaatataaaggcaaaattaattagattcatggaatgcaatttggttgcacgctcctagcgcagaggtcgggaacacaacccaccttgtgcttcaataaaatgtctctaaagaaagatgcatcatttcttttaatatatctgtctttggatccactcaaaccaaattttaagagattggtccttggacaggttcattgtgaggcaatctaagccttggtaatgaaaagataaa

SEQ ID NO: 29054 - DNA, 647 bp, Oryza sativa
atgtgtagaggacggcagactggaccatgtgccgttcggtggatctgatgccgctggtgaggtatggatggctgtgattgatcttgtctttcggcgtgcttaaccagggaataataatggagggaaaaagaagcgggaataggaggcgcacgcgcgccaaaattttgtttttgatggagcggtgcccgtgctcgagattttttttttctatatacatgatcagcgtgttttctatcaaatcgttactcaaatatttagaacccagtacgactcctccatccgaccggtgtaacagcttctgcctgaatttcgtcaagctaaggctgtgtttagatccaaattttggatccaaactgcagtcattttccatcacatcaatctgtcatacacacacaatctttcagtcacatcatctttaatttcaaccaaaattcaaactttgtgctgaactaaacacagcctaaatccagtgcttgctaactttgtctcaatattctgtttttgcgtatatacacacataataaaaggtatagtgacatcgaaaaccataaagtacgaagtatactgtactgtccaatcattgcataaaaataaacatgctaatgtcttgtttagttcgtcgattgaaattagacctagcacttgga

SEQ ID NO: 29055 - DNA, 394 bp, Oryza sativa
atttttttaagcggatgcggagagggtgtggatgacgtacggatgcggagcggattatttcggatgtcggattcggtgtggagtcggtgcggactcggttcggaaatggacaaaaagttgtcggatgtcaagtttgtattcaatccatacaacaagagggcggcaatacaattagccgcaatacgatggcaaaacaacatatgaacatgatctcagctctctaggaaaaaccaaccaaaacacatcaataatataattttgcttaatataacacatccatcaaaaaaacatgatataagtgttcagttcagcagttcactgcattgcttaaaatttaaaaatgtagtgttcagttcagtagttcactcataagtacgataggcatgaggcaatg

SEQ ID NO: 29056 - DNA, 1678 bp, Oryza sativa
tgccatctatcgaataacagcaaaattatagtgacatttctccaaatagacgaatagtaataaaatatttcaaaatcataaaagttataatggcatggttccaattaatcctaaacattaccagcctataatgagctagtagcccatataagtgcaatttgttggctgaagagtttggtggttgagttgatatctacaagctagctaggaaatcatgaaattttatcgttctaaccaattttaaatgcaaatttctaattacgttatgtccgctttcatatttataaaaagttcatatttctcaaaattattggttggttatgaatctacttttgactaagacgttttatacttcttttagatatttaggctgtgttcggctggctaagttcccaactggaacagtgcgcataaaaaacagagcgatccatttgcacgtgggtaattaaatattagttatttttttaaaaaaatggatcaatatgcaattttcgtatagaactctttacaagaaacacaccgtttagcagttcgaaaagcgtgcacgcggaaaaggaaggagaggtgttgggaacctggatgcccgaacacggccttagtgtatcaagaatttgaaattcttaattaagacaaattcaccatctaaggacaagaaaattgttatagtatgtgtagcagtgttcttaattgtatacttgctctccctaaagttaactgtctttttgggatgtgtgcagtaccatgtttaaactttgacaattaatataatatcactttgaatattttgaattcaacttttttaaaattgtatgaatagatttctgtatcaaaaatggcttcaaaatattataactttgctacactttaccatacctttttattttatactagtagtgattactatcagaaaaattcttttggtgacttgatcaaaaacatgctgcaaatggcataggtatgggaattgaacatattatattggtcacgctttgattcatacccctgatcgtacattacatcttaaaaatattcttcatgttacccaagccaaaatgaatcttatttatgcttctcgtctagctgaagataatcatgcttttcttgagattcaccctaaatattttttgttaaggattgggtcacgaagaacacaattcttaaagggtggcatcaaaggggcctctgatgacgctctctctcgtggcccgatcttctggtgaggggataactctcgctttgatcgagtgcgacgtttgtgacgtggctaccaattagaacatgtccagaatgccgtgcaatcgctaaaccacaaacgatgttgtaccaaccgtggcgcgcggttgatgatccctgcaatgcaaatgagagaaccctgcaagaacaagataagatgcaatctaaatattgcgaataggtaattaagcacaaagaaatggttgcgattgaagtggtagatccaatcgacccgtcaaatcaacacaccgaatattgggggctctgaatctatagtcgccgactagtagagcgaggactagagacaaggtgaatagcacttagcaaaattcaactaaacaaaaccccattgtttttcaggatgtacaaagctatttatagagaaaaataaagctagggttaagtactaattcgtggaggtggagggagaaacttccgagatggg

SEQ ID NO: 29057 - DNA, 176 bp, Oryza sativa
tatcccccatcgacagtggcgtgtcaggtaggggaacttggtgctcaaggttctactaatatgtcatcaagcttcgttgacaacagcgtcaaccctggcatcaaccaaggtgtttctacttcgacaatactgatgtggacacaaatcgtcttcctggtttacaccacggtgccaat

SEQ ID NO: 29058 - DNA, 1074 bp, Oryza sativa
cattcattccctcctccctcctgttcatcttctcagcaccaatggcagcagtacaagcatgggtgaaagcgctggcatagaaggcgcttaacgacactgtcggcaacgggaacatcaccatcttcgagccaaggaacgaggacatggagcgcgacctcgacctagagttccgccgccaccacgtcctccccgcctgcctccacggtggtcaatgagggtgggcaccgctcgtccacggacttggatgaccttgttcgagcgtgtagcccgcgccgccgctgctgccatcgacccgaggagatactctcgtggggatccatcagccgatcgagaacgacacctccggcggcggtggagaagcccctacggctaaagtgcctcactcagatttgggctatgaagttgccatcagcctcgacacgccgctcacgttcctcccggatgagagcagcagcgaagaggagacagtggcgacttggcggctgttgacggtcgttatcgatcagtttcaaccgtcaatattaccaaaatagaggagaactagtggtgcttgcaatgcatatgtttgttagaataataatattccactagtattaggtctactaaccttttgcagagaatgacaataaagtggaggagaatcgacatcaacacaaacgataaatcaatcggacgatgtcgagaaccagacttgtgtatgaatgggccaagaactcagaattgacacgacaaactgggccaaaattcacaagtctgcggagaagaacaacagaggaggccgccagccaaaccatgggctggttgggccggccctaggttcgaccgaacctggtggttcggccgaacccccctcatcgccgctggatgcagggtttcttctgaacggtgtggattagctcccaatgacggttggagggtatttctaactattccaaccgtcacaaccgtcattaggaggctatataaacccctcatcttctcactttactcacacacctcaaggaagagctctctcattcctctcaagtttagtttagtagtatctagctggtggaatagaattagaataggaat

SEQ ID NO: 29059 - DNA, 447 bp, Oryza sativa
atctactcgtggtctgttgctgcactgagctgctgacaacctcaaattcgcagcacatcgctgccttatgccactgataaacagtaaattgtatagtcgtgtgataggttatgagagatatcaactcaacttgcaatccatttctctgctcgcaaaacccttctccttgcatgaacttttaccttaataaacttgtgttcaggctggcccagtaagtccgtcattgttcgcctcgaaaaatacattatatatgtattttcttaatggaagacaaactaacccagggaatcatatatggatcttgatagctaaatcactaaattcttattgtttaagatgttgaaactgtataccattattgttatagttgatgcgcctatgcctcagagatcacactattcatcaccaaagaacaaaccttaaatcttaaaccattatactccctga

SEQ ID NO: 29060 - DNA, 849 bp, Oryza sativa
cttaatagattaatcaagtggattgaccctgtaaactacccatctgtttagtccaagttgatggatcgacccatctctaaccctattactatccagtagtaaatttgtagaagtacattgtttcgttacgatagcttctcaggaatattcgggataccaatttttttgctgatatataccgtcggattcgcacaaccgttgcgtgtaaatgacgtggaaagacgtcgcggacggtattgcgcaaagaaaatgtgagaccgtgcggtctcgcgtcgcgtcgctacgcgagaccgcacggtctcacattttctttgcgcaataccgtccgcgacgtcattccacgtcattttcacgcaacggttgtgcgaaaccgacggtatatttctgcaaaaaaatttgtatcccgaatattcctgagaaaaaattgaacgaacaatgtattttcaaatttaattctggttataatagggttagagatgggttgatccatcaacttggactaaatagatgggtaatttacagggtcaatccacttgattaatctattaagtgaatttatggtttgatttacttgcatccatgcctggtaggtttcatactgaacttaaacttttgagtggaaccaaaactaaacttaactttttagtggaaccaaaactaatccatagataaacatcgctttctaggttgatctatattatccatgggttattagggttgatctaacttgatgtcggtagccttgtcacatcatagtagaaggagcaaccactccatacaactcaagctcctccatcttcaacattgctaagaccataaacaaatggtgatcatgttgacgatatagct

SEQ ID NO: 29061 - DNA, 9293 bp, Oryza sativa
  unsure (1)..(9293): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatacaaatattgatcaactgagacaatatgaaatatggaaaatagatgaacaaactcaccttcgttggtaatctggttgtggtcaccgtgttgagtaatgccatcaactacatcagccacaagggtgttgtcatcatgctgggtgaagccatctaaaaaagggcagcaagtaagaaaagcattcatcatacaaacaaaacttacataacgacagtaagaattcatcacctccattgtccatatggttgtgctgattatgttggtcgatagcatcagacccggtggtcatgtgagtgttgtcaagtaaaaatgtgaaaattggtttcattaattttttttattcttaaaactcaagttaatattttcaaaaggtaaacaagcaataaacttagatcagcaagttaaacatttttatagctgactcatgttaatggaatgtaaccaagaaatgtggcagtagaactggccttcaacagcagcctgtgtgtggtcatctaagttgccatcgagatctccagcgttagcttgtgatgtagctggcatacaaatatcacttggtgtgagacttgcatcttgttgggcaatgcttttctttgaccttgtaactttaggagtcatttgctctgcataaactctcttgcgagaccgaaacttgactccaccagtctggatacttgaagttttgttgttacagttcttgcgagtcttctccttagagcactgctggaaagaaaagcatggattggtcaacatagtattacattgaattaggaagaaaaataacaagttaagacttgtcaacataaaggaattacaacctttgcattctcatcatcaatcaaatctccttcaccagtatcatcctttaaaggatcatactcggactccgaatctccactttgattctggtcagaatgaacaccaacatagccttccaaaactggggtgtagcgatcaggaagtccaagctccttcagccttgcactgttcttcatgcattcttttaggcgctccaattcgtatggactcagatgaactggtggatggtagacagcaacaataaattaatgtgttactgactcagtgaacaatagataagccacaagagtagcaatagcacaccatgtcttggatgaggtacagatgaattggaatattattaatggttagtggactcaaagatatatattgctagtaaaaaaatgatatatactgctggctctttgagatgcctttcaactaaacgttgtttaaaatattgtcatgaattgcatgcacaagcatcaggagaatagatgaactgatcaggaatttgtcaacaagactgaaagtgccatatgctaaatgaattattgtactctttgatttttgtttaccagtaattaagcaaagtatgactctctccccctccattccattccatattcatgtataactgtagggtatgaacaagaatcatcttgtgaacctattttttactgcaaaggcagaagcatgtaccctatcttttcaggtaaaatgaccaacactgcaaatggaagttctaactataatccagcaaacagagctttgcatctatcatccctcaatttcccaaatccaccggtcttctccacaaatccaaacgccacaaaaaagtcaagagcgaggtgatgttaggactatacctgctacccgatttccttttggattcttcggcgccataacagcgatgctggtggtggccgcgctcggagcctcccagtgacgatgggcgcgcgggcggcggatggaaccttccaacagcgttctagggttccatcggggctggaggatgggaaactggaggatgcgtggcggcgggcaggccttgatgcgccggtgagataaggtggctggaggatgggtggctgctagggttttggaggatgggtggcggctagaagatgggtggcggctggaagatgggttttggaggatgagtggcggctaggtttttggaggaattgggaagtgctgtttcataattaccgatgtacccttgagaaattttctgatggaagtgttctctatattttatattttatgaacctaagggtagtaaggtaattcggactgtgaaatatttcgggctggcgcacatcaagcgcgccaagccgcttgggcgcgcgggatttccccttatcctgaaaactcaaagcccctgttttgtttggaaccttctagatgagtatatattataataagtcttatatttgagatttgctactatgtaaaatttgttccccttgaatgattgaatctgtctcattccttcatactccattaattttttttgttggaattagaaaatcaggttagacaagcaccatatatgatacacatagttcatcatgttatgatcccttatgttgatgattattatcttaaaaaaatgttgataatgattaataaaactatataggtgttgataatttcccaattagtgcttctagctagtaagtggtataaaacaatgcatgaagcaaatttgttcccttgaatctatcttattccatcggtattagtcatattccactaatctaaatttaggaattaggaattttggccaaacaagccccatgatcccattactttttcgcgaacacgcaaaaggattgcacttcaatatgtacagagtttatgttacacaacatgatcagctgggaggagacagcacaccgtactaaacctacggagcgaacgcacagagtcaatgttgctttctctctctagtgctgaggagagatatgcgaatttttttttttgatatttttttcgagtctcggagcacactgcaaccaaccatagaaattcttagctcaaacggacaaaagatgaagcatgaggaattttttcaaagttctatccaaggggttccggagcttctcgcctagaaaacataattttgtaagcggaatttggtagttctaatttcaccgaacccggcaaagcggggagaatcggatgtaactttttctgtagatgtctgtggatatattatatgtctaatttcgagtccgtatgaaaaagatatgattgttttaaagaaggtcagtcgaatcaggcactaaaagcactaaaaacaataggtcactcgcccaacgccaaacaaggcgatccccgatgtccggcgagagctgtatgtgaagcaccgcacatggtttatcatgtcatgtggtgctgtacatatcctaggtgagtggtgcatcacgattatatttttaaaaacatttttaggctcaactagtacccatcacaaagtgtctactattataaaaattgaagatgtttttgctggtactttggtatgtcatccgtatatgagtcgtttttaagtttgttcagttttgaaaatacaaatccgtatttgagtcggtttataagtttgtttgcttttggaaatacaaaaggaaccgtataggaaatctctataaaaaactcgcacactaagtaagttgagacgatcggattccttcacccgttgcaacgcacgggtattttttctagttaataaaaaaataaaggctcaactagtagagactaaatctgtagtttcattgacacaggcaagttgaaatgccatttaggccaacaaagaatcaaaacttgaaaaacggatatgaatagtttggcatcgaaccaattatacataaattccatagatgaacatgatctcaaatacaaattgaggctatctaaaataatagaacatatggtctcaaataagtagaacatggtctcaaatactaattgagccttacgacaaaatattaaaacataaaattcaaacagaactattcgtcgtcactatcgacctccataactgagtcatcttcttcgttaaaatactccataagtgtgtcatcttcttcatcttcatcttcatcaccaatgacattcacttctttgctagattctttcatcaaccgagcaatttcagcagcttcaaaaacagggccacgctcatcatctctatttaaaggcgtatcatatataatgctagaaactggtcggcgtggatcctcctcatcatagcactcgtcttcttgatatgcagtagcactaacctccgtctgacttacgttataaagatgcctatggtcaaatgtctgtacaacttgccaattttcacccagctttgtatctggcaaatagaaaaccttcgtagcatgagtggccaatatgaaacaatcattcttgtaccacaaacttccaacattgatgcttttaaaaaagccatcatctttaagtgcagtcctctttccatccagtttgaaccagtcacactcaaacaaaactacggacctctcctctaagttatagtccaactgaattatctcttttatgtttccaaaaaaatcaattaactgaccattatgtgtagcttgtgacattactccactgttcagtgtcttcttgttcttgtcacggttaactgtgttaaaccgcacaccattcactatgcacgaggagtattttctaactctcaaatcaggaccgcatgccaaggagaagatatcaacatccacctcttctggatttgtactatacttcttcaaaatctgccacatgcatacaacacacatatattagaaaaatagaagttacattatgcaatatataacttgacaatgaacactaacatggttcctaaaccaggtctgaaatccttgtcgaagcattctttcaatgttaggcaccccttgtgtctctaactcttctatgaacaaactgcagaaaaaaaaataaattagtgtgcaacacaaaggtagcatatagaagaagtctaaaagtaagtatatagaacatacttgacgtaatactcaacttgggcacagttgtttagcacaaaccacaccatttgatcaatgccattttcatcatatacatattcaggtgcagaagtaaaattaactccatgcccaaaaacatcaacaccataagcttcttcattggagaaacctttatttcttggctcccgattaaatcttgtttcaacatcgtccatgtatttagagcaaaatgtcagacactcatcagcaatataagcctcggcaattgaaccttctggtcgtgacctattcctcacatatcgcttcaaagtatatagtcgcctttcaattgggtacatccacccatattgcacaggacccctgagcaatgcctcatcaggtaaatgtatagcaaggtgtaccatcacatcaaagaaagctggagggaaaattttctcaagcttcaccaaaattatagggatttctttcttcatttgaaccagcacatccttgttaagagttctgctgcacaatttcctaaaaaacatccccaactcagctattgcttcataaatatcactgtccagaaatcctctcatggcagcgggcaaaattctttgcaaaagaatgtgacaatcatgtgttttcagcccctgtaccgttgttccctcagcatttaaacatcttgagatgttggaagcaaatccatctggaaacttgacctcttgtaaaaaagcacaaaaagccttcttctgttcagtagacaaggtatatctagcatgaggcatctctccatcctctctaaattgcagctcctttttaatacccaaatctttcaaatcaagcctagctttagctgtgtcttttgtcttgccctttatattgagaattgtcccaattaggttctcacatatgtttttttcaatgtgcatcacatcaagattatgtctcacctttagttttttccaatatggcaacttccataaactaaccatccggctccaaatttccacatgacccccttcagagttggaacgcttccttttcccagttccttgtggcttcccaggtctgacgtctttaactctctccaattcagccagcaactcttctgtacagaatttacctggtggatcattgctttcgtgaagtccagtaaactcattgtttctcctcaaaggatgttcctttggaaggaaacggaagtgcccaaaataaccaattttgctccttaaggcatatgaaagaggatgcttgtcacaatggagacaagcaaaatagccccttgttgtacgccctgagagagtactcaaagctgggtaatcatggatgcaccacaaaaccgctgcacgaagtttaaatgatttgccagtaatagcatcataagtatcaacacctgcccaaagctcaagtaaatcctctacaagaggctgtaaaaatacatcaaagtccttcccaggtgatttcggacctggaataagcaaagccatcataaagtttgattcctccatgcactcccacggtgctaggttgtagggcacaacaaacacaggccacatgctatattttgtgttcttttctgaaaaaggattgaacccatcagtagctaggccaagtctaaggtttcttgcatcctttgcaaaaccaggatattcacggtcaaaatcttgccatgcctcgccatcagctgggtggctcatattattctcaacgggctgtcgctttaacttgtgccactgtgccgcttctgatgcttctttggtcgaaaacatcctctttagcctaggtgccaatggaaaatgccgcaacactttttgtggaatcttctttctttctgcatctttccatctcgagagaccacaaaccgagcaattgtcatgcttctcatattcctttctgaacagcacacaattattgtagcacacatgtattgattcataaccaagacccatttcctttagaatgccttttgcttcatcatatgattttgggagtgtattgcattctgggaaagcatcagccaatagcttcatgtgtgcagaaaaagcagaattgctgatcctatataatgacttcatatgaagaagccttaccacaaatgagaaccttgaaaatttggtacaaccaggataaagttgacgctttgcctctctcatgacaatattcaaaaatgactctttatcacgaggttcttcagcaccaacttgattttctacatccggtcttgcttgtgccgctgcagtctgtaggtctcctaaaattccttccaaacgatcaccatagttgtcatcctctgtcaccatagttgtggaaccatcattattttcattcatatcaataggatcgtcaataacattgacatctaagctctctccatgatgaatccaccgagtataagtagtttccataccattcatcagtatgtgcttcttcacaacagcctgtctttggtacttctgattaaggcatctgctacatgggcatagaatttcaacattctcattgaatttcccctgaatgaaactcataaattctttgacgccgtcaatgtattcaggggaaaatagtctgctgtgcacccaacttctatccatctaatcaaacattgtagataaaccacaatgagcaagctgcaccaattcaaatgctacatccaactaaatcgaagaagaagaagaagaagaagaagaagaagaagaagaagaagaagaagaagaagaagaagaagaagaagaagaagatattaccttggctggctgttgaggcagatgggagaagaggcttcaggagtccggtcaacagctgaatttgtcaccaggtggacgcatggccgcactcggcatcgctcgttggtgcggcaatggagggcggcggtgctgcagatctacaggatggcgttgtagggcggcggtggtgcctgatgtcgctgttcggctggtgtgcagcggtgatgcgcgatggcacggtaggcaaggaggcggcgttgctgaacgacgcggcagtggtgggcagcggcaacgccgctcctgccaaatttcgccgtcggcggcggcggtgtcttagattggttgcggctgggtgtcgaactgaataactgagtcacggttgaggaaaccttactcctccatacatacacaggtcaaaaagagtacagaatcctacaataacacatcaaaccaactagcgcagtggtaggatggggcgccttctactagtaggtcatgggttcgattctcgttggttgcatttttttcttctattttacaaattcgagttctttttttcttttcgaaatgccaactccggctgctgggccccattttcgaaatgccaactccagctgctgggccacactgtgggcaacatcctggaccaactcaactcgagtgaatggcattaatgggccacgccaacagggatgctgggccaataataaataaataaaaatatataagtgcagaagtggacatctacaacaagtggttcaattggtaacatatttcctaccttcctgctcaatgtgggttcaaatcccacatgctgcggatttttcccccatgcgcaccatatttttttagtttgccatattatgcatcatatacatgtaacaaattaacaaaattattttgttcaaatttaacaaatcatcatatacatgtaacaaattaacaaaaatattttgattttttccgcatgcgcacaatatttttttagtttgccatattatgcatcatacacatgtaacaaattaataaaattattttgttcaaatttaacaaaccattatatacacgtaacaaatcaacaaaaatattatgttcaaatttaacaaatattttgattcttcttgcaatcatattttttgtttttctttgcgctacaatttttttatttttctaggctaactagagtatgacgaatttaaaatcatacattgttttttatttttctaggctaactagagtatgacgaatttaaaatcatacattgtgacggtcctgataaaaccgtcacgagtttgtgggctgtgaatatccactgggctcatctgtgacgaaaaacaaaatatcgtcacggagtatgtctgtcagtgacgatccgtaaatccgtcacggagaatccatcacggattaacaagtttcttgtagtgatgatagtaatttttttacctaccaatataatgaacatccatgatagtaattttatgggaacag

SEQ ID NO: 29062 - DNA, 62154 bp, Oryza sativa
gttccccattcactctccaatctctatcctttttttccggatctgggagtagccggcagcatcatcggccaccggggcgacaacctctccctacaccggcgacgtggtttgctccgagggagtgagcctaggcggcagctcgtggacatagatggtgcaccgctggatctgactcctctccggtgttgcaacagaatcaggggcatagaggaagcctgtcctggtcgtctgcgtcaccttccgccgacacagtcctgcgcggtcgtcggcgagcacatccgcgcgttgccctgattctgttgtgtattttttgcacgccatttgtggtcgtcgtccaccttcagtgaatagtgatggatactacagctgcgtgccttctttttaagctataaaatgaatcttcgtcctttttatagatgtgtattttttccctcacattatagatgtgtaattttttgcctcacataatgacgcggcacggtacggctgcgggcacggtggtgacgggcgactatgggcgggagacgcagcggctccgcctccaccgccgagcgacggcgtgcgcagcgtcagccgatctggccgttgattgttcgaccgttgattgttcgaccatttatcttatacaaaattttagtataaatatgtaaaagtaaaagtgtaagtttatactataatttctttatgataaaagaagtcataacaaaataaatgatatttatataatatttttaataaggaaaataatcgaatgtcatctaaaagtcaacgatgtcatgcatagggagtactaattagttttctttggttttctcgggagaggtcgtgaaatgacgatggcttgtcattattacaaaatccatttttcctaatggccataacacattttcaccagcggactctctatccgcatgtgatcagggtcaatgaaaatagataatcatcgtaggtgggccttatcggcttgcgaaaaacagttttcaatggcggctacattatacggaccgccagcaaagagatttttggctaaaaaaaatcgaccggcaaaaatattaaattttatttttagaacctccaaaaccagattcacaatctacatcagtttgtcattaatcccgcaatcacaaatccaaatcaaacatcacatcccacaatcgcagattctatgaatttgcatctaatcccacaataacaaatccacaaatcaaacatcgcatcctccaatcccacaatcacaaattcaagaaatcacaaaccacaacatgcatgcaacacactaaagattcacaaatcgaccaccacagcgcacttggacactagtgtagagcatctcctgccggcgcggaggaaggaggtcgaggtccacgtcgccgaatctttgtacttgttgttgccaacacaccgtaggacccacgcctgcaagcctcgtcgtcgccacccgctcataaccttagccacggccaagctccgtcgccgcctgagcttcatcacccatcgacaggcgcgcccgagctccgtcggcccacctgtgggcctccccaccaccaaattcaccacccgaatacctccctgtcgtcggatccgcctccagccaccggatccgcagcccacgcacctcccgccactggaaccaccgctcgcggtcctccccgcgcgcctcctttgtggatatatatttccgttaagctaggttggctgtgtaccctttgcagatatcgatgccggtttaataaaatatctattattaaaaaacggtgagctagcgagaaaaacacacttgacaaattatgatgacatagtcaaatatagaggaattataaaacgtcacttgctcattaattactttgaagaatattaactttggctttgcttgtttcaatgttctgccctgacttactgaagaaacatcagacatctttcggctagcttcataaaatgatacactagacgatctgagtttaaaatctaattatttgatatttaattattctctaatattcgcgtattcggagagagattgcgtctgtcgatcttattccctacacctactagatacgattgaacaggtcacaagggctggggcgtgagacataagattatattagttattatttacatagatatcccattgtatgtcaacaagatgactgagagtttgagagagatgttcattatggagatcatcaagtcaaaatcattaattttgagatgtgtacactttcggcctttcgggaaggctatgaccacatatatagtaggaccaatatatattttttaaaaagaatatattattgtactttggcagtctagatatgtatatacggagagctgagctactagatatctacacctactagggaaaaaaaatattattgtactttgacagtctagatatgctaatatagtcttgacaacatttagaaattacattatatttttataaaatttgcatggggattaagaagctaagcctaggactcagattctagttgtcctaagcctagctacgttctactccctccgtcccataaaaaacctactagtacctgtgacatatccatatactacgaatttagacatacatctattcaaattcattgtattagaatattcaaattcatcgtattagaatatgtcacatccggttctatatttgtttttttatgggatggagggagtagtgtttatacttttttttttctttacagtgatcattacgagtgttgtggaaagacaaacacttatctctaagtatataaaggcaataaaaatcatatcttggagtctatttataacttacaagcatctgaagcaaactctagtgttttgtttatgttgggttttacataatcatctctttgataggaacatttacatggtatacttgtcatttcgtaacctgtctagcctagacaacttttgtgggtcagcgttctcatagaaacgttctttagagttgaccttcttcggcctagttggcctacaggatcgagcttatggtggtgtttaaatgtcctgaagatatagatgaagataaaaattaagtgtttcacgtaaaacgaggttgtaataacgtgtgactaattgagttttaattattaattacaaacttgaaaaatatattaatatgatattttagaacaacttttatatagaaaattttcgcacgaaacgtaccgtttagcagtttgaaaaacgtgctacgagtatccaaatttaatccaacttttgttggagaaaatgtttgtgtcctatctatccaaaatgtgagaagcagctaaaccttttcataacacaaggatcgatcgacgaattgatagcccgctccccacctcataagcaatctcacgaatgtccataacgtacgcctcctcacggatggatcgctcaatctggactagctagctactcctagtttttccccctttttatctaaggccacctcatatcttatcttacgtttattttggtctggaaaatagaaatgtgcgtacttgggtttccatgaacttcgcttaaatagtgacatatatatatccagaaattatatgtgtacatattgtgaggatgaattaactaaacttgccacatttgtggccgacggccctggcaaatataattgagtttgcttttgtagctgagcacctccatttgtggttaaatcgatcaaatcgaacgattgactttcacttaatttgcaactcgattaatttccggtgaatcgaacgagcacgtacgtatggtagatgccaagcgtacttgcatatatgaagtacttgcatgcagttattagcctgctagtatattacagtacatatttctttaccttgaatcggtcgatcgacggcgtcaagaagctcaaaattaagcaccggttcgtcatctactaagagtacgtatacagtactagatcacatgtatgtgcctcatcctgcctatataaacacgtctagttacgttatcgatcgattctcatcacacactcgaaatagttcaaattaaactagcaatttcgattacatatatcttcacttcgtgaggagagaaattaaaagaatacatggcgtcgtcctcctcgtcgtcgtcgtccaaggctttgcttgttttcgctctcctgctcgctgctgctttcgtcgcctctgccgaacaaactcgtgagcacacaccgacacaccgtacctcattaattcgtgcatataatttagtttgattttcatactggagttgaaatattttcttaatcaattcgatcgtttttctcacacacacacacacatgcatgcataatttcatcttttttcaaaaaaaaatttaacgaaccggctcatcgatgaattatatattgtgctcgtcggtttgatgaacttgaacataggcacgtactctctccgtttcacgatgtaagtcattctaacatttctcatattcatagtgatgttaatgaatctagacatatacatctatctagattcattaataccaatatgaatatagaaaataatagaatgacttacattgtgaaacggaggaagtacatatttgtttttgcatttaatatgtaggtaacgcgtgctcccaattaatgctgcagatgacgacggtgacaatccgccggagtcgccggaccacgaagacccaccgccctcccctgaatactacgacccaccgccatcgccggactactatgacccgccgcactcaccggactactacgacccgccgccatcaccggactactacgacccgccaccgtcgccgtactacggcggaggcggtggatatggcaaaccaccgccgccgccgccatgctgcccatgcaagggtgtctaggactgatgcgactggtccggcgagtgctgctcgccgtaggccgatggagcgagctccgtacaactcatatgaagcagatcacacatggtggttcataaataaacacttctccttaattaaatattattcaaaattactagaaaaatgtatacagttcaaataaaatagttgatgtcatgatctgatacctatggtgtcatgctgacatcatcatgatatgagtattacgtccggtatcacggtatcatattcgatatacctatctagtatcatagataccacatctgatacctaaggaaatagcattataagtattacatattcttttttatcgaaacgatatagcattatgtagtagccctcaattattatttgcatgtacttttatatacacctgagtattagtcttagtaacatacatcactataccatattaatctactcgactactccctttattcaaaaatataagcatgcatatttagcgctccagctacatacccagaaatactttctcaacttctcaaattgtaagtttgcaaggtgccacagataattgttgttttgggctgaagaaatgggccatgctcccaataaatcctcaacagtccaaatcaaatccatatgtacaagcccatcactaaggaggaggccgttgatacgcaaccagctccacctctattacgtatacgtatatgcatatgcatacaaagtatataaatttgtgtatatatataatgtatatataaatttatatgcgtatatataaaatatttgtgtatatacttggtacatatacacttatacaattttttatatgtataaatttatattacacactataaagaattatatatatatatatgtatatatatgtatatatatatatatgtatatatgtatatatgtatatatgtataaaaactatgtatacatgtatataagtttacatgttaatgtataaattttgtattgtatatataaattttacacgtataaaattaaaaacaaacttaaaaagtaaaaaagttgaagaaaataaataggccaaaattactgagcccatggaaaaatcaagccaaaaaggaaaaagaagtatgcataaaaccaatctagatttagcctatatagtaaaaaaattattaaaccgacatttacataaaaaagaaagtagataagccgacaaaacatacgtatgccaaaaaatgaaaaggcggggttcttcgtgcgagtaggccggtgcgtgactagtcacgaattagcactttcgcatctaatgaggcctttttcagttgggtctcacgtgatggataggccagcccattgggccttaggcccgccacctaaaaaggtgaaaaggtttggtctcatcttttcgcttatgcttatccttatcaaccaaaattcaaattttcaacattaaatttggagttaattttgagggttttttatcgaagtttatttttcagcatttgcttttagatcactaataacacgtatataaaaatttttttgcaaattatttttcattcgtaaatgtgacatttgacttatccccattaagccatccgatggcctcctcggttgcaggaccccgtcctggacgaccgatcgacgacccaatcatcgtagctcgcggcgagccgaccgacgaccagcgccggcgtgctcgcattttccgagctcacctaacggatcggcgaatgaaattaatcctacgcgcgcccaaataaaatcgcccttctcctatggcgtcacacactcacacttgtactggtggtgtttggtttgaaaagctaaaatattctaaacagacatgtgggcttggggtttccacgaattttgctttcatatgacatatatatttgatgcaaatgggcatgcctatggcgtgattagttgttgacattggtggccgggccatcgtaaagttgaccttttatgaataatgtactcctcccactcatttctcgtgtggttctgattttccgcacccaacatttaaccatccgtcttatttaaaaattttattaaaaaaaattaaaaataagttgagcataaagtactatttatattttatcatctaataacaattaaaatactaattataaaaaagtttaataagacaagcgatcaaatgttagacataaaaatttataactgcaattaattaaaatggaacaatggaacggagggagtaatcggcaaccggggattaatgcggtaatcagaatggcaaaacggttagggcacccacaatggttatctataggctctctacaagagatccatgtcagcatattttcctacttgaaaggtattaaatgaagagagagagagagcaaagctatctactaacttaaagatagtctatagagaaaaacgaggcaatgaatgagagagatatagataccaatatagacatactattaaggtggtttactattaatcgagtctattgctgaaatatacatgttttatagagagcaccttactttactattgtggatgctcttatagctggtcgctagtcagcttaattatatatgttctgctatacgtataaccttgaatcggtcgacatgagaagacgcagtgtgtcatcaactagtaactaacgcactactaccagaaccctaaatctcataagaaggcttcatcctgcctataaatacgcttggtttgcacgcataggcttctcaccacactcgagattgtgcgatccagtcctaattaattataccgtgagttgaaaattaattaagatcacttaaggtcttaaagctagcagccatggcggcatcgtccaagttggctttactggtgttcactctcctgctcgccgccgctgctttcatccacgtcgcctccgccgaagaaacacgtacgtgagctagctagctagctagcacacaccctgcatgcatatatatacatacaatttttcgttaaattttctcctgcacatacacatatatactgcttcctccgtttcacaatataaattattctagtatttctcacatttatataaattattctagtatttgttacatttatattgatattaatgaatctagacatatatatctatttagattcattaacaataatattaatatggatattaaaaatactagaatgacttacattatgaaacggagggactacgatacgatatactactacatgtattgtgttcatgcatgccttcttcatagtattcatttagtattaattagtatttgatatgtcgtctatatgcatgcagatgacgatcacgacggcggcgatcacgacccgtcgccatcgccgccggaccacgaggacccgtcgccgtcgccgccggaccacgaggacgaaccgccgccgccgtcgtctccggggaaggaggacgtctgcaaaggcaaggggtgctgcgactggtccggcggcgactgcaagcactactgcgacggatacgacgacaaatcctgctgcgacgactggtccggcgactgccacaagtgctgctccaagtagcccggcccgccgtatatacgtcgatatcgccgtacgccgtactatgtgtgtatacgactgtatacgcaacacaagctcgatcgtagtattgcttattgcactcttcgtcgtcatcaataaattaaggcacgcgtgtcagcgtgtgtacgcggtgccgacgtgcgtttgtacgtacgtgtacggcttgctaggccatgagtgtgagctctttccaaaggctacatgtactatgcgccagtcgatggcttataatattgtaataacataagttgtgcgtgagtgtaacatgatataatataataataataatatgatgtgcgtgtatgtttgaacgtgaataatatagatctgccgttcaaaataaagctataggtgtagttgtaaaatgacttttcgtttataggttttcattagagagaatttatcatgagatacttaagaagtaattttcatggtgaaggtctgaaaagaaaataaaaacaccgttgttagtttgttaccttcagtccgaacacctttcgccgaggagaagaagaagaagaagaaatggaaagtgttaaaaggcaacccaaggtgtatttctctggaaactgggccatgatcttcatatggttctatattgggccgttctcgcaagaagtgatcattaatgggccaaatcacctcttgaaagaaataatgggccaaatgatcaaatccatgggcactagcccagtaatgatttattcttctttgtgaagtttctgaaatagaaatttcgttcttttcctcccttctgaaccattatacttatttcctaaggaacatccgaaaggcaaagcatgtgttaaaagtgaaatcttacatcatattgggttctgtttattctcttcaaggaagagaaagtcccaccgaacacgtgttaaagtagcagaatcacaaaagacggttgattattcctgggaaattttgttttattcgggagacatttcctggttcaattctcttctcattttctttacggagaaagtgagagctttcttactcaattaaagatgctttcgttcaccaagaattaaagattcaattaatggccggtggaatatcacccaaattaactatttaaccaaaccgctaatccagctgaggaattttttttttagaatgggaaatcgcaaaaatatagatcggttaggcaaaatcgtaagtttagcaccctgtcaaacaaccgtggtttgacggggacctatcaaactgcaacagttcaatagggtagttggtcaaaataaaaaataaaaaaagtacataaacagtgacgctacagtgattggtaggggcatgtcgaactacccatgttcgatatgtttgatgaacagtgccactacagtgataattctcttttttaaaatttttttatcacctcgacaagtaccatgtcgaagatagataccctgtcgaacaaccgacctatatttttgtgattttcgtctaaccgacctatatttttgtgattttacttaaaatcgtattatttcttaaaataaattctgcagctgagtgctacactgttttgctctctccgcatctttgataaagtcgatgtagcccaattctgtgaagatataaacaacattcacaaaaatagtacgatcaattgttacgaacttacaaactgaatcgcaaaaccaagaacggtgttcagccaacagaaaattaactcggggttttgcaggcggcagcttgcgctgcatcacggaaacatccgattgtgcatcacgcacgggttaattaacaaaactcaacttgtttctaagtagggaaaaacaaactagagaacgaaagaaattaatgtttgtttttgaaaaaaaaaaaagagaacgaaatggaagagattgaagatacatgcatgcatgaatcgttgatagtctgatgaagttggattgaccaaaaaataataattgtcaactcctaactccaacctccactggatgattttttttttttgagccgataatcatttgagttatcatttttctcacctgcactcgagcttatcactttcagctcaccaaaaacccgaaccttgtaacccatttttgtacaccccgatcggaccgtccgatacaccgactgtcctgcatccaacggccgagatcgatcgctctgcaccaatcaaatggagtacaagcgacacgtacccacgtaacatccattaaattacttggagtcttcctcgcagtcaaccgtccataaaaaattttcggctcccgccgtgttcgttgataattggttcggatccccgctgcttcgtcgcaaattaaaagaatctcttgaaaaagatgtgccacccaacgccgcaaccgcaaggtgaattggaattgccctgaaaccggtagtagcatctgtgtgcacgcataatctcagtataaaagcccgcgacatcacgctatatctgctaatctgctctgctctgacacaaaccaattcgatcaattctgctctctcttcagatcgaacgctagcttgctcgatctgttgcaaaattgtacggcgccatgagggtaaatttgctctctcttcagaattcagattgattgattggtcttagtgacgatatatgaagatgaattgaattttcttttcttttttttctaatggatatatgttgctgtgttcttcttgcagacggagatgcttatcaggatgcaggcgagctcggagaagaatgggaacgccaaggccatgaaggtggcggcggcgatggacggcgtcgagtccgtgacgctggccggggaaggtcggaacctgctgcgggtggtcggctccggcgtcgactccaaccacctcaccagccgcctccgccggaaggtcggccacgccgacatcgtcgagctccgcaccctgcacgacacctacccacgtggcgccgccgccggcagctacgccgccacctcaacgagcggccgcctcggcagcagcaacggcggttactactactcctcccagctctccgccgggcgcggcggcgcctacagctccggcggccaccagctgtacggcggcggctacgactcgccgtactaccaccaggcgccgcagcatccgtacgacggcggctactacccgtcgccgtacggcgccgccgcggtgcagcacgagtactacacgacgagcagcaacgacgatcccaacggctgctccatcatgtagcaacgactatagtttaagcttagctattgtgtatagctgtttctattttttttttctatgatttcttcttctcatttcatttcggtgaggtttgagcagtgtttactactactatttgctggtgaggctgctaaataactggggaaatttgtgcttcagttgatttgtttgttcatctctgcatgtaaacagatttgtgtgaagccgtgatcggtcgagatagaggggctatggtttttgtcagccccttcgatcgttccatttgattgtaattaattgttaatttgcagctgtgttgttttcagatctgccaagataaatcagtgtgaaatgcagaaatgatgaatgaattttcagagatgcacatcgaccgacattgattggctgaatcttttttcctttcgggaagtaggaatcgatcctttacactgcagaacacactagtacaccatatttgtgtgaattgttttcacataacgtaacgtggaagctagtcagtagtcacctagatatacaaattaagcaacagaacaagtcgtgttatcggtaaattatcatctcttgtattgcacatttgtcttctggggctaatgacaattgtcaagagttcgggtgattcatagtcacaccaaacgtagataattggatgatttgatgtgttagacacagagacaacgacagagggtggatgggagatcagtcttagccatcgctgtattgagttgcctttctgccaggctccacaatattgggagaaggcagagcacagataaaaggtcttgcgcaatccaagtgagaaaattgacatttgtcaacaaaatggaagaaaaatatggcttatgtatttaattaaacctctgcagtattacacagagcatctttaataagtattgaacggaaaaatatatagtgtccagtataaacttcatgtacagtacaaacatgaaaactatatatcatcagatacatgaatgtacacacctaagatggagagtaaaaaatttactcaaaataatatggacaaatcacatatatctatttgtgcatcctatgatagctttttagtttacactacacagtttcccgtgttggatagagtatctatcattaaatatgttgtttagaaatagagcggattttttttactttggaccacactttattatcaaaaattttgttttcgatcctcatttgatctatcttctcactttgtaccaaataattttatatttgttatactttagtccaccttaactctcttttcaagccatatctatcaaatccttaggcaaaaatatggctggggcatggatgagggagtttattgaggtgtgagtgatccaaattaaaactttgttaataaaatatggtacaaagtataattaactcttagaaatatactaagtcgtatgttaacagtttaattttgagcttgaccaactattaattaaataatatttaggtttttcaaaaaaaatattattgtattcatgttcaaaaatactagaccatgagtatggttctataactttgagcaaaattgtgtaagagatatttacaatcaaatttcattgttaggcagttaatatagtacgtgatgtgatatatttcagtactataaatcgatgtgacatatgctaatatcatgaatctgaacatttatttattcagattcgtgatactgagatatatcctactccctcatcccattttaagtacaaccataagtttccgtgtctaatgttcgatggagtatagctagcttttggtcgggaaagcattccaaggatcgaaacggtaatttcccgtctgtacaacgatgcgtcgtcgatgactcgatggcaaccccacccggccagattaagcaacgtcgcgagcacggttaagttaaccaacatacttgcgcaagttgcacatggacatacccgtgcagttaattagtttggtcgcacgcgcgcgatccttttctccgccccctagctgctaattaacatgttgcgtcatcggagacgggatcggaggacgtgttttccgtgacgcgcgcgccactgcgcctcgccgaccgcccccgatcgacgacgtataaaaacgagtacgacgacttggacatgagtccgcgggttttaattttcgcccgtcgccaccggtgtacatgtggatcagctaccgcgcgcgcgcccacgtatatatcacgatcggccaccgagtttagcacgtacgtacgtttcgcgatctcagcggcagttttcctagctagcccatgtggcatacgatgcgtacccaaagtagctagtgtcgcgcgcgcgcgcgactcgcgcctacgatcctgtacgtggtcgaatccctgtccaagcaatctagtcctagcagcagcagcagcagctacgacacgtatacgtacgatcgagaaggtacagtacgcacgttgcgttgcgcgtggcacgaattgccaggaacttgagctcggtgcttcagtttctcgccatatatgattgattttatcatatctttctcgctgatccgtcgacgacgtttaatttggccggtttcatgcaatagttcttggccacagctggttaatgagccgatcgatccctactctggtagtattagttgtttggtacatcgcgatttgctcctggaagcagtgggcggtggcgccgatagagagcgagcgagctagcttagagcatctccaatagcctcttcaaattaacctctccaaaaactcatatagccaactctctatctaatttggctagttaaattagatgatcactccaacagactctctactgatcctctccaaaataacaaaggacccacatgtcagtctctactcctcttcttcccccccccctctctctctctcttccttccttctttttctttttctctttccttccttctcatcgtcgcacggagggcgcggcgccggcaaaggacgacgatggcagagggacggcgtcggcaaagcagagggcagcgccgtggaggggcggcgctgtggaggggcggcgcggagggacagtggcgcggaggggcgacggcggcgtaggggcggcgcgtggaagggtggcgcggaggggcgccgccagcggaggggcggtggggcggagccggcggacgggcagcggcgcgaagcggcgaaggcgcggcgccgacgctcatctgacgagagagagaagggggaaaagagatgggacccacaatttggctaggttattttggctggccaaatttggccagcgggaggagtagtttggctagccggatggcttagccatccggttagctagtctgttggagcatgatttgctttaaaattgctaaaatttaacttggagagttgaataaggaggctgttggagatgctcttaggccggaccatgtacgtacatgtgtatgtactgttcagtactctctctatctttttttatagacatattttcaaatctgaaaaatttacttttgataagcatatttcaatccaaccacctattatcttaatgactttctcggatttaatgcatgactctctattcttctacacaagattagttatatggacatcgagaaatgtaaatattaatgaatcacttatttatgagaaataactagtagcatatttaaataaatgataagtaaaattacttattcttagtcattgtgccaagatgaaatataactatcaccgatctctacaagtgtagcgagggataacaatcgacgatagatgatgtgacgccgacgaaccatgcaaattaaatgatcatgcatgtagatatatatccatcggctttaattcgatacatgtatttgctgaaactatatgtgtcggtatcaaattatctaatctcctttttgtcagttcgtttaatttgccataccccagaccgatctcgatcgggtatgtcctccgtgcgtgcaacactcggaattgctccacaactaacttgcgacagtaagctaggctatatattggcacgtcgggcacgtgaaatattttgttttgatacacagagcgcaagcaagataaccatgccatcaattttcttagacagatcagatcgatctcgggtagatgatcttcttcttcttttttttgtttattgcaactgcttgactataggtctactacaaatgctttttaactccgccgtgcatgcagaagctagctagtggaaacgtgcgcggaaaagaaccacatttagtcaatccactttctagtgtgtgtgtatatgttcatccattttaaacttatactaccttcattttttttaataaataaagctgttggcttttaaaatagcgtttgatcgcttgtcttatttaaaaatttcgtgtaaatatactaaaatataagtcatatttaaaagtgtgtttaataatagaacaagtcataataaatatataatttttatataatttttaaataggacagatggtcaaatgttatgctaaaaataatcaatgatatcgtctactgaaaacagcttttgaaccgtgggtgttaaagattttgagttgcatttggatgcaacaactgttaaagttacttgtctactactcccttcatctcgaaaaagattaacttaggtgggaaggacaacgaatctgaatccagatttattgttttagatggtgttaaatcttcatttaggtttttttttaaaaaaaacgaatagggtatatttttatggtacatggaaaagttatcgaccaacatgaattattttttactaaaataattacacgtgaccaaaacaatactactacgacgacgacgaaattcaagtaaaggcacgtggtggtggacgtctgctcccgtcagcaaggagatcctggcatgtttggctgatatatctcgtatgatatttgtgagtggatgggccttttgtttatgcataaacaaaatccatatggattgttttgggggcccaacagtgagacatgccctgtataataatcctccccttcgagataactacacacaaagccgagccaaagtctctaggtcaaagtcaacagttaaatatgcatttctctcaaggtctatctaatcagtgtgtttctttcgcttggctaccaagtactagtaccaaataaacaagatattatggtattgtcaaataaacaagatattatggtattgtcacacatggcaggtacaaaccactgagctaaccacagtagctcacaggccattatcctgtcagtacttaagagagtgaagcacgcaacacacggttgctaatctccttagccctctcctccattggagctatagctagcaaactttttttttttactgagcaaattcagttagcgaagcgaaaaccatgaaggtaattaacatggttccttttctctcatgattcccgtgtttctgcaagtttgagttcgaatttggtgtgttttaatttctacgagttgcaccacgaattggtgcgtgttttatggaggtttatttgcagagtttaattggtgtttcctctgaaagtttcttctacgtacatattttgctttggtctgcttgaaactttttgtccgagacacaggcgagattttagttaatccatgtctgaagaacttatctgtgaaatccatgcgttgaaaatttcagaaggagatcattatcaggatttccgtgaaaaccgacaaatgccagaagaaggccatgaaagaggctgctactgtcagcggtaatcatctttgttttgatcttgttttgaatgcgaaatcgtggttgtgttcttgttgatttcatggttgatttgattccggtcgagctgcaggggtgcagtcggtgacgctggccggcggcgaccggaacctgctgctggtgatcggcgagggcgtggacacgaacaagctgaccaagaagctcaagaggaaggtgggctccggtgagatcgtcgagctgaggaccgtcgacacgttcgaggcggcggcggcgatgttcccgggcgggatgatcatgccgccgccggcgccggggagcaaggacgccgccgccgccagggcgatggcgacgacgcgggcgtcgccgtaccactaccagccgtcgccgtacggcccgtaccaccagcagcagcagtggcagccgccgtacgccatggcgcccagcccgtacgcgtacccgtaccagtaccacccgtcgccgatggcgatggccgccggcggcggcggctacggctacggcggcagcagctactcccgcgcggtggcgctcagccacccggccatctactcgccgctggtggagaagcacgactaccaccccatgaaccactccaccaccaccaagaagaagaccaccaccaccaccaccaccaccggcgccggcaccggccgcgccgccgccgcagccgccggcggcaagaccttcaaggcggtgtcccgctcccgccgccaccacgagagcgacagcaacgcctgctgcattctctagcaccaaattaatctcgatccataaaattacctatatatgtgcatgcatgtacatatgtgtgattttgcttgttgctttcttgccttgttcttttccatttttgaaggtcgttaaccttttgctgctttcttttgcggttaattaatttggcagcttttgctgcacaacctagtgaattaaccatgtataataataaaactgtatatcgtaaaaactgtacctgtaaaactctgttactgcttggatttcttcagagattatctgaagttcttgcaagaacaacacctctcctattacagaagagtggtagctttgtcttgtactattaaagattgtgatgcaaaactactcccagatttacaattcatctcggttagagactacagaagagtagtaaacgatcaaaggaacagggaactgcaaaagacagtaaattgaataactgataaagatcaaggaatagagaactgtagaagtagaagctaacttgctagatacgcacaccgttaattgtttggattagttgatggaaaccaaattgcagcttcagaagattaaacaaaaaaaaaattcctgtagcaagtcaccatcagtacagagagtcagagaagatagatattgaagcatcccgagaatccaatcagcactcactcgacatcgattaaacatagcaaccgatcgtcatcgtcgcgcccccgtttctgaactattttaattccttgagctgatgccagacgcaaaagggatagttaaccggcattgcttcttggctggacttcaaattctttcagcactttcactttttagtttgagttgagtcccgatcagctttctaggctccgtttctgatttccaaatggagatttgtcaaatgttaattgtcagtagtaaggtagcacaaaacaaaaaccaccctagttaaactattgggtgattgtaagcttcatctcaaatttagcagattatttacacgcactacgcaaatttataaattgaaatgaaaattttacaagtttatttactaaattattctccctctgtttcagattataagacgttttgactttggtcaaagtcaaactgatttaagtttgtccatgtttatagaaaaaagtaataatatttttaatccaagataaatttattataaaaatatattcaattgtagatttgatgaaactaatttagtattataaatattactatatttgtctataaacttagtcaaacttaaaaccgtttgactttgattaaagtcaaaattttttataacctgaaacagatggagtacatatctgttgaataatctcacgttggttgtggaaaggcaagtggcctaatatataagtgggggaccccctcacctcattggctagcttttggggtggaaaatacccttcacgatcatacaatttgtatcagagcctggttagttcaacatctggtgaaggggtggtaaagggctgaggtacgtgtgaaggcctgatggaccgtggatctcacgttacctcattggtcagcttttggggtgggaaaggggcagtaaagggttgaggtacaccaatgtgtgaaagtagacctaatatataagggcatccacaatgtaagccattcctagagtgtcctcactaactgaggacactcgtaggggaactcagctcgcaatggagaacacccctggatgggctcctcaaaatcccaacctataaagccacaagtgttgttttcctcttctacccctctcttcaaactaaggaatttgaagacatgaagcattcaaaatacacgaatatattcaacacatgaattttccatcagcaacgggtagcctcaggggcgtgtccctagctccttccgtccatctccatttgcttttttcgttcgcaccgtcccccagcgacgccacgcgactcctgcctgggcgacgcggctcctcctccttttcggccaggggacgggctcgaggcacgcgttgcggcgacgggtgctccacctccatattccccttccacccctctcccccctctctcctgttcccctcgagctcaagccggagggagctcatgggcggcgctatgtggcggagtcgacggcggcgtggtggggcaaagtcgcaaaccacgcagctcgagcttgtgctgaccatggtggcagctcgctcctaccgtgcgcccgcttcaattgctccgcctcgcttgcttcgcccggtacccagctcggccgcgcacgcgagctcgtcggccgactgtcgccttgcttgcttcggccggtacctagctcggccacgcacgcgagctcgctacgccatccaccaagctcaccatcggtttgctgctctcgatgcctctagaagattgggggaaaagatgagatagagtagtacagatgatgcggtgaatggctatgaacgaagaggataagatagagtagtacagatgatgcggtgaagtagtactagtacttgagagtgagatagaaaatagtatcctattgcttaattagattataatatataggttatccttgattggtccctcacctcgttgaatagcttttgggtgggaaaggctctttacgtttcttcgatttacttttatcataaaccaagccgcattccggtgtactggctaatggacttttctcaacttatacactaccattttggtttataaaacgagataacttttaaatccttatttaggctcagcgatcagtggccaagggacaactgccgttccgtgaatgaagtcaagtcaaggattgttgtatgtttgctccaagagtcaattaaacgcttaggttattaggacggtttcacacgttcatttttcaacatggtgagatggaccaccgggaaattgggtttattttgttgacaaataggatagctagctgtaccgatcatgcatgctcatgtcacgaaatgacaacagtagattagggggagacgacatactcgaatctccttgatatattccctctagaacaaacttggacaaccaacatgattgttggaatacttgcaactgttgaacttgttcgtaagtattttcaatgaagaattattcaagtaaaaaaaacagaacagtagtttgtcctttctctagaaaatatgagagttttcatttttaaataagaaaggtataaatccctggtatctgcatccgacgtcaacttaaggatgcacattaccactacattagctaaatgttaattgagacctaaaacgactaagaagaaagaacaacatgataaaaacttatcaatgctaagactggtctgaaatggaaaaaaaaaatctgaacctgtcattgaaaccataggccgaccaaccacaaaattgcaatagtttttttagcgaggagatatttcaagcttcattcctacaataacgctttcaaagaaagggtacaacttgtacaatcgtcatcaaaatccaatcagtacaaaattttcaccttagtgtatatgtaccattctcctgtacacatcttcaagactaggacatccaatatatccaatgtttttggacatccaatccaatgtttgatgctttcactgtctccaaccagtgaatgccaaaaccagtttttccacctcaagaagagcatcaaaagactatgcctgggtatgggcttcttttacaattacacgacatacacacacgcagacacatcactgcacacgtaagatgatactcagtagtacatccataatctcactacaatctcgttagaaacctatctgcataaacgtaatatttgtgggtaccagaatttaaactccgacgaatgaagtcattcgcccatgactccacgcccccgactattcgctaaattcaaccaatagtaacttatcctcactaattaggaagccaatataaaccctatgtttcaatctattatattattaaaggaatagaaaaatgagcctccacgttcgctctcatggcctagaaattgtcacattaatcggagaaaaagaaaaagcagagtccatatagaaatacaatttagaaatagctgaaattcggaattgaaaaataaggaatattagaagaggagactagagtccatatagaaatacaatttagaaatagttgaaattcggaattaaaaaataaggaatattagaagaggagactagactccatatagaaatacaattaggaaataactgaaattcggaattaaaaataaggaatattagaagtagagtatagagtccatatataaatacaattaagaaaaatatagaaattcggaattaaaaaataatgaatattagaaatagagtatagagtccatataggaatttaaaactaagtaaaattcggaataaacataataaaattaaaagtagagttttagtccgtataaaaatacaatttacaaataactaaaattcgaaattaagaaaaacatgggaagaagagtttaaagtcaatataggaatataattagaagtaactgaaattcgaaattaaaaattaaagaatattgaaagatgagtttagagtccacatagaaatacaattagaaataataaaaattcagaaataaaaataaataatattggaagaagagcctagagtctatatagaaatacaatttacagaaaattcggaattaaaaaaatatattaaaagatgagtctagagtccatataggaatatatataatttacaaataactaaaatttgatattaaaaataattaataactaacacatatgtaaaatacaatatgaatattacacatttgtagtttcgtaaagttattgaaaaatttaaaattatgatgttattttaatatatttgaataatataatgagaaaacatatatgctattatatgagaaaaatataatgatgctagccgcgcaatctgcgcgggccaccatgctagttaggtgttaagagaagcaaattttgaggatggtcgtgattacattcaaagccaataatacaaccgtttgatcttaatgtttgatgagcatgatctcttcctctgttgttacattttcattttcaaattgaactatttgcatattgctgtgctcatcacagtaacacaacttattatatatactgccataagcgtatctttcatgggagtaacttttatactccaatcataaaaacctaagggcctctttgttttggaggaaaaatatagaaatttcctataggattttaggaaaatttcttatgaagccctttgaaacaaagaattgaatcctatccaatactttgaaattcctatggaatggacaatcctatagagattttggagaaaatttagcaagagcttcaacctcttgctaactttcctttgagtctatctctcatccaattcctgtatttttcatgtggtttaatcaaacggtcattcctgtgtttttcctgcgttttgcaatcctctattttacacttacatttctatcaaaatcctacgtttttcctattcatacgttttctcaatcctgcgattcaaagggccctaaattcatacgtttcataaccaattttgttcacggtgacgtgaacaaatccaagaaacttttatatgctgtaaaatataagatgaataaaaaacaatcaagaatctgaatttttttcagacacggataccaaatactactacgaattcaaatttgaagagactacaaataattggatggacttctaaacttctaacgaattccctcgttattaccgttctaccctctatctctggctcttcgcgtgctcaaccgctaattccctcccctctcctctctccctccgatcattcgcggcggcggcggcggcgaccggcgaccggcggccatgcgggtggcacccaaggtcctcgtcctcgtccgcgacgccgccggctacggcgccgccctcgccgacgcgctccgcccaacgccggggctcacgaggtcccccctctaaaaccctagcctctctctctctctctctctctctctctctctctctccacaaaaggaccaaaatccagcgccttacggtagctgacccgtcgtcgctggatgcttttgcagggaatccacgcccctggagctccccctcgccaagtacggcctcgacggggagaaggcctccggcgagctcgtgaacttctccgattctagtggcgatccgcaggtaagcgtccctttttggcttttggccccgtctgatagatccaattcgcgtggtgtgaaggttttggatcaacaattagctgcttgagctaaatggaaagcattttcttttgggggaatgaaccacacggttcctggaataagcaattgtagggggaaattagttatcgtgcacaaatgtactgtgttgagctggcagattagcctctgtttggctgcatactaggatattttcgtttggttttatgattattatagttagaagttttggagcaatgtcagtgaaccgaaagatatagggttgttttgtttgatgccgattcttgccctaccagttataaatggtagcttcaattggtactatgtggccatttggattggaaccaaaatttgccgatctataatgctaatctatgggttgttttgtttgatgccaattcttgccctacaacaactttggtaggcttcaaaccaaaacggcctatatgtcgcaattttactgaaatgcgtgaatactataacttactcttacgatatggtttagtcacttagtaaatcttgcgtcttggggtttgatgtggtatgcaccaatcaacttactggcgagtgtgttttggaggcacagaaaactttgttgccgaggaagagagaactgatggtttcagtatgaacatatgtgttgtatctgagtttttggaactgattatcatcaattcatcatgattcagtttgagcacttgatatatgaagcctgagttgtatttgtcagttgtcactcttttgattgctgcgagcctattacccttcattttgaactgacttatataagcatgcgttcatgtatactgggcttatttctgtcggtgaagatctttgtacttcctgtctagcaaacatagaatagacacttctgttttcatggttatggatgtagcgctctaaattatcttgttgcatttggtcagcgcaaaaattacatattttacagttgattaaatggtacctcatattatggtggaacaacctgaggcaatccagtgcaaaaggctacttttttgtgatttactggttgtcataattttttcagatgggcaggtttaccttgtgccctagatctattgatttcatgttgctttgccctgttaggaaaggttaattttcatgtcttatggttaactgctagtcagctggcacctgatagcttttgcagttttcacattatgcaattgtaaggtcgtagaactgttgtcatgcactctctctttcaatgtcactttatacagttctgcagttctttgatgaccaatagatactgaatgactggctgaccaactatatatagttttttacctatttctttttattattacttgggagtgttcatttctttctgatatatttaatttctgttaacttttgccaggtgtccttttttgtcctaccagactataagcctcctgttgcagcatgtgctatgaatgagattttagcattggtttcttcggaagctccatccactcagccaaccctcattgtcccatttatgacaagatcgccaaactattatcatggagcaaaaacaggacagttagctacactccatggtgctgaaataggagcaacaactgagtttactcagatgttagttgacggaactactaaacttcctcaatctttacaagtgcgaagtgagccaatactctgtttgctggaaatggtacgtgtgttgaatataccgacagttattctttttgcatccggtgggcagcaccaaggaaaaagctctacagatgtggaccttgaggtacatactcactgactgctgagttccaattgaattttgctttgcagtttatttcttctttctcttgttctaaatgaagataagtgcagaataggaaactactacagttttaatggctaagcttgaagtcaattttatggtaatatagtaaatgagaaaaggttaacctgtagacttggtatcttgaaaatattatgttagaaccaagattgaagttgaactataaaatatgtgtccagtaataggaaaatgtgctctatgtcctcttctttccaaatagaaatccagaaaccatgatgtttccaaataattgtatgtatatcatcatgatgtcggaaataatattataatggttagagatctgaactttcagcacttccatttcatgatgtaagtctgcaatattaagcaatatacatgacagtaaaaattatgtaggaaaaggaaatagttttttagtttcgagcaactgtgattctgtgaaggaggcaaggagctagtcttttggtaattatataaggattcttgcgtaattttgtctgccccacactcccacccaggaacttcaacttctctgtacctgttgccactatcttcaaaatatatctgcagtttttatacttgcatttgttggctcaccccgacccctacctgttgtgcttcaggtgctgcagtgtgtaggtgatcacttggctaagcacatcaacttggaattcagcaaagaaaccgttcttcagagggggatcgaaaaatcacccgtctttcaggaaccatggcgcgaactgtaccagtgacagaattctggcatgccagcaccctctgaatttagttttgtaggccttacatgttggactagtacggtgtaccggaatgctggatttattctgtcaaagggtgtgtaatatgacgctctgtttgcttctgtttacttccatcttgatcaactgcttctcattccttgctgccactctagagcaaagctcctataaaattatagaagaaaccgctggactggtcaatctggtcttctggcaatcctaattttcccaagggttggttgtttgacttgagcgtgtaatgactggaattagtactacagaagtttgtcatcacttgtttggttgatgattcggtgcagatatcactgttatcattacatttggacatttaaaggtaactactagtagaatgcaagaggaaaaggtatttcatgtgtgccttcgtaagagatcgattctgatgtcctattggttcctgaaatgtgccagagcatcatgaatatggacgattagatcgttactatgggctgttagtgtttgaggaatatttgatcaagggaaaatactgggactagaatctcgaatgtacttattaactgaaactagatttaaccattgatatcacaatattcattctgtctatcacagaacatccatgcaaactggaagagcgccttttttttttctgcatttgtatgctttggattggtactagagagagaatgaacataaaaccagtctcaaatattgtactccctccgtcctaaatattgtactttgatcattcgttttatttaaaattttttaaaaaaaaattaaaaacataagtcacgagtaaaatactatttatattttattatctcataacaacaaaaatgctaattataaaaaaattttaaataagacggacgatcaaagttgagcgtggaaactaatagctgcacttattttggtacggagatagtagtagagaaactaacacgaggctctaagaaaaagacatttcagaagaagcaaccggttctgacgaataaataattttattggtccacttgtcagaaacaagcaagaaagagggatccggatcgtctgccgtaataagaggagagagtacggattgagagaagaattatatcgttatccgtgcccacgctttcttacctattaaacagggtgttctttaaaaaaaattatatagaaaagttgctttaaatgatcatattactttttaaaaaaatttaaatgagttactccctccgtttcagaatggaagtcattctagcatttcccacattctatctagattcattaacatcaatatgaatgtgagaaatgctagaatgacttatattgtgaaaaggaggaagtaatactcaattaatcatgtgttaataactcacgtcgttttacatatattctccatattctttttttcctctcgtctcaaacacaaccgaggaaacaattattggtgacgtagctaaatcttaggtgtccatttctagatcccaaagtattttccgtaacgcgcgtgcactcacctctatgagcgtatacacacagataggtacatcgcatactactgaaagaataattagctataaatgcaagtaccatgtgggttggtttcaccacaagaaaaataaccgattgagttatgctcacttcacataaaatgtagcgtaaacttgaaatacgtaggatatagaaatggattgggcaaatgtcaagtgctcatttctttgtcctacgatagtttctatatttgtaatacatatgaagtttgcgctacatattttttttttatagaacctccattcgtaattcatacagtactttacatcgttgcttcatgtaatacattaatttataccaggtttaaaatcaaaactctatccattttttaaaaataaatctacaaaggaatgtgacacatttttatatgaatctcggcagaaaatagttgctcccgaaattggaatctgaaaatcgcttccgttggtggtgttccttgcgcaaatctcgaagcaggggcagcgtcaagccgtcaacccggctcctggcaaaggagcagagccgagatcccccagcaatggcggcggcgcagtgagctcgccgccgattgccaacatgcgggcgacgccaccgccgccgccgcgtcccccggctcgcgcgtacccaggaacgtctcccatgggctcgtctccagccttgccgcgctccaccaacccggcggcgctcctcgcccacctcgccgccgtcctcacctcgcccgactggttcctcaacccttccctgccccgcctccctgccctgctcacgccgtccctgccggagtcgctccccgtcccgctccccgtccgcctcgccgccgcggcggccagggtggccgcgccgtcccgccacctcctcgccgtcgcgctcccggtcgtcctccgcctccactccctctcgcccccgccgctccgcccgctcttcgaccgccccttcgcctccctcctcgcccacctctcccgcttcgccctcgcgccgctcgccctccgcctcttcgcccacatgcaccgccacgccccgccggcgccgacagcccccacctacaacgccgtcatccgctccctctgccgccgcgccgacctcgcccgcgccctgcggtacctcagcctcatggtccgctccggctggcgccccgacgcctacacgttcaactccctcatcgtcgggtattgccgcaccaaccaggtcgacgttgcccgcgacctgttcgacaaaatgcccctgagagggttcgcccaggacgtggtctcttacgccacgctgattgaggggctttgtgaggcggggaggattgacgaggcagtggagttgttcggggagatggaccagccagacatgcacatgtatgcagccttagtgaaggggttgtgtaatgcggagcggggggaggaggggcttctcatgctgcgtaggatgaaggaattggggtggcggccaagcacccgtgcttatgcagctgtggttgatttccggtgtagggagcgtaaggccaaggaggctgaggaaatgcttcaggagatgtttgaaaagggattggcaccgtgtgttgtgacatgcactgcggtgataaatgcatattgtaaggagggaaggatgagcgatgcattgagggtgttggagttgatgaagttgagggggtgcaagccaaatgtgtggacatataatgcattggtccaagggttctgtaatgaaggaaaggtgcacaaggcgatgactttgttgaacaagatgagagcatgtggagtcaacccagatgctgtgacatataatttgttgattcggggccaatgcattgatggacatatagagagtgctttccgattgctacgtttgatggaaggagatggtttaattgctgatcagtacacatataatgcgttgatcaatgctctctgcaaggatggaagaactgatcaagcttgctccctttttgatagtctagaaactagaggcataaaacctaatgccgtgacattcaattccttgataaatgggttatgcaagtctggtaaagctgatattgcatggaaatttttggaaaagatggtttctgcaggttgcacacccgatacttacacatacagttcatttattgaacacctatgcaagatgaaggggtcacaagaaggtctgtcctttataggggagatgctacaaaaggatgtgaagccctcaacagtcaattatacaattgtgattcataagcttttaaaggagagaaactatggattggttgcgagaacctggggcgaaatggtttcatcaggttgcaatcctgatgtagtcacttatacaacgtctatgcgtgcttactgcattgaaggaagactaaatgaagcagaaaatgttttgatggagatgagcaaaaatggggtcactgtagatacaatggcatacaatactctgatggatggacatgcaagtattggacagacagatcatgcagtctcaatcttgaaacaaatgacaagtgttgcttctgtgccaaaccagtttacttattttatcttgcttagacatcttgtacgcatgagattagtggaggatgtgttgcctttgaccccagctggtgtgtggaaagccatagagcttactgatgtctttgggttgtttgatgtaatgaagaagaacgaatttcttcctaattcaggaacttattcttccattctagaggggttttctgaagatggaagaacggaagaggcgacatcgttagtttctcttatgaaagaagatagtatatctctgaatgaagacatctatactgctctcgttacttgtttttgcaaatccaaaaggtatttggatgcatgggtgttggtttgctctatgattcaacatggttttataccacagttgatgtcctaccaacatctgctttctgggcttatttgtgaaggacaaacagataaggctaaagaaatattcatgaattctagatggaaagactatagtcccgatgagattgtgtggaaagtgattattgatggcctgataaaaaaaggtcactcagatatatcccgtgaaatgattatcatgttagagcgtatgaactgcagaccaagtcatcaaacctatgcaatgctgactgaggaattacctgacagggaataatatgccacacaagtctcattcatcactcgaagcgaaatccccatcagctgtgcaaactggcatctcattaggtgctgttcaagcacaaggtgcaccaagtgatgtgaaatggatcatccaacatactctctcacacacaaaatgagttcacgctctatttgctctctggaaggtacaaaactggttcttggtattatgactttgctatttatttgttactctcagtacatgactatatgtgttgcttcccataaagcttttgaccgaagtgtacaaatataaaattccgcattccacctgatcaatactaaccttaactttacttactgaattgatactaaattctctagccttcagtgtgttcactgaataatgtatggcaccacatgagaatccgtagctcctgaactaagaaaataaaagaactctagataatggtggaagcacatataacgacttgatgctatatgttgacaattctttgtttttttttttggaacattgtgtctggatatccacaaataaggtccatagagtataactttgacatttacccatgtgaactatttttcttggcaaaggaagatttttgagctatacaaaacaacttgctgtacttggcaaggttagttaattgcttgggttatcaagggaaacaaacattgacatatatctgaggtgttcagagaaagcattcataaatgtatcactaaattgataggccgtcaggaaaaatgatgaattccgtgatttcttgaaaaaaatggctttgttttgttatatgttccttgagttctctagaccattccttggatttccttttccatgcgtagtgtacagattttctgagcagaaacatcccttttgataaagctgtagcgctgtactcgaaagataacttgagtttgaagcttaatagaaaaaggatatcaccaaaagatcataaagctaataataccgtgttccttttctttgtagagcagtgattatcagatttttgaagactgatatgagcgcaaagcatttgaatccagattgtgtgtgtgcctgtactatatcaggtcgacagatagtgtttacagatttgtaggagccaaaagtcccataccgctatggcaggcttcgctactttattattttattgatctgaagagaggttgccaagtttgattcgacgattttgtcacggatcttctgagttactgtgtggcacaatttctgatgctggttgttgaaccgatgagtgatctgatttttttgggtggcaagtattgttgccagtaaaatatatggaagggccgaaagatttggaaatgcactcagcgatcagtttcaataaatcatcaacataggaattactggtaagcctctttcaacttttgcataatgaatcttcagttctaattccatgtgcaatataggtagatttatctgtaattgactgacaaaatgttccaagagaaggaactaatctggtcggctactaacttgtttgcactgccagtaatattgaaataagcagcaatcttgaaggtgtgtacgcgcaactcgaataatatttgcattacgttggcgctgtaaaaggaaatcatgagttgatgctacgatatcagtactgttatatcgcttgatttgatgtctggaagcaacgggatactccctccgttccaaaaaaaaaagacaaaccctggatttacgtgtccaactttgactgtctgtcttatatgaaatttttttataattcgtatttttattgttgttggatgataaaacatgattaatactttgtgcatgacttgtctttttaattttttttataattttttcaaataagacggatggtcaaacattgggcacggaaaccagggtttgtcttttttttttttgggacggagggagtagctgactagagcatagtgacaatctacagaagtctcatttcttatgttcaagaccgacacataggatgcatatggcactacttgtatagttactatatggtatcggtatgtgttattctgtcatatatgctcacttgtgcattccatcttagtacatttatgtactgatgaataatccatctggatggtgccaggtcacaatctgggaaagaaaggaatctattaacggacggccaagattccctggcccactcaaaacagcgaaatgcacaaagcctcgatcggcgtctgacaggctgtcacggacgtgggctcacaatcgggctttcaggctgaatgtatggcccagccagataggaaagacagcgttataaaccaaagccacgctgcagccatagctgagcacatggaggtgccacattttgtcacactaaatgttactccatccgtctcataatataatattttaagtttttgtttgcaacgtttaaccattcgtcttatttaaaaaaaatttgaaattattatttattttatttatgacttactttatcatccatggtactttaagtataacttttcattttttatatttgcaaaaaaaatttgaataaaacgagtagtcaaacgttgcaaataaaaactcaaaatcctttatattatgggacggagggaatacttactttgtttcatatattataagttgttttgattttttaaagtcaaacttctttaggtttgatcaaatttatagaaaaacttagcaacatatctacaacacctaattagtttcattaagtttaacattgaatatattttaataatatatttgttttgtgttggaaatattattatatttttctcaaacttaaaaaagtggaaaaaaatcaaaatgacttataatatgaaattgagggaatataagcatgttacactttgtttggtgggtgtttgatttattgtcataaccgtggttgatcacacttctgctccaccgatcttagacatactctctccgttcctgagaaatccaacttctggggataaatcacggacgtagtggcagctttaggaatttctcgttgggtgattctactccatgctcaaaattctctaacgtatttacttagaagtatgatacaaatatagcatatagtacctcataatattacaaatccactaaaattagcatttgagctttgtaaaaattacaacatatatagtcattaagccatgcatataaacagtggcggagccaaggcccggcttgcacgggcaatggcccgggctctaccagctacatgcagcaattcaccagtaaattagtgcctaattaccttagcaataatctttcttactcaccggtatggcagtacaatgcaactagtaaagcagcaaacacgctcaacacaaacttttaaagcaaatgttcatactaaagttatctattataggtttgtgtataccttatttgttgttagacttgtccagactcatgaaaatttttgaatccgccgtttcatataaagtgaaattggctggatttgaaggagggagtccttcgggaccaaaattgatggtgatcaagggatcacctggatcaccctcagaactgtcactgagcacggagtatttatttgttaaattttgtggctagcaaactcatagccacactttaataaaactttgaagaaaaagctttgtgataaaaaggcatggggaagtgtaggtgtcaatcaatatgctcttatcatggagtactcctgatacggaccaggttactctaatcttataatcatggtgactgtggcctgtgggtcatgtgactgtgaagcaggagaatcctagtttgttggagacacgtctgtgagagccggtacaataaggtgacgagcaggtataacaagatgatgcaaataggttgtacaagttgccacgttatattcgtacttattggtgggggggggcaagaaaaacgggctatagatttataactagctgcagcatgtgcttaataatctatgtgagagataggtagattagatattaatgatgcaatatttatctacaaccaataactaattgtataaatggattattaggttggcttttatattaattgacagttgggcccagaaagctatctgccgacgtgtcagcgtctcaccgccggccacgcgtgtgggctaaagccactgctgctgtccacgtcaggtcgccagctcagccggggcggaggcagccaaaggcacggtcgtcgtcgcccccaagctcccaaggagaacaaacaacggtcactgtcagggcgggcccacggggtcggaagagtaaaatcgctcgacgtcggtacgtacggtacgagctcccaatccggaggcagtaggctgtgcgagtgtgaggtactgttccacagtacacgagtaaatgcttttggtccccctattgtactggcctaccagagggttaatgtggacctccaacttaattgactgctcaaatcttgtagtatggctgtgttggtgaaatgggtgattatggctctggattatttgttggctgtctgtatacggtatattcaattacaagcgtggaaggttttacccctagtttttatttatttattttagataatatgagtttaaaccatatagcagagcacattgatggatattgctttggtaaatactactcctagaacactggattggttcgtgttttaaaaggttttctatagggctaagggacagtaagacatcaatatttttagcaagtcaagaatatagatatatagataaatgttgcatttgagcaaaagtagtactagtgcgtagtgagtatttttacaagattataatatctaactgatatactgcaatatcccgtctggataggataatattaggtctgataccaaatgatacccgtccatgtctaaacatgtcaatatgtgatacacatttagagatggagttggatcgaaatgtggtggacccgctagaaaagcaggaaacaacgacacatatcgattttaggatgttggtgctctaaggcatccggcgacagcgaggcactcgaaaactcctcctattcccatgatgacctacacctgcaactaccattgttggttgtgcgccaccactagcatactgccctcgagattaagaccacctactccctctccattgcctctttcttcgtggccttctcatcatcatcacacctgcgtaggagcaacagcagtggtggcatccccgccttccagcgtcgaacccttttgccgttgcgctcgagttcactagggatgcgaaaggagagggctacgacggccatagaggaggagggacttgcggcaaggatgacacatccgagggtggaggtgatggttgtgtcgcgtactcgagagagaatatactatgcatcgtaagaagagtagtatttcgacttgtggcatcatcctacatagcacacgctctctctctaaggatactcttaggatggttttcactgtggatgctttaaagtcttagcttgaaattactcttgccatgtgtcatcggtttataagaaaaaccctaagcccaaacacagtggcggatctagaaaaccgatttgttagtgtcataacgtgtctatcggtgccatagtatactaataatatttagatcataatgttataacatatagataagcaattttgttataggttttgccgaaagtcgtcggtgtcgcctgacaccggcctgagtaacgtagatccgtccctgctcaaacatgcatgcatttttaaaacactacaatgttttcgacattgagatgtacttcaaagcataaattatgtaaagtacttatagaacacaacaacattacggggttaagaaaaagctatcatttgtatcatgtcctttccgtattctatatcgatgtcgttttccaccgcttgaccaaagtatttgcaacaacaatactgacactggaattatccaatgcattcctaaatatgaaaaaaagaaaacaaatttcttctcgcaaaaaaaaagagagaaagaaacaaacaaaatgaatttggcgaatataaacaaagcagagagcagagcaatctccaaaaaggaaaaggtaaaagcgaaaaataaccaaaggggaaaaaaaaaagaagaagcagaggagtgaagaagaagagggtggataaaaacggatttacctttttttccgagtctcccaaacacacaatctcctccttcccactctctccgttgcccacttccttcgcatctcctctccctctccactcctccgccgcggcggcgccggagctgtgcccgccgccgtcggaagcgtagcagcaggggatggcaatgcccccccgggtcaccgatccccggcggtgaatttcagcgggcggggagccgcgccgccgccgtcgacgacgactctggtccgacctcctcactggtatggtatgggggggggggtgttcctcgatttggcctctgtgtgctcgtccttgttgtgtcggggtaatcggtgaagctggctcgtcgccggggaaagtggaaggtggctccccggcgacgggggacggcggaggccggttgaatccaatcggctcggtgcgtggagggaggggaggggagggaaaactcgggtagattcgcagacctgtggttcatggacttctgtgaattgtcctaccatgaaaaatggtttacatctaccgaatctgtaattcgctatgttctcatgtctcctggggaaagggagaacctgtaattttcacttttcagaagaagaaaaaaaattgtcaacgtgattgtataaactctagttgtttttctcttttttttttctttaaaaaaaactctagctgattcctttgtgagttcagtgtttgttagtctatgaatatatatatcatcatggtgtagatgtttagaaggcaacctaaactgaaccctaaatagccaggcacaatgcaaagccattttaggggtagtagcgtattgttactgtcattttccttggtatactgtttctaaagataattcctctgtatacttgaatatgaaggtgtcgctgttatcttcgaaagccagattttttatgttatttaccgattcattttgatcttttttcttttgcaacttgcaaggacaatgaagtcatatggttcagtttcaattttaactgtacttttttatggaacatacattttctagaactcttactatgaatgtctttataactgaaaattctgtactgatatgggagctgttgtgcttattgcgtttttatacatgtcttctaggtcaagctactgcatttgtacagttcgctgaagatcggtagttcgtacaagctgggatgaagtcaaagactaacaggagcatacagaaggcgagaaaaacagataatgtccaaggaggaccaaactgggttcttgttgcgggaggagttttgctgagcacactctcagttaaacttgggtgcaaattgaaacaactatttgatgcgaagcaacgaaatagtaatacttccaaaggtctaatgcctccatttgctgttgtaaccttgattccttgtctgtattgttttaaatgttgactgctgactttgcaaaattgcagcccaaagaaggccaggaacatgtgagttacactcaaatctctaccggtttagtgatcacctgagctgctaccattgtaattcaggtgcttcttctgtaacttaatacgatctattgcctttttatcactgtgtgctgtacctgccagcctatgtggttttgattgttatcactcttccttcaatttatagagttaaaatgcaaaactatcttagttacagtatcataagatatgcatatatgctatttgcatttcaaaaataatttgcagtattatctttgtatagcttcaatggaaaaacattaggcgtaatactttctgcagcattcataacattttgtttcagcacttcaaacttgctgaatacccttcttccctcactttcaaggctcgatctcaactcataaaaaaaattatgagttgtacaccaaactgttgggaaaaaatatttaagcatcattcttcgacatttccaaaaaccaggcacgtttttatcaaaatcactactagtgggatgaaaaagttattagtcgtccgtgaaataaccacgctaccttctataatctgtactatagaggcccagactaccatcaggtttgcctctcattttagctcatagtgtgattagttccatgaaatgaaagcgcacttgatcgttgttcttttgagaacttatcacagacagagtaactaagtctactaggattctcttgacgaagatgctttcgtgcaaaatgctggagtaacaacaacccagaaatgataacatagcactgctgagaaaattgcaacttgctcgatttgaatggtagaataacaacatccccagaaatgagaactaaataacagtgttgagaaattgcaacttgctcaatttttctggttcatacagaaattatctgttgatatgtaagtttgttataactctaagacctaatcttgcactgtctgttaccagctgtagtcattagtcaagagttaagaccataattatgctgctgtacagaagaatgtttatgcacagagaaagaaaattagaaaagaagataatgttttatatgagtggagtactattgtcattatcacattttcttacttccttatcgagcactttgatacacagaaagtgctggtgtagctttactttattcctgtctttctggctgtgaagcatttacagacaattaagcaattttcatgtttcctatctgttcttacatttatgttcctggaattaatataactaagttacattgtattgtgttgtagtttccacattgtaaattgtgtttaaaaactttttgttaattttttgttgccatggcactttgtcaacatatgggaagtatttattctttgctattttttgcagggttttcaggcaatggagtaggagtaaagcaggcacctgcaagtcctgcatcaaaacagatggaaccctcccttccacttgtgaagataccaggaccagaatcaagcaaagagaataatggcgtcatgtggatatcatcacctgatcgacttgaggatcctcgtaaaccatttcagtactcaaacagttctggctctccttgtgtttcagaatcaggatctgacatctatagcaagaaagaggttatacagaagctgaggcagcatctcaagaaacgtgatgagatgatcatggagatgcaagctcagattgctgatcttaaaaactctcttaacatccaggagacacattccaccaatttgcagtctcagctggattccgctaaccgtgatctcttcgaatctgagcgagagattcagcacctgaggaagatcattgcagatcattgtgttgcagaagcactctctcatgataaacctttgctggctgggcattggcagtcaggtgccaccaatgggcatgccaatggctatgctgatagcagcagtgttgatgaccctgagctgcattttattggcctcgacaaaaggaaaggagaggcagaaagggtggagatgctcaagagggaggtcggtgagctaaaggaagttatcgaagggaaggacttcctgcttcagagctacaaggagcagaaggtggagctctcttccaagataagggaattgcaggagaaattctcaagtcaagtgcccaacatcctgtaggatctaaacataatgtcacgttgctgcaacgagcagaagccagaaggtggatcatctctgctccattgaccggggagtttcaggagaagaactgtcagcacagatgctgaacattttcctaggatattttcagaatgttaggttgattgccgtctttcttttcggtcatcgtaatgttaggttgatttgcttcctttccagtttttgtcactttggtatcaaaaaggatatcttttttccccagctgctagtcctagggtagatgaattaatggagatcttgatactcaaggtgttgtacaggttttcgttctgcagacacggctgtgtaatgtcattctttctccaaactacttaagacgcattaagcattcatttagaatgcaacaatggcatctctacatttagatctgctcggcccatgccatgagacattgcttttacctgtggtttgcaaatactgaatactgagtctctttccattcaatgcaaatatacacattgcccttctgaatggacaaagcccaagatcagatatcatacaagagtagtcacttgaatcaatacaatttattaattacttgcacttatatgtatcttactttagctaacaggaagcgcatcccatgttcatgagaacatgcactctgcttaattaagtttggccaaatggctctcgcacatggaaagatccttctaagattatctcctcttttgtttgctttcaaaacgaagagtaggcagtgttgcggaattcagatatgggaattcaaaaaggaagatctatcggatgaaacagaacatagttagcaatatagtaatatggtagcactgtcactgaaaactatctcatgaatcaaatctagtgagctcaggccaggtttctagcgtttgtcccttgacaatattataacattcgtgtactacatattcatgttgtatatataagaaaacacaagtcagatcatatgacctggctaattgaattaaacatatttttgccgaattgactgcatccctgtcaggtcgtcagtgtgcaagctaagctgaaatatttcggttcaatgtttcgattagttgggcggtctattcctgaaacttatgagccatcaagtgttggtcagcatcggacgaaacctaacggaaggcaggatgtggtttagatggcttagcttgatggtgttgtgtatatgcatttcattaatgttttaattcttgatttcgagagtctagcatttctagtatgtcaatatagtagcagccaaaaacgattttaaggcagaaattttacacttctactcttagcgttgtagaaacaagactgaataatagaaaagtgatgaaaactaactagatatatttaaaattatatttcaaaatttattttttttatcaaatatttcaaaattcaaatcatggttgggcttgtaatttagcagacgagctgccaatagagtacttgcttggctttggtgacatcttgtctctatcttgtagtaatataatgagatccatatagcaaaacttttttttttcagagattctttctacggctttcatcaatcaaaatttcatatgatgaaatattgccaatcaatctaagaccaaaatttctctctgaagattataggttttcattagatgatacacactaattgggctgtaaaatttccttggaaagaataatacgccaagatacatactaaatcaattactggaaatgaacttgtcaagtttaatttatactttcccaccttaaataaacaaatattgcttccaataaaatttcagataatccacaaattacttccagctactgcagcaagtcgttatgtggttaaaatttccaaacttcggtcaaaatttccaaaacttcggtcaaaatatactaaggtgtattctttattataaagaagactacattcttgttaaatttttttttacaaaacaaagtgttgcaatttttttgtctttttcagatgacaattttgatatgttttagtgacaaacagctacagaaagcaacacatttttagactgaaaaacaaaactttgtccaaaaacagactgttggagaaactaataaatgtacctttctagtaccacatttactacacagtaccatgatgcaaaacatgtaagagtagtagcgtgacatgttgttatgtgtagagtatattatttcgcacgctaacatcttatcaagtgacacaaacctcacagtcagtacatctgccccaatatttgttttgccagtcttaaactatgatgaaaaggacttcacattagttttgttcgaaggaaaaaaaatattttcatagcaaaaaggtcattagtttagctcgaagaagaaagctagactcaatataattggatccattccaaatagcaagaattaggattctatttacgtgaaaaggttacatcgtttactatgaaattgaagcaaaaaaatcaaattggtacttttttatttaattttaaaagtttttccctgtctagaaatgcttcgttggtaccagtatgtctaataaattttgggtccgtagaggtggtttggaatttggagcacttaaatgtgggagagctgtcctctactgctggtttgatttcgccatttcctcctctatttaatgcttctctcctttgacttatctaccatttctcaataatgccctgctcataatatgttattaccagacattcactagatatagtttcatttacttaaaatggaatatttattctatatacgcgatatgctctatgatatatatactccctctgattcaaaaataaatgttatcggaagcagtgagtctcaaaattctgaatttcagatccataagttggttcctatatattgtaatatatttgaaaatcccaacagaattatgctatgaacattccttttgttttgttttgtttttgctaggaacattcttacctgtatacattcattatgtatattagtcgaagtaaaaatgcaacatcatcttattttctatctactgtaagatgaaaatccactgagtggaaatggataatgaaatactaaatggattatatgctactcaagaacatgctaggaaaacatcaattatgttcctcttcgtcccattaaaaaaatccaatccgaacctggacatatgcgtatacagattcgtagctagaatttgctttttttttttctggaccgagtagtaatctagcatctcgtcacatattcctaagagacaactctcccacatttaagtgctttgaattcagcttaaactatcaacattgtcaaatttagagtttttttttcagatggcctagtgcgaaaaatatttttcccatttagaaattagaaaataagttcaaaagttacttgctcatattttaacatgcaccgtggagtatccataacctacacaaaattttgtatggtaaaaataattatactgcatagaagaataattatttaaagttaaataaaaaagcatctctatttctcaccgagcttaaaaagaaccatctatatagccacataaaccttatttcgctaaatatgaattttgttacttttcgatactctccaacgcaaccaagacattatttttaacagtaaaaaaggtctattttactcctcttaactaattcaatggatcactcaacctccttaggtttttttttcctcagtttaccttctaaacaattaaaaatggatcactttactgattaataacatttctatttttttactcttaatacaagttgtattttaagttgaaattttttaggccataactaataccattattaaagtttgaaaatgttttcgaattttttcgtggatgcttgtttcagctttaaaattttgatgtttaaatcagtcttaagtgctttcgaactatataaatagttagaaaaattcaaaaaaaaagttcatatgtaagttctaaatgcatctatattctaccaaattttgattacgaaatatgatttgtatagagagaaaaaaaaaagagaaatagtgttaggggagcaagctgaaccattttcaatagttcggggagtcgaatgagccaaaaataatttagggggttaagtgatctggtggaataatttgagggagtaaaatgaacttttttttctttacagtatactctttaaagtcattttttgagtgtgcttcaaagacatttcaggtcacaaggttttgacacctgaaaatgctattcttcctagtgaacatgaacatacaagtacccaactgaatcggacctggtctgaaaaactcatgagaaaatactccctacacactagggccaaaccacaaaagttggaacacttgtaacaaattgtcccagcaacttgtgttgtaagcaatccaaggactggcctgtaaatatacacaacacatccatcatccagagagggagggaagagggaggagagagagagagagagcatcgatcgaatttattgcacagctctgcgccctcatgccttttatttaagtgtccatgcttccgttcagattttttttttctccttcacttccgaattccttgttcattaggcttcctgcgatcccccgtaggctcactcataccttccttctccctctgctgcttgcaaactctctccttgacgtttctttcgattttggaagaggaggtaggagaagagaattagttgccgagtttatctgaacttgaggtgagttcttgctctcgatctttcctctctctctctctctctctctctctctctctcttatcgtcgtttcttttgatcgctatgctcatatctttcgttctaatcttctgttgatgagttcttggtgcttttgattcttctttcctcatcatctactgtaaatttctctcttgtcaaactcacttactccactctgattttttttaaaagaaaaactgatgtgggcttggacagagtaaaaagcaacatagtttcaaaaaaacttttgttcatgagcatctcatatgaatttcatcaagatcaaagcagcaatcttttcttcttcttttttttcctgcgtctcctcatgcttgctggttaagctctccctttcctgcctgccggcctgtgccgtagtaactgcggtgtgtgtggggagagggcgccacctagctgcagacaacgcctgctccatgtagttaatgtccattaatttttcctctcgtttcctgccagcttcttgaatctgtggccgtagacccgatcgatgtattcttgttttgatttatttctgcgtattttgttgttgcgtaatgtgttctaaactgttcttgacgagtagtaggagacagtgtctgtattgtactgtatgtctaggacgaggagaagcaccaattgatggcgcatctccgtactccgtatcatgcaaataaaccggcagttttatgttagaaaaaaatatgtttaaataattggacaggaagtttaaatcttgaaaaattttgggttaatagattgcagtgtcgtttgttttccctcatctgaagtctgaaacagatggtagaggctgtatgttaatttccagagagagaaaggagaattcgttacaatcacaaacaactatttcgattttcgatcgaggtagtattttcgaggccatctgttgggaaaaatctaatatgcctagcatgcttaaaccgtacgtttcttcattttgtgttggagatgagtatgcttgttgtgtatgtttttttctgttgatgttgcggtttgtactaggctactactagctcatgcaaaggacgtgagatgcttcagtttgtcgtcaggacagctttcaagatttcgtgttaattttcttcattttattttgaccggatttgttaacataatgcgagagcatggagtttacaaaaaataataataataatcagcattccttgttgctagtaatattgtcaatatccacagaaaaaaataatacttgcagtaacttttctgattatattaagttgttcgagtttatccattcaatgtaattattagaactcatattgctgctgcttaaccgttgttcccatcttattatacctctttcgcatgcaggacataagcaattcttttctccataagatctgcatctatatcgtgaaactaggtgaccttttcagttgcacccttgtctactcacagtaggtaagaacaccaactgttttctagtacggtcaatacatcactgtggctgggataaaatttaggattatttttttactttcaagttaactttgcttggttagtaagggtgccaatattctttgttcttgtaagctgtaagaaattgtgcagtcaactgctgtgttgagagtagctagggtagtcaactgctacttaaaaattaggatatccagcaagtgattcatcgttagttgcgaacactgattattcactacctaaaacctactctgttgactccatagctgtagcctgtttacaaaaactgaaaaccacttttagtaataataatgcagaaattcaacttgatcccaatcaaaatgaaagtctacatttttttttcagcaacttgtggacactgaaaggggatatggccttttcttaagagtgagaaaaggatccaattgtgtgtattcggggtctcgatcgatctcggttgcaggccttgcagctctacctgtcaaaaattgatttgttaagtgggaaggcatgatactcataatgaaaaatcaatgtcttgacgtggtcttatgcttatatatacgttggttccaccaagactaccaccagtccaccagcttctttgttcagagtttcagactggggggagaattgtccctatcatggtcttcatatactatattttaggaagatggcagtttgcagtcacaagtcactacaggaaaatttaatgcttataactgattaaaagtgatttagcaaccaaaatggaagaggacaatgctagagatcttaattaggttgaatttacattccattctgtaggatttgcccaaatgatgtttcatcgtgtattagtagtcagtcttgggttatatgtcaaaaaagataacttggtatgctagcatgacatttatttaaaaatatatttttttgccttgtgaaagttttgatatttttgtattggcttgacagatgatgaaaattttgacaacggtgaaatttctgatggaggtagcttgatagctacatttggtctgaaagactgaaactggacacagaagtatacgagaaaagtgattggctgggttttgatagggaaaatggtagaagcctcaaatccaacacaagatatgatagatataactggacatgtagtacatgatgatgtttcttacgacaaggatgttttggagataaaattgccagatactgttgttacttctgattatggtggcaattttgtcaaggatgtctgcatcgatgaaggagtacttccgcatcggaaaatttcagcagaaaaaaagttagatgagaagtcaccaccaaattttgatttcctaatgatagacacgaatagtgatctaacatatggggggaaaggtgatgctaaaaaatatgcacatggacagaaaccaaaaactgttctcctacctgttggattcgctgctgacgataacacggagaaacaatgtgatcttgaaagcagggatactgctagtgatatcagtgagaagaaaataagtttgcatgagttacttaagcttgaaagtgcagaagaatccaaggaaagacttaaacttgaaagtgcagaagaatcccagacccagcatcaaagcacaacttctgcaataaatgaaaaaaacatgccccctgttcatgaagaggctattgcacaggtaaccacataagttactggcttaatctgtaatcaaatttgttttctcattaccactatcaccaggtttgtcattattatttttttattacctgaccctactcttttgggtgataacttgaattatatagttatgagaagttcaatcatccttagattggttttttagactgacaaacaggtttgacaccacattgcaggtttccacaaatgactgcaatgatgttgcaactgcatcaaaaactgatgaacttattactagcaacgtatcaagtatcaataacaccaacggttcatcagcaacaatatctgacagacatgatgcaaccgcagcattagataaacccatgtccactgctgagactactgacggtttaattggctccaaacaatttaacgaagttggaacagcagaagccatgcctgatgctctgacatcaagtagttcttcagaagtccaaccatccgaaaagagcaacgaccaccccgaaagcttcaccagcgagccgatagcggatccacaggatgaaaatgcagtggccacatcctcatcacctcatgttgtagagtccagtgatgcaaataggcagatgaacaacaagaactctgacaacgatggtgctactgatgtgcatgatttcaaccagacagattcagagagctgcgcagacgcaacaaacgatggcagaattagcacgagttctaccgatgcgcaaaaggattccactcatgtggatgaactagatgtgcctgataataatgcaaagggaaaatctctgattggcaatgggtatccccttgagccatgctctcttgggcctagcatcatgtgcaacccagtgtcgacctctggtcacattggcaacatctccatccggtcagatagtagcacgacaagcacccggtccttcgcatttccagtgtaagcatccatcctcatccactctgtcatgttacaactataaacttaaaccttcttttgtgttcatgaacaacttttgtctcaaaactgaaagttgggaggtatgtgctgctttggtggatgaacaggttacagtgggattggaacagcagcccggtgaggatggcgagagcggagcggaggcgaaacaagcggcgccgtggctggaataagggcttcctctgctggaaattctgagcatccccttttcttatacctcctgaagaatctctgaaattctgatgcgctgctgaagtcggtcgaaatctatctgtaactccaccgaagtgtctgatttgcacgccatatatgtataccctgcttcttcttttttgttggtcctgtagcaggtaagatggcttgtcggttttgtcagtggcttgtaactctgtaccgtgagcgagaagaggagtgaagaggtgtataaatagcgtgtagcctagggggtgatggatcattggattgcattgctatctgtaaaaaaaaattagtttgtgttgatctttgctggtttgagcctttgaggagctagaacgtattccttttctcttcatcataccaatattcgtcttccggtctgaattctgaagtctgaactgacatctggttttctgaaactgcgaccaaagtgctggaatctgaaactggggcgatcatcagttcatcacgcgatgtcgcgatgggactgggactgggaggggagaggggaagcgcttctctcaccgttccggtggcacgtctccttttttcaccgccgaccctattattttttagtaccataccgctcgccgtggagcgcgtcccccaggataaaggagtgcgccccggagtctccatcgccgggcctggtagcgcgggccttaaactccagcttctttggagggcagagttggtaacgagtcggatatccgtgggggcgctagtctctcgtcctgggtctaagtttacccgaggcaggcattgctcccggggtcagtgtcggtagagcccatgtcaaaaaaataaaggccccagagaaaataaactttttacccccgcacagcccactaactttaaagcagtcatcgtgatatttcgcgtgcttgtcgcgggtctgtggacagaaataactctcacatgctgagcttaccacttagcggagttcatcgtgataattcgcgagcccgtttgcaagtgtggatataaatgggggggaggcgggaggcggctgtgtatatgtgttctcgcaccgctttacgagtgtactttgggttgcgctttagccacaggtgcgggcttccacgtagtaaggagacgaggagccttctcttgtgggaataagttcactttagttctttatttgtcgcccaatccgggctacgccccgtcccccaactttccataaccgtgcaaacaagttctctcggtggttttggttgacgtggattgttagactagttctccgttccacgtggcgctgatgtggcaattgtatattggaaaagtaataaaaatcgtggtcccacaattcaaccatagaaaaaataatttaaaaataaatatggaggggcccaaatgacatgtcattcccaaatgatcaaatccaatcctcttcttcctcctctctccagctctccccatctctctgctccctcctctcgccgggcggcgtccagcacgacgggcggcgcggcggcggtaggcggcgccggcgatgtacagcgcatggctggcggcgggcgatggcgtgcgcggcggcacgcgaggcgcgtggggcagaggcggccatctctctcttgcgcaacagatggattaagttgtgaccacgatcgatcacttcaaaccaaattgagttcacagcaacgagattcacatactgcaatgcagaaacgcaaacagaacaggcaattcagttggccaaatgcgacagaatggaagagttaaccacaatccagagctagaggattcaaacagcagcaccagaattgcttcactgggttatgttgcgatcgcctaataaccaaactgaaatcacagcagcaaggttcaaatcaccgcaatgcaaacatagacaagcaatttatgaggcgattctccactgcttcatcacagatgctcaaatccaaccgagggactccaagttagttcaaagttcaaaccaattcccttcctccaatccaccgaacttccagaaacacacgcgtacattgaaaccacactcgattaagaacaaggcacgtagaatcggaaccaatttcaaaagttcaagagctccggaatttactcaaatttgccatctcgaactcgaagccactcacgcacatggagcagagcgaatcacttaccagtggaagggagggcgacggcgagcgaggaaggaggcgcgtggaagcctgcacgcctggagcggcgcctcgcacggaccgcacacggatggctgacgcacaggtgtggcgccggcgggagaggagggagcgacgcccgcgcgctcgccggtaggccagggagctcgcctagccgtccgccgcccttctagctcgccggcgggagaggagggagctcggcacggctctagctccttcgttcctcttcccctttcccatacgcgcgtgcccgggagggagtgaggggagtacgagccgccgctgccgctgctgttgccgctgtcgcggcggacagggagaagaagccgagggcggaggccgggttgggggagaaggcgagggcacggagcgtggtgttgagcatgaaggaattgggggcgcaggggagggaggcgaggagacggagcacggcgtcgggaggggagagcgcggcgtagacggcttgtggagcggcggcaagcagcggcgggagcatgacgagcgcggtgtagaggcgcttggcaatgccgtcccggcgcgcgcggagggcgtccgggtggtcggcggcggcgacatggatggcagcgtcgatggcgtctagggcgccgccgcgctgctcgccttcacgcggagcggcggcgccgaccacggccaccgccgccgccggagctcgcctgctccgccgcccacccgcgccgtcctctgcctgagaaagagaaagagagaggggaaagggaagaagagagagaagggagagggaagaagagaggagtgagactgacacgtggggcccacatggcccccacaattttaaaattatttttttgtgcagctgacatgtggggccacgttttttattattttttttagatataattgccacgtaagcgccacgtcaatgccacgtgggacgaaagacctattcaaacaagtcacgtatgcgtcacgccagccaaaaccgctgagggatcacgtttgcccggttttcgtaagttgggggacggatcatacccggacaaaaaatagagggacccaaagtgaacttatttctctcttgtggggggcaaaaagggctcgcgcactttgaccccctctttaccaactctcaacttttttttatccccctcttaagaggctctaatttatttagaaaaatcttagagaaatcagttgtcaatctccctctcaacatggacttgaggacgcattggatatttgggtatccatcaattcttcaaaaaaaaaattctagttttttcctcccttccatattcaaaaattttctaaataaattgagaattccgtagtcaaatactctctggactcaagagaacgccatggatcggatacccctgaatccttcaaaaaaaattctaaataaattgaaaaatcagtagtcaaatacaggctacaaaattgaaaagatgctatatgtgacatctttattgaggttaatttctcaacgacgtgctgctggaaagtagtacactactagctatgatctatggagtttggtcactcctctcctatcttagcctagggagagaaagataaaactgagaaaaagaaaagctagtctaaatcaaaatagatacagcgggatgaacttggcagctatatatccatctatcttggctatctatactcataagttgtgcttcttagggtgaggcgttggtccccggcgttcaaccactactatcttcgcaaactgatgaacatccgggctccctccatggacagagtttgatccaacttgcacggcttcaaccttcttggtcttctcctcatcgagcttcttctttgaatcttctaatcctctttctgttgatgaaccacggctcgacatggacgtgttcttcactgcaaaaaagatagtaatactggttaaaatcaacaatagttgaacatacgaagaaagaaaaagggaaatgctcctgccacaaatttcatggtgcttttctcagagaaaaactatggtaacaattaattgctgcaaagatgaatatgaacttacaatggcgtgcgtgagcaatgggacggtcaagtaagagcaaggagatgaccaaggcgatcacaagaagactcgaagtccttcggcaactcatgatgaacatgaactgaactccaatcttggcgtacgtgcttcttttctctggatgcactacgctcttctgctctagcttagctagcttggtcagtcagtgagtgagaaaattaacagtgtacagaggagaggggggcttagatcgagtagtaagatctttataggaaggcaaatgcttagccgcttaatttgtcagtcagctgagaggaaggcgtggtcaaaggctttgctcaaaactcatctcagatttcttacacacactgttattatatgccgtacgtactcctgtttctacccttgtttaacaagccctaggcctaggcgttgttcttttttacagctcggtcctagttgcacttgcaccatatgccacgcactgatgcaccacgtgtgggctctgcaacaatgcgtgccggtgccgtgccttctgccgagatcgagctagcagtggctgggcttcgggagttgagctccctgttggaatcccgcggccaatcggccacaacaccacacacacatctcgccaattcgccatgagactggtttctaatacatgggtggtgtaaagttttggcgtgtagtatagagtgttttgacattaataaaaaataattataaaatcatcaataaaccgcgagacaaatatattaagcctaactaatccgtcactagcatatgtttactgtaacatcacattctcaaattatagagcaattaggcttaaaaggttcgtctcgtaaattagttgtaatctgtgtaattagttacttaacatatatttaatacttcatacatgtgtttaaatgttcgatatgacaggatgaaaaattttgtgttgggatcagggcgtgtgtgagcgtgtgactgggcaacacttctcacatggttgcgcctgcgcggcggcaggttttctcgtttataaaaagagggaagttgtagagcgattctacggcactgacactagtgttaaaagaccaggatccaaggcaaggggcacccgggatggatcaagactcgcacccctaggaagttttgaaaaaccaacattcaggaatcgggacagaagtcacagaaggcggaggtgtgagatgcctctctctgcgtgcagtcggctggttattacgaattccgacacggttttaacccacaaaagtaaccgaccgcggcaacttggtagcaacagtaccattgcaaacggaaggcggaaaacacatggagcaagtggtttcgagcatagttttattgcacaaatcaagcagattcatttctagctttacaactgcaaacttcatttgttcgatcagctttgagcagatgagattgtaacaccatatcccatttaaagtccataatgatgtgttgctttatacctaggtgatcagcagtgttattgtagttgtaggcgattggtactgtgaaattaatgtgttgatttaatctatgtgataaacaattgtcaaaagtaagtgtttattgaaaatacagtgaataatgttttcggtcggtgaatagtgcagtcagcaatgggtggtcggtcagaccggaggtgttggatagcccggcggttagaccagcagactctgggttgtagttggtttcgggttgttttcgtgggatttctaaattgcttcatgtttatgacttttagatgtttctttttgtatgtgatactattttatgctgatatgagtcaagttggtgcgaacttatactcgaatacagagagtctctttgttgtttatgtgcaggtgttgcttgaggttatgtgagtatagtcggtaatggatcaggactaggcttggaagaaattgaggtccaaatggtcatatcacacaggatgcttaggctagaaaccatgcatgtggagtgaaggtttccataaagtatatacatagtgttgtgtacgtatgggaagaggtccaagtttagaaagattagagcgcggagttgtatgagaatgttgtttaccttgttgagtaggtttcctatgtgattgggaattctagttcttgtaggatttgtggctaggggtagccacgttgaggatataaatagatgaggggttgatgctagaagtatatcaattttttaggagagaaaagttatagttttgcttcgaggcttcaatactagttgacagaggagtgctttagatacactttgtaaacacatattgatgcaataaagttgatctactttcaagagtttcgtctcgtcgatatgtgatttttggatcccgatggtcagaccgacaattggcgagcagtctacggcaggactactgcggtttaaccggtagcaatcaacatgttaggcctcccccgcccctctcctccccttcccgtctctgccgtcgcagtgtcggcagtgggcggcgagcggcgacagcgccctcccctctccgtcagcagcgggcggcaagcggcgacaccgctctcccctcctccccttcccctctgtcggcggcgtcagcagcgggcggtggcaggcgtcggcgggtgggaggcggcacaggtgatgcgggcccaccttatcgtcaccggaggcactccgcctccttccccgctggcctccgggttgccatcgccgtcggcatcctcgtccttgacaggagggaggagcgccgggcccgggccggcgatggcgcgaacgaacagcatcgcggcgagcgcggccaggagctctccttctttctttgttcttctcttctctttttcttattttctgaaggactgtagttcagaattaatgttcatgtatataattaatcttctgtttgaagaagtgtagctgcaaattagtcccctttttgcaagtgagactagggatgtgttcggattccagtgatgggaactaatccctctcacacggaaaacggagcggtttattagcgcgttattaattaagtattagctatttttttcaaaaatgaattaatttgattttttaaagcaactttcgtatagaaactttttgtaaaaaacgcatcgttatacaaacacagcctaggagttgtgcatagcaatgagttatgtatgattttgttgttgaatatgttcattcaatctgtggtatcaaattgttgttgagtatgtacgttcaatcggatttgggtaatatgcaagtagtaataaacaatgaaaaaaaaggaaaaaaatacctttagtcccgattgacaacaccattcgagatatcttagtcccggattagatatctcggtttgcaaagggttccccagtagtgtcactgtgtcaggagctcagctcggatgtgaagctggccaacatgtttttttcacggatatgcataggacttgcatatcattttgtattaataaaaaagggtcacggcgagagagagtggcaactaaccaacaggcaacagcatatacagagcagcaaaatatgaaaagagcactgtacagctcgggacaatgctgcagcacacaagtactcctagaattcgtcctcacaagtactcctataccgctatacgtgaagctcatcaatgatgatttttcctgctactcgttggagggaagaatcttcatctctgaagaccctcgcattgcgttctttccttaccaagtctgtcacatggttaggaactttgcatgataatggagtcacatcccttctctctggatctaatctttaatcctcccccaccagtccacaatgagaatagttcccgggctggtgtaggtgagactaccggcggcagaatagcatccagaactgccgcacccatccgcaccaaagagttggtctgctctgctgtctctggctatcgctgtaacttgaactcctctacatagataattccatttcgtaatctacttggatatcacgtctggtatatcccttaccaagaacttcctgattgctctaactaaaggaagagggttctcaacgtgcacggcgtggccgctgtctggaataatgatcatctcacatagaccatcggattcgcgatccttgtgctttcttatctccctgcacatttgctgcgatatctctttgaattttgggtccttttcacctgcgacgatgaggagagggctcttcaagtgcttcaaatcttcccacagggacctagaacattgaaactaacatgagatcgaatcacacatgattttcttattacacaatcactaatgtaatatgaccatcaaagtgttcacaggctctatatgtatcatcggcacactatattttttaccactattaacgtcaaaattactaacggactcgatggaacatgactttatggatatcatcaatgaaaaatataatacggagtatgggaaggcaagccttacttttgcgtccctatgcttgagtcagcgagaaccttagatagagctttgatattattgtgtttcattcgtgtcctcactagagaatcaaatttaggatgttctcgtaaactgtaaatttggtcatccatcaacagaaaatatcccagaaaaggaaaagaaaaaaggcatgtcaatacatttttggcaaaacaaaagtatattgtcactgcataacaatattacctggcccacattttcgcagagtaccacgtctcgagaaaattttccagtccacaagaagacaagaagtgggctcttgatctatcaatagcactacgacgtcttttacttgcctcgtctctcaatccaggactacccgaaattataacagctccacttatctgtcttaacgggactgcgttagaatcataaaaataaagaaataaacacaaaaggtacaatgtcgagaaatttaccttgtggttttgatttaatgccatgtgtagtgcaatccttgcacccattgagtagccaacaacaaccaccgctccatcagttatatttcttatcaacttcagtaacaaatctgcaactgattgaactgaaaaggagatttggttggagttttcaacatcatgctgtagaatttcggactcgccatggccaggaagatcgacagctataacccgtgcactaggagagagagctttcatcattggaacccagtcttcactcgtaccaagaaatccatgaagaaagagaataaccttttcctacattggttaaatcatgacaatagttactgtgacagcaccatcttactacatacggagaaactaccagtatctcaagtatacagtgcaagtaaaacttagataattgaacatatgcttgcatctggtttttaagtggataactggacaaccaaaatcaaaggagtaaaaacataagcagaaatttaactattactgagattaggaacaaggcacacaaatgaaaagagagcgtcaaagcactcccagaatgtatgaaacttgtccattgattgaatgatgtgaatagaaaacagataacatcataattagcaagaaagacaaactcaagagaaaacatgtaattatgaatgtgcttccttcaagaaatgaaccaaggacctatcaaatatattattgaatcattcatatggagataataatgttttcacttgaattttaactgttagtactaagaacagtagttttaaatcaatacgtgaacaatattctgcagacctttgtgatagttccgcggtctacagcatacctccttaaatcccgagtaaagtaggatacatgtcgattaaaagaattccatcttttgaaactatgatatgcttagcaatatattccagttaatatgctactagcaatagctcctgctgtttgcaacttaatcatctaatttgctctcatactgcaaatatctagccatggatctcgtgtcagacactgagcactaatctaaaccctcttatataacaagctggtaataaactgttggttttcaaaagaaaattgaagaaatcttacatgtgtgcaatcaccaccctcttgaagcttgacttgataagaaaaattatccccatcaacttggatgaaatatgacctcaatttttcttcactataagttctttctatcttcttgtcgtttataactaaatgctggagatagccatgggcatcttctgccgaagctctgattccatcaccaagtggtggcgcatggatttttaacttttgatctgaaacatcttcccttaaccattggtatgttccaagtccatgtgccacatttccacaagaacctctgttctttattctggatgttatgtcattttgtctgtcaacataatgtgcaaactgtatataggttgccaaacctacagaactctcataggtgctactgatgacagccatcttatcatgcatgtgagcccattttgctatataagctgcagtctcaaagccaccaacaacactgggttttataacctgaatatcaacatgaaaatgaggtcaaatctagaaaatgaagcatcagcttgaaaactagcccgtaaagtttgaactcacaagagcaactattcctggatgtgaaaattgatgtagcttagggattacatcccctgtaaggttgtcgatagtctcgtctagtgcaacaggcaagccactattttcacagaacttgatgatgtcatttacagagtccactggttcctgtggttaaaacaaatgaagactctcaaggaagaactgcatgaaaaacagtctcttccccaaccagtattatgatatgctgggtacaaatttaatgctttgtctattttagattttcgatgcatatcagatgaataaaaggcagattacctcgatgtattgcaaacataagccttttaccctggatccaaaatcaattgcctgttcatatgtccatttcctatttgcgtcagcacggatattgatcttgtatcctacaatttcccttactttttgaataacagctgcatcttcagcgggattttcgcgacgcccaacctttgggagattttaaaaagaagcaatgtacagattcttttagaagctaataaattcaacttcctataattactgaactggtagaagatttaccttcagtttaacggtggtgaaaccttcagcaacaagtttgacaacagcaagtgttacatccattggagtgccacaggagtctacgagtgcacatatctgtatgtttgcagtgctgctctgattatattcgaccacattggagccagtaaaaataccataggatctatctattcgttgtgactccagcaaattaagaatagccatctctagaccacacttaacactagggaatactgaagaaggctgtgaagaagaacacgcggaaaaatatcagtctctcgtatgtttttcacagaaaattttcttaagtcaacttacaggaatcccaagggttgtccatatccaattggagaaggatcctctcaacaaaggaacaacatctagctcagcatctttcattctgtgaaagagaaacctaagctgttcttcaacatccaacagatcctcctcatgaatttcaattggtgcaacctgttattttacaagggtaaaaaataatacttaataaaagctaaataaatgcacggtgcaacatgtaatatatttttagacgaaacaaagttaggagttctgccaatcaattaagaggaatgaagaaataacagaccagcctcaactaagtttacaaaaactagaagccaataaacataaaataaaactactgtaaaaccaacaccaaacctccagtaatatgctgtatattccttcagtgaaacatgggcatgcataagaaacatttttctgtattatccatttgaaggataacatcttcttcaagtataaaactgtgaggtaaggtaatttttagaccaaattaatttgcacgaggaaaaatatcctgcctactacaagtttgccagatattctggttgaagcacaacatgaa

SEQ ID NO: 29063 - DNA, 3010 bp, Oryza sativa
aaattgtaaaggagaaatgctccagaccagtccatttcctacttgaaaactgtgagtagacaactaagataacattttagtatagcataattcaagaacagtaattaaggcccacaatgagttagaaaaaacagacagattacagtagtaataaaatcaaacctcgccgaatcccacaatgctgtcacccacacataactttagtatgaaaccttcatgaaagaagctgctttctgatatcccagatgtacgtggtgcagcaagttggatcctgcatagaaggtaaatcctaaaataagagagttcccagttctaactactgttacacactttgtaatttgtcattgtatacttttgaaaattcataaaaaaatctatgttaaaatatgttcactcaaaaaaatatgtataaaaatataatcgttgtactgtaccaaaaggaaaataaatgacttatcagaacttttgcaaacaataactttcttgtcttttgtgtgtggtgatacacaatacatttgatcatatatttgcgcaatttgtgtctctgcacattgtagcatgccctgcatgttttttttttctaaattttgtaagctgcaaaatccaaaacatgactttcttgtcttttgtgtgtggtgatacacaatacatttgatcatatatttgcacaatttgtgtctctgcacattgtagcatgccctgcatgttttttttctctaaattttgtacagctgcaaaatccaaaacatggtttagctacacttatgtttagaatttccaggctgtgtgacctgtgcaggagtgaggtgtgtattgattggttaaggatgtacctgtaaaacatgtattctgctgcatgtattctaccaacagaaaagccatttaccccatccttacaatatggacctcccagaagatatgccagatgcatggttgcactatggtctgtgaacatgcttataattctgcagaatgagaatgagcatataaacgcgatgtagaccaaaataatcaaaagaactagtttgaatataaaacctatgaaagttggcattatcaacaatgcgattctccacttcgacaacacaatcaacatgcccctcatgggacttcactaaggcatcatgaagttcagcttttgtctgaactagaatatgttttatcctgaaatacaactcatgagaatgctggggatgcaaaattgccaccagaaagttatttgttgtatccacagctgactccataaccaataatgtaacaggcagaagtctcagcagaaaacatctaataaatcccagaatcagtaacagcgatgctacgttagcatcaggcaggcatattgttaaaattgtatttctataagcaaggccgaggtatgtaagcaccagaatacaacaatcgcttttacctgtgtgcagcacagagtttggaaatcgatatgtcatgcaaggtgtagaaaaatttctccaaaatttggagtgaagctgtttttgcaactggtagaaggctgaagattgcaccaccatggttgttaatgacaattactgtcatgggtttcctctgcgtccttcaggaatgtgagatgcattatcactttatcagaaataaatattcatttaagtagatggttatacaatagctttacagagagaatatctgtagttctttttatttctttgactaagtagtaatgcaaaaacaaatgcttgggtcaatgaaaaataaattaaggaaatgacaatgagccaatgactcgcagaaaaacaaacggtggtggatagcatagaatagattcaaactgtaaacctttggttcagaagtgacaatccattggtatcatgaagaaaagatatgtcaccaatcacacagaatacctgaaaatagtgcagccaagtcaaatttctgccaaaagcttactcaaaaagaagtacagcataaatgcattggcaactgtcagtatctaggaaatacacaataaaaatattataagataatcagagtagtttgagaactgcaggtggctgtgatgaaaattaggaatattctctttgaagcatagtgtttttcattgtccccaagtttgtgcagctgcagcaagcgcatttatgcattccatatctagggtaacaaatttcatcacatgaagtacccatatgagctaaataactaacttacatgcttgtttgatccaatggcaaatccaattgatgtactaagcaaaccatcaataccacttgctcccctgttcccagctactggtgcaccaagaaagcctggaaaatggtgcatcatagcattatttgcatttgtactatggtcaatccagcccttgccaaacatatccaagtctcgaatgaccatgctattcccaataaacatagtagcatcgccataaagtgcttctccaattacatgagcaacatatggttctgtaagtgaacattctgaatgcacctgaaacattatctcctgtgaaacctggaataaacaacagttatcaggattagaaaaaagcagatgatggcaacaaaaggtgtttgttagttatttccagaaaaaatctgttcaagggcatgcttacagaattgaattccttatgtagtcaagtttccatggggacaaatatatgaactagaggcagttggttaagtgataaaccccttcatgcatgctatttacagatttcagaaagagacattaaatatcaattgagttttcaactttcaatgtcaatactatttcaaatcaatttgtggtgaccttttacctatactataacctgggtgtagggtgtataataccaaagtttactgcagaaaatgattgaaacaaatgactaaggttcaggaaggttgcttacacataaggacaagttttatcctatccatactatcagaatattttgttgcatattttcaagataactaccctcttatggaccataccgctgaattcagaaccattaaaatatctgaccatctgcttgtctttgtttggaaattacactggc

SEQ ID NO: 29064 - DNA, 14706 bp, Oryza sativa
  unsure (1)..(14706): unsure at all n locations
ggactcaagatatgttcccactcgtttgctagtgatccggcttccaatctgtcaagcaaaaaaaaaaagaaaggtgtcattataaatatatcacataatgaaaaggaattcaaatgattaggtaatgcaaaagtatggaataaaaagaagaatcagtgaggagatgaacctggacaataacatctggagttttccagcttttaacagattcagacagtagaatttgatctatgtggtctataaaacaaatgctcttatctagtcctggaattgatttctgtactttcctcattcgcaatccagacagaacatcagcagcaatcggccaggaaaggtgtctagctagtaaagtcacagcccagatatcatcttctgtgtgaatagcaccaactaataaaagcccctggtttgcgttctttacaatctccagaacctcccttactgaacaagaatagttacctaatgcagaaaccattttcattcctaggtatctagtgtatggttctctatttataaaccatttgtccaaccctttcaaacagtcaacactccaatcttgatatccgtagtctagtggttctctaaaagcacagtttatatgcactggcccttgtggtgcttgcatggcatagtaggctgctgaatcaactgttgtaagaaccattctcgcgtaaatatgatcatctggtggagggagactaaaaaagtgtcttacaaaactgccaaaatgatttacctgaaaatagttaaaaaaaaatgtgacgagttcttcacaagaataacagaagaacatcataggcttaccagataagtttgcatatgctatagaggcagtatgccattaaaaggaaataaacataaaactatatgcataaactggaatggtaatccagcaaattccaagttcactgtatgggtcttattgcgtgaggaatataggcctttgcttctcaagttcactgtatgggtttgactagtgttctgtatatgtctttgcttgagtgagacacataggtcatgtgaggaatatatatggattgtacaggtaggacataattttgatggtgctgagaaataaaataaacactaaaacatagttaagggaacaacatgattggctttatgtgcatgacaatacttataagcaatttaaggcaattaaaaggtagccaaaattctgaattaacagtgctgattcgaagctcttttcagaataggagctattgccagaaacttttagtttttgtaatattgtattcagttacaatacctgattgatggcttggttggctcctacatcctgcagctcaggaggacgatcagctgtgagtaaaataagtggtacgaaatcttgacttgcctccaccacctacatatgaatcttgattaaacactatagactatttctcaatagttgatatatccattactgcatggattgcctgtagtagcacatagagagcataaaggtatacactacacagatgaagttatagcaacaagacttgttgaattgtgatttcagcaaatggtgggtatttctgtaaaggctggaagtaaggaaataaaaaaagtaagaaagagaaatgttccaactcactgaaggaaggagatttgatacagcagttcctgatgatgtaattactattgcaggcttccgagaacctctcccatagccaagagcatgaaatccaagtgaacgctcatcataacatgatatgcaggttgtcaaaggatggactgaagcagaaagtgcaagtggggatgatctcgaccctggagctatacagaagtactaaagcaaaccaggtcagaggcatggtaaaaacgctagagctatgtattcagttaagcttaccgtaaaaccaagcctgacaaattcttcaactatgaaggatgcccatgccaaattaatgttagagcatctcctaatgaaagattcaattttgttgctttgcaaacataaatcctataaaaaaattagataagtacaacttcaattacagagagcaaattacatactatctgtttttaagctaacccaccaattatatcatattctaattatatgcatcattttttttaaattggaaagtagaaaatgctgtaggaaaaggcttactacagaaagcttgtactccctccgtttcacaatgtaagtcattctagcatttcccacattcatattgatgttaatgaatctagataggcatatgtccagattcattaacatcaatataaacgtgggaaatgctagaatgacttatattgtgaaacggaggaagtatttaacaaaataatttaatggttatttatgaaaaaaagaaactcaggtagaaaccattaccatgtttgcacaaaacaagaactgcggcgaaaaccgaacaaatgactgatcagaagttgggcaattctcctacagacaaaagaataagttccatatccgatcagggatataaattcaagtttattgtgtctagtcttataagagaacatgaacaacaaaaagtttaaaaaggaaataataggaaaattatgtctgtcctaataattgtggcgaggtctatgtgtacccatgaacttcttgactttaactttttggtccatgaatttgtggagttggtcaaaagcaattcaactaactaacaggtaggcaaacttgttagttaccaggtaatgcagggcagcagggacgtaaaaaaaataatcttgaattactattataaatgtgataggtgtgaatgtgccttccagcaagatacagacaaaatatccataaaccgcaaagaaagaaacataatattcctttttgcaaggggcatttcttatattaaaaccagggattaatctcaattgcaaagtaatgaaatagcttaaagaagcttaccagggttaagaggataccttttccgtgacagctttgccatctattacagcgagaaattcagcatccaagtatacctggaacagtggattcaacaaaatcaaattgagcactttgatgtctgatgataataggaatagcagataactgtcgaaatacataaacagctataaagagtgtttgcgtgcaaactagaactatgttccataactcacaaactggttaacgatgaatagccaaaactctgtatggaatacaatatgagcacccaatctatatcattagccatagctaatttttttggaagccagcatgttctatatgttaaaaggcatagacgtttcatttatctatttttgttgaaaaagaggattttttttatcattcaaccaaaaacaaaatggtgggaagaatggccattagagattggagaagcaattgttgcaaacttcagtagagcacatcacaaaactctgctattataatcctccgtaatataactaaataatgtttcagactcaaaaccctgtgaactaattaaggcatagaagtaagaacatcggaatagtgaatatgagtgttcatgtgaaggcctgatacaactgaagcttcatcacagatggactttgcagagtggagaacaaatggcacaagcgtaaattcatgaaattaacaaagtgattaagattgatagaaatatgtaccaactgagtattcctgctctctgacatacgcgattctccaatgtaacttgttaccatgttttcataacagatagtagctgaagaatcatagctactccatatcttacaggggaaaatacaaaacagaaaattaattgttttaaaagaacatggaaatgctatattaatatgaaagaaagttaaacagaattaaatatatttttttcttaatctagttagttccacatacctgactgaaacaagattcaaataaacaaacagaatcctcaaatgtgtgagacacggagtcatcccaaacaatagttgacgataacatggaatagccatcaaattcactcagctcaacctgtaaattcaattttgctgatcatcacgaatgctataagatcaaatatctacattatgcctgcagaagataaccaagaaagaattctgtaaattcttactgcctcctatgtgacttgtatgcaagaatgcaagaaaaatcctcaaccaagttgacctccacttttaaccctttgcatttgcattactttctgtgcaataacttaccagtcaaagtaggtcataaagcgttgtgatcctcttgtaaattgtttatgtagatctttttaatacattaaaaaaatgttctaataggctaacttctatgtcatttttctagatataagtgcagtacttgtgccactcatgcatgttcagaataggactttctttgcaccaacggattactttgaggaccccaccacaatcataaaaaggctaacaagaaaaattcaggtgtaaaactgtttctgttgtctgacaatatgatattaaaccatgtaaccaaatttatacagggaatgtcatatcacagaacttcgaggattttccttgctaaattcaaaatggcttgtacacatagtctgtatctcgcaccaacttgataaatattcaggtagctagagtagcaccacagaatactgaaagttgttacctgaggaataaagaagtaaaatgaaccaattctctcctctaaagacaatagttccttgtcatatttaacacctactgatccataggctctaatcaagtgtgaattaaacgaaagatatctgcagggacaaacaggtcctaatttagttagaaacaccctgcatcacacgtacgctacggaaagcaatagagaggaggcaccttgatatcaaatcaaacccattatctactcgagaggaaccatgaaagcaaattgcagagccagcgccagagatttcaagctgaattgatgaatcagtggtttgcttcctcgacaaataaaactgaggaaacaatgatgatctcttaaactgtgtgcacagccatttgagcgccttcgtactgggtggaacaagcacctgcaccgttgcattgtcagaactgagaattaatcatcattgtttcacttgttgcttagaccgtaagggataaacaaatccaaatgcatcgcaaagcataaacaatgagctagacgcgagctcgatttacgcctattgcgtcaaggagctgagtggattattcaataatttcacagtgctggattaaaattcgtaagggaggggggggagcatgtcgcctcgccgccgcgcagcaaatattgcagcggctgctcacaacgaaaccaactgcaaatctgtaaaacacgacatatcccctcccacacagcctcgctgggcggctcacctcgaaccggatgacgccgctcgcggcggcggcaggcgggcaggccttcacctcctccccggcccgccgcagcgcggcgaggccgtccccgagggtgagcaccggcggcagcctccgggtgaacgacacgtccacggggaggtcgcggtcgccgacctcgcccacctcgtcgacgtcgatcacgatgcccgcgcgcctcgcggcgacggcgcgaaggaggaggaggccgccaccgccgccgccgcataggcagcggcgccggcgaggggcgagcagaggacggcgaggggataggagaggaggaggaggaggaggaggaggggtggtgaatgtgccggggaggacggggagggggaggaggcggtgaccggaggagaagacgacggcgagcattccggcgaggtgggtggagtgaataggaggagacggcaggtgtagtgttcgaaatttttaagcaatttttaatgtgaggggataaggtttctgggcccacgtggacagaattttcagatttccggcctacacgtatatatgggctagagatcggcccaatcaaaatatctcaaatcgtccatgccaaatataatgttcattcaatttttcctcagaaatattcgttatacaattttttttgcagaaatatattatcgatatcgtacaaccgttacgcgaaaataacatggtgacgtcgtggacggtatcgcacgatgaaagtacgagataacgcgagaccgcgcggtctcgcggaatgaaagagcgagaccaaacgctctcgtgaaatcaaacagcgaaattgtccaatatctccatttgattagtaattaattaatcaattaacaatcaactagtaataattagtgattaattatcctagttagcaattaattaataattaattaatcactaattaggataattaatcgctaattaaatcataatggcaccggtatcgctccttgcttgagcgagaccgaacagtgtcgcacttataatccgcgagaccgcgcggtctcgcgtcgcgtcgctacgcgagaccgcacggtctcacattttctttgcgcaataccgtccgcgacgtcattccacgtcattttcacgcaacggttgtgcgaaaccgacggtatatttctgcaaaaaaatttgtatcccgaatattcctgagaaaaaattgaacgaacaatgtattttcaaatttaattctggttataatagggttagagatgggttgatccatcaacttggactaaatagatgggtaatttacagggtcaatccacttgattaatctattaagtgaatttatggtttgatttacttgcatccatgcctggtaggtttcatactgaacttaaacttttgagtggaaccaaaactaaacttaactttttagtggaaccaaaactaatccatagataaacatcgctttctaggttgatctatattatccatgggttattagggttgatctaacttgatgtcggtagccttgtcacatcatagtagaaggagcaaccactccatacaactcaagctcctccatcttcaacattgctaagaccataaacaaatggtgatcatgttgacgatatagctctaagcctctaactaaaagggacaatatcaagatgtgctaaggtttaactcttttattcttgtgcgtctttagtcgagacctttattattttggattgatatgactctctactacttagaattgagtataaagacaatagttcaacactcgaacagttcctatgcctacaaaacataagaaaaaaaattactatagcataaggggaaactttactgtacaagttatatctttaaatactttattttagaaacttaaaataacatacttaagggggaaaacgactatatattctcacacatcatgtattgttcttttgcaatgttctatttacatcgtaatcctcatatgtgatgcacttattgacttttgtacttgagtactttaattttttttacaatagaagtataacttcgggtgaatgtattaaccaatactctacacatagtcatgcttatgggcactatgatctaaatcttgttatatagtagattaatacactcacaattcctagatgtgcaatattcatgatttagaagttaaactaactttgtaggaatacttttaaaatgaatcttttaagaatatctctaacaaaagatgtatcagtgctgttaaggaacaataattataaacccttaggacaaccacaatgtatgaaaagataaccttaaaataacgattgaagttataaagtgagtcatatacattgtggaaagtagtattaccttatggtataccttatgcttatgcttaaggtctaccacaagaaaaagaaatcattattttcctctcgcattcacctcattaatcagagccaaagcatttttttatctcatgtgggtctatcttgtgaccaaatcctatctatagaattgtgagaattgctttaacaatgatcaattatttatgggatacatgttaaggttacaccaaaaaaaaaacaccgacattgccttgtggtctaatatttttctgatcttattttttctccaaatgcatttcctttgtatgataacatttatattcagctgtatgaataagttacaaataattcacctattgattatttacaaacacacaagaaatatacaattatttttgaatctcgatgaatcctacccataggataaaaaacccacaaaactcgctaaacaagttatcataaccattttcggattattaatcatagtacaccaagtcaaaaaaaaaatgtcaaaaatggttgaaaagtcaacctggctacaattcccatctcttcttttcaacggtagatgcaatacaattcccagcttcctgggattaggggcctgtttggtttccacggacttattccaagtccatgtcacaccagatgtttgaatactaatttggagtattaaacatacattaattataaaacatattccatatccttggactaattcacgagacgaatcttttgagtctaattatgtcatgattttgacaatgtgatgctacagtaaactttttataattatagattaattaggcttaaaaaattcgtctcgcggattagctctcatttatgaaattagtttttttattagtctatatttaatactccaaattagcgtccaaacatccgatgtaacatgggctaaaaagttttagccctatctagacaccccttataaaacacggttcattacgcgctttctattgtaccactccgtgcaaccactgcgagactaataataaaaaaaggaaaaatataaaataaaaataaacaagtggggagtagtagtagactcgtagtggtaaaacagaggcgtcggctgagtcagagggcgaagaggaacagaggagggaagtccaatcggaatccaccccggccccaaccggggtcgcctcccctcccctctcgatccttcttcatccagcttcgcggccggcgcggcggaggagagatcgatttcttgctcctactcgattcggcctccggcggcggatgggggtcgcggcggcggcgggccggctcctggcggcggtggactgggagcgggaggcctacccggcgtaccgcgacttcttcgcgctccccttgttcgccgtcttcttcctcgtcgtccgctacctcctcgactgcttcgtcttcgaggtgaatctgttactgttgacctgttgggtgcggaaagcagcgaagcttttgttttgctggtgtgtgtgtgttttcccttcttcttctccgggctggatttcgcgttggaggaatcaccaaccaatccgatcgcgttggatagctagctagctgggtttagtttatgtgtgtggggggaaacaaaggcgctgctagctttttagcgttttaatgattgcttgtcgggctagcttggcatgcgtttcgcgtttcctggaattgtggggggagagatcaaacgctcggattctcaggagagatgtgctggtacatcatggcattgctgtattggagagtcgtcctcttctcttgtctaatgattatctggtactctgaatctgattttttgttacggaggggcccctgttgtgttgcgctgcagtggttagtcagggagtataatggtttaagatttaaggtttgttctttggtgatgaatagtgtgatctctgaggcataggcgcatcaactataacaataatggtatacagtttcaacatcttaaacaataagaatttagtgatttagctatcaagatccatatatgattccctgggttagtttgtcttccattaagaaaatacatatataatgtatttttcgaggcgaacaatgacggacttactgggccagcctgaacacaagtttattaaggtaaaagttcatgcaaggagaagggttttgcgagcagagaaatggattgcaagttgagttgatatctctcataacctatcacacgactatacaatttactgtttatcagtggcataaggcagcgatgtgctgcgaatttgaggttgtcagcagctcagtgcagcaacagaccacgagtagatctgagtggttttggcaataaagagagcagtatttctctcgtgtgagcatcttgagcaaggttaatgtaatttatatccctcaaaaactagaaatacctcgcggttataaatttgcaaattgcaaccatctcattgcagtaagaatagttgcaaccgccacatttattgtatgagtagtatacctttccactgggctatctgtaaccaggaaaacatttgtgtcgtgatgttttcttgagattttttttagataatcttgatatgtatgttgaggtatatgttagcatgctattcatctttatgttacataccattatgttatttaaaaggtaattctgatcattacaagtcatcaggacggagaactaagacactagtgagggagagttctttcacttctaatatggatggacttaagcacaagcacacaatgatgccttctttatgaacatttactaactcaaagtctaggttggagtgcgatacctaagttgattacatatagcttttttcacaagaaaattatttagacagatgcatgactacaatatacagacatcacagggtactgcaattatggcacatggccatctggttaccatttgttctgtatttgtttgagacattttttttgtttgctagatgagatcatttgcttcactatgagggttattatgattctaaagtaatttatgcttcttaaatacatgattggtgaaaggttgagcacaacagctactttaattctgtattccgaacccaccagaaaattactcttgttcctgtatagttctaatagattctctcaggctccacgttgtatcatagatatttttactttaaataattaacattttcaattgttaatgtaattctaaagcttaatgttgacactttcattgtttttcttttattttcgtttcagtggattggaagaaaacttatatttggaaaggaaaaggttgattatgagaaggaggaaacaagaaagaagataagaaaatttaaggaatcagcttggaaatgtgtctatttcctatctggagagattttatctttgtcagttacatataatgagccttggttcacaaacactaaatatttctgggttggacctggtgaccaggtttggcctgaccaaaagataaagtaatacgaattggtcctttattgcttcatgttcttactagttctcaggctggtgtatatctaacaattttccccttatctacagatggaaacttaaggctgtctatatgtatgctgctggattctacacatattccatatttgcacttatgttttgggaaacaaggcgttcagattttggcgtgtcaatgtcacatcatgttgcaactgttgcgctgatagttttatcttatgtgttcaggtctctttttgtctaacttttaatttttgttgtttcttgaatatgaactttttttaccttgattcaagcattactctatgagttagtagcacagggccttaatattttatcttcactgagtttatttcactcatttttattaacacttaactaatttatttctgaaatttttcttcatgaaccaggtttgctagagttggctcagtagtattggcaattcatgatgcaagtgatgtgttcctggaagtagggaaaatggccaaatatagccattgtgatttgcttgccaatgttgcatttcttcttttcgtcgtttcatgggttcttctccgtctcacatattttccgttctggattctcagaagtacaaggtaaatgtgatgtactgaccttgttgagatatgcctagaaaagtcagccagaattttgtgagaaagaagtttttttgaaaactagcctagaacccgtgcattgcaatggaaaacaaattgagtttttagcttattaaatcaatcaataagcacttatttgttctaagtaatactatgatttttcttattgaacaagtgattttgaaatttaggggagccaatagtgaaatgggggatgacttgttgaaaggtggtgtaatagttgtggggttcagatgttagtggtaggggtggtgtggggatggacaccaccacttctaacattttaagtactatagatgttgtgaattgtcaaaagcaagcatattatttactatgcgaaatttgtaccatatgaactttggatggtgaattctgctgttcttgccaatgccttcattttaaggggagaaaagaaacccaagccaacaagtaattcagttagaaaacagtaattgtatccagtaggaaaaagacctttgaacatagcacagtatcttatgcctcttgaaaacaaacttatctagatcatgccaccgcatgctgaaattaattttggattttatttccgatcctttctatgccatgataatcatacttatattgtacaaaatatatgtgtgatagcagactagaatactatgtacaatagtatcttgctgtcccattgtcccagcatgtaacaaaatggtgttttcattccttatttattagaagttacatgagctgactaagtcccgattgcttcagctatgaagtcttgttgaccttggacaagaagaagcacaattttgatggtcctatatattactatgtgttcaattctctcctattttcactacttgttcttcacatatattggtgggttctgatatatcggatgcttgtgagacaaatcaagacaagaaatgttggagatgatgttcgatctggtaagctctgcccccttagaatcttgtttttgcacaggatgagcatgcaaaattgcatggtcttattttcagtcccatctgcattgggacaagacaaagtctgcttataacatgcattactccaaccaccattgtgagttgaaaattattttgagtttgctaccatctaaaactgttctgctttatgtgcagactctgaaggtgaagacgagcatgaagattgattgctgaaccatctggtttctatcttctcatgatgctaggaacgccaatatctcagcttatgatgaattcttttcctggatgagggaacatgtgcagattgtttggatatgagtattattgttcatgcgaattcgctacagagccgagcaatcatttcctctgtcccggtaggatatttgtgtgttgatgcattgtatgcacgagaggtcgcactccgaaccttccctctggctgatcatcacagaagatattctttgacttctcagttcttgtagagattgaaatgtaccgaaaggtgtaccagtagcgaaaatgtagtatataattccagaaatgcagtctacatatactaaaaccctttcttggtcatttgtgtaagatacgtataccatatgaccattatatgaaattgtgtactattactatcgttctatcagtattaaactacattacagctgcccacgatcactttgtatgctgggaggtgcagtttgcatcttgcgagatgaactgcgaatcgtgaagtgtgaagcgataattatttcacttcccaggttccatattgtaaccagtcttatgtgaagaatgaagccacatggatttgtatagtaaagcacacgagctactccctctggtcgataatactctgatttgaataagactattgtcaaattttaagatctttataacatctaaaatatttatcttagaaatatggaaaccatatttatagataagtcttaaaaaaatacttcaataaattattgatatttatatatatatattataaaatagtgaccatttgttgtttcttggagactgtccttatataaaacgacaaatattattaacttagagagaagtcgatatgaactaagagaaatatcgtcaatatctattttatatactaaaagtactttaaacttcctcaaaacgctcttatgttatcacgtggctttctcaaaacactcccaaactgtcacgtatatactaaaagtccattaatcttctccaaaaggatttcaagcagccacatagcttcttcatagcagtagtatgtgtcacattattctcttctagattaacttattttagaatggaggtagcatcctttaattatctactatcttcttcgtcatctctaaaaagaaagtagacttcgtttgtctagaaaaatgtctaacagattattaagagggtacaatgtgcatgttgtgcgttcataaagatgactgtgcgcacgtttacaatattattaaaaatatataatattcaaatattatccaaattattcaaaataattttaatacaaatattaaaattatcaaaaaaatattcaaaataatacaatatcataatggtcaaaatgccaatagcaaaaaattatgacaatttcaataaggtgtccgtgagaatgtgtgagctacatttctagtttagaataataggggtagtttagaacaggttatataagcaacgctgttgcagaaaattttgacagagaaattgtagtttgagaaccgtggtaacaataatagttcataattcgataactaagctgaaaaaaacgtctcgcgatttccggacgggcctacctccgaagggaggcgctaacgttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29065 - DNA, 483 bp, Oryza sativa
attggcgttgccgttgcgttggttgttagcagttaggtgcgctcgtctctcacggtcgcatggtacgattggcaaatggcaactacacttccacattcttctcgaagaaatggagagaaaaaagggtataaaaccaacaaacttcttggaggtagtacggcattgcaggaccatgaataatttctgaacttgaatgaatgcagcaacgacttgattcttcagtaatttcagagatcatcagattcagtggccaaaacacagagtattctctagtcatttcttgcaaatgtattaggtatttgatcaagaactcaatattggtcaatcctctattgctacagaagaatgaatgccttaccaagaaacctctcaattccttttctcaagatcgagttgagtctctctcactatctatacattctacggatgattttttttctctctctttctttttccaaaaaattctatgccaagattgacttt

SEQ ID NO: 29066 - DNA, 22678 bp, Oryza sativa
  unsure (1)..(22678): unsure at all n locations
nnnnnnnnnnnnnnnnnnnnnnnnnnnnnnnnnnnnnnnnnnnnnnnnnnnnnnnnnntatgtgcgtgcatataccaaccagacatctctttccaaaaaatgatcctcacaaatgaaataaattaacctttggcaactttaattattttcgatgaagcagcttattgcaacctaacctcatcattctgcaagtagtactgatgatgaagaaaaactatcagcagatccatttttatatcctctctggatcttcatgtcaacacctcgatgccgctgtcctatgagtacccaagaacagtattcccactgatcatccaacctactaaaatagtgcaaatctgtcggcagaaagggccactcctctccagcaactccaagaaccggttgttacaacgccgcggccattgtcgtctcctgcatccatcggtcgcttcgacgtcttaacagaagttcccattaccatcataaactagcttatcaaccggcaaggcaagactaaaaagatcagaggcatctgttcttcacttgcccacaagccacgcgtctcgccgtgacacaagacgccgtacctgaacagcaggtagcacgtacgcgggaaaagtctcgcatagttaaatgtgtacgggttcgccgggcaccgacgcgataattcgccactcgcgcttgtttttccctcataaatccagcctcgtcgatcacggatgccgcccccaaccgcagtagtgcagtaccagccatcaatcagatctgcccctggatgcatttgtcgtccgcttgatcataaataagctcgggtgatcgggtcaggggcctcaatggaaggtgcctgaaggcttcatctccgtgtctcgatttgttttagctccagtttgcgtgtacgtgctgagtttttttatgccgatatcttttgtttctttgctccttcctcgtgtcgccttcagctgttcagttccgccattgttaatagcttctttttgcccccacgcttgcctccctctggtgtataaagtgtctgcatttgcaagagttctctgtgtacttgtgtagcataggttttgtgaagaaccaagcttttgccattgaattctataggagatggcgtgcactgagttagcgtcggatgtgtacgcgctcccgtgcggcgacgacggcacgacggcgctgtcgactccggtggtcgtgtcggtcctcgcgtcgctgctggagcggcacatcgcccggaacgagagggaccaggcggcggcggcggacggcgaggccgcgaggaggcgcgcccttcgacagcgcacggctggacatgagccttcacgcgttcctggagcggttctcccggtacgcgaacgtctcgccgcaagtgtacgtcgtggcgtacgcgtacctggaccggcttcgccgcggcgacggcgtgcgcgtcgtgtcggccaacgcccagcggctgctcaccacagccatcctcgtcgcctccaagttcgtcgaggaccggaactacaagaactcgtacttcgccgcggtgggcgggctgaccgccgcggaactgagctcgctggagctggacttcctcttcctgatgcagttcaggctcaacgtgagcgtcagcgtgttccagagctactgccggcccctggaaaaggaagttagctacggcggcgggtaccaggtggagaggtgcctcaagaaggccctcgtctgctccggcgaggcgcaggcgcagcaaaggcaagcggcgtcggcggcagcccagtagacgtcagctccggagccgccattcgcgcgtgatctgccagttgcccgccacaggcggcggcacagcagccgcacgatttgatcgccggcagctgccactcgagtgcccagaaagatcaaggatgtaaatagttatggtttgctcgtgtacttaggataggagtaagaattgtgcaatgcaattgttcctctctacctcgattggtaaaagaactgatgcggggacaagtaaaattgattttctttcatgttgtcacgaccgatcaactttgctttccggcaaatcaagtctttaaaacgctaacggaatcgatagcgacaaggtagcgagattacatcaaatcaactccagtagggaccaaatatgactaccaattaacactttaccttaactcatggtccatgccaatgggcgaacatagcacgcaaaattttctctgttgcgatatgcgaatgcgttgtcggtgcacattaaaaacttttcggataataagagttatttttaatgaattactcgacgcagcacagcttgcaagctgcagcaactcggccgcccccacggcagcgtacgtacgcggcggcccatacggtacgggaaagggttctgtgcaggtgcaggatctgatttctggcaacgcggatgcccctggtccatggaccatggctgagtgaggagaggactgaggtccttgtcagcattccatggcagcatcttgtgacggaaataatttacccacagactagagcgatgacaaagctttgcccgttcttggagggcaccagtgaccagacactatatctgacgagatgaaattgcccagatgcaggaaactacgtggagtacatgaggaacatttcaggcgagtagctctgggcagctgacggggagtcggtgtgggggaataggatgagcgtgcgacggcgacggcaaagaatagaatcgaggcagcgggacgaatggaatggccgatcagctgcgctgtctcggcccacattcggaggcacgtcggctgtgaatctgtgattggaataagttggtcccttaattttcaaaattcgtcccttgaccataaaatcaggtacaatgcatcatccaacttacaaaaccagtacaaacgagatccctcagtgatactatccccggcttcgactgacgtgacgcctacatggttcatttgactactacgtctcacgtgacgttggcatgatgcttacgtgacaatttaatatgggtaataaaaaaaagcatgagcccacatgttagttacaccacaaaacaattaaaaatgatggggcccatgtgggccccaaatgtcatccgcgctcctccggtccacccttttgccctctcccctctctctcctctctctattcttactcatcctcactcctcccttcttccatctcccctctcttcatcatctcttccaaggtggcggacgggggtgggggtgggggttggcagcgaggagaatggcggagcaggcaagcgaggcaggtggcggacggagctaaccgatggtgggcggcgacctcaccggtgccttccctcttcgaccgtgcctccaaggccaccacggttcttgtggtcgtggtgctcttccgcattatgacccccaagtgcgtagactagaagtggattccgccggttttcttcttcatttgttgtctctctgttacttccaaagaccaaacaaaacatgggtaggaaagagaagaggagagaggggaaaatttgggagccctagatttcgacaggttggctatagtgagggggagtggatgtattggcgcgcggatctggtgggtgcaagaggttgggtggggcggtgagatctatgtggcagggaggagacgagaggaggaggaggggagaagggtgagaggagaggggaggcggttgagttgtcgttgtccgcggactccgtggtggtgatcgtggtaattgtggcggtggtggggcatgtgctcatggcatggtggaagttgaggtgcgacgcggttttggagggaaggaggtgtggcggctcacgcggctggcctaggagccacaggaggagtcggagttggtggaaatgaagttggcgcatgtgtactagtcagagctgttcccgagcacagtgcacgccgcggaaatatggatgaggctttgtgggcgttgccaacggtggtcatcttcagctcctctgcgccacccactaccgctatgcccttctccttgcagtgtagggaaggagagaggggatagggagaagagggaggagtgacgataacacgtggggtcacatgggcctcaactttttttttattatcttgtgtgtagctgacatgtgggtcccacgtcttttaatttttacagaatcaaattgccacataagcgccacgtcaatgttacgtgggataaagaccttgtcaaaggagccacgtatgtgtcacgtcagttaaaactgaggacaataccaccgagggatctcgtttgtattggttttatatgttggggatgcgttctactcagttttgcgctcaagggactaattttggactcggcgactgagggactcaaagtgaacttattcctctgtaattcatgttgcgcgttcgtgtgaatacagtcccggcccaactaattgcggcagatgggaatcccgttccggcccatgtagttgggcacgtgtgtggggatccagttacagcccaactcgtgttgacggacctggcggtgcgttacttgcccggtcgattgatcagcaggttgacgcaggatggcgaaaggagccgaaaattccccgggaaggccttattttagaatcgccaaacaaggggagggtggtaatcgtaagaatttggatcgctgccacttattgcaatccaacatacggcgctctctggaaacttccgaaacaagagtgtacaatctcatctaaaaaaatgtgcgatctagagtatagcagccgtcgcatattcagacggatttgctattcagatgtgcatacgcgaatgatacttacatgattatcatttttaaaattacgaccaaaatttgctactccctcctttccatattataagtcatttgattaatattatcaaaatacattcaatgttaaatttaacaaaattaattttagattctgcaatccgaaggagccccaaggtacactagtgcacgtgcgctgttgttaaaaaactaacaactccaatcctacatatatgtcaaatggcatccgttggacgaacatgattcgtgggctggtcccttgactttcagattcagagatatgtagcttattatcaccggcacgtgtcactcctaggcgttgtcaaacgtcactagctaaagcggccgatgcaccgcgaaacacgcctatgagaactatatatgtctatggacgtgcagtagtgacgaagtttttaaatttggatggctgttttggaccttcaggttcaggagaactcgcggcattgctgcgatcgtgagttcgtgacaccggacggaggcgcgcacttgatcggcgctcccatctccaggtcgaattcgattccgccgcggcgaaccaagcgcatgcatgtgtgaatcttcaccgtctttggtacttagtcgattatcacatatatatatgtctcgcaccgaaagttgatttgatttttcgtcgagacatgttgacattgtgattttccatacaacgattgcatcttcttgagcatcatggccagatgcagccgtcgccgtcatcacctcgggcaccgccgccgacggcggcgcaggcgtcggggtacaagcacttctgcagagtctgcaacaaggggttcacgtgcggaagcgccctaggcgggcacatgagggcccacggcgtcggcgacggcgatgggttgggtgccgatgatgacgacgacgacgacgacgattcgctcggcgatgaggccgtgcggcgtgcgcgcggcggggcagatgatccttggaacgcgggcggcccgtcgtcgtcaggggcagcgacacacgtctacgagctccgcaccaatcctaaccgggtcacgaggagccgccaggtgtgcaagaactgcgggaaggagttcacgtcgtgggagcatttcctcgagcacggcaagtgcagctccggcgaggacgacgacgacgaggacgacgtggatcactcgctgcaaccgtggtcgccttcgcccgaggccgacggcgaagaggattctgcaccggccgccggttggttgaaagggaagcgctcgcgtcgctgcaagggcacaggagtcgatttgtcaccgacaccctcagcgtgcgctgccggcgaggaggaggacctggccaattgcctggtcatgctctcgtcgtccaaggtagatcaggcaggcgtcactgaagcagaacaacggtcatcttcttccgcgagtaaggaacataagagactgatcacgttcatggagccgacgacgtatgtactggatacagtgatggcgcttcccccgccggcgccggcgccacagtatgtctcgaccgtgcctcgaggcatgttcgagtgcaaggcgtgcaagaaggttttctcttctcaccaagctctcggcgggcaccgtgccagccacaagaaggtgaagggctgcttcgctgccaagctggagagcaaccgccagaggtggctgagccatcacaccatgcagaggtcgctgatcggagcgaggacaatcccgccaaggccacttctgatgccaggaggaacgtgcacgcaagcatcgacggtgatggaaacgccggcacgagcgatgccgcggcagaactgtcgatggccatcgtgcccatagaaccgccggtcgccgcgctcgccgctgcaccgttgaagaagaagggcaagatgcacgaatgctcggtctgccatcgactgttcacctccgggcaggcgcttggaggccacaaacggtgccactggctgacgtcaagttcggcggatcacaccgcctcagtcccacccctagccgacgaccttgtcccgctctcgttccggccaatgttggacgcaccggagcccgctctcgacctcagcatcgcggcgaacccgccactgctggcctcggccgcaacagtccgtccgaaggtcggcggcagctcgtttcatctcgacgcgccaccaccggtatacatcccatcgtcgccggcgatacccagccaacggaacaaggctaccgcgacaaccggcagccagaacgccaacgacgcggtcgggttaagcaccgccgcagcagaggacgaggcggacagcaccaccgtcaagagagcgaggctagcgatctcaaggacgtgagcatggcaggggagacgacaccgtggctgcaagtcggcattggctcctcgtctcgcgggggtgctgatgataacgacaaggagtgattgatctgcgaattgatcagtacatacatatatactgttacattatttccatgcgtttgcaattgcatatatgttgttcgcatgagcatataagtatttgccttcttttttgggactttttcttttcttttagacttggaggttttttttttttttcaagatagtgagtatgttttcaaagaggtacatatgaatttgggaagaggcagtagacttgtaggatttttttttcttctgaagagaagcaagtagtgagtattttttcacaagaggtaatgtattaatctgtcaagctgcgtgaccagaaatttttttaaaaaatagttgcttctcttgttttttcacaagaggtaatgcattaatctgttaagttgtatgaccagaaaatttaggtaatgtattaatctgttaaggtgtatgaccagaaaatttttaaagaaataggtgcttctcttgttttttcacacaagataatgtattaatctgttaagttgtatgaccagaaaattttaaagttatagttgtttctcttgtttcttctcgagagaagcaagtattgagtatttttcacaaaagaggtaatatatgaatttaatctggtaagttggatgaccagaaaattttaaagaaaaaggggcttctcctggtcttcaaagagcaagtatgagtatttttttcacaaaagaggtaaatactagaaaattggtgcgccgttagccccccatccatatagcaaaccatattaatactacatatactgtttattgttatttgtaaaagcgtaaaattttaaagagatattttagcagtttttaattttatgcctacaagtctgagtaaacattatatttgtaatatttaaattacagaggaaaaaatgatgtcaaatatatgttggttgatggtcgatttaattattattaataagataaggctaaaaggtgaagccttatatgaaaattgtttgggactatactaattgagaaaatcccttatatacccctgaaattttacctaatctcttctatacccctgaattttgcttacttccttgtatacccccaaaatttgattttgatcccttgcatacccctcccatcagttgaccgttagttgaccgtctattttccataaaaatgaccattttacccttggatgaacaaagaaattcatgaattacattattaaaaatataaaagcttctcgcatgagactattatagttatgagtttgttgtgcgatgcattatttatcccaaaaatatttttagatcatgaaataaaaaacacgtatttatttttttaaaaaaagtcataaaaatgaggagcattcatataaagataggactaccaatgttcacaacattttttttatgaatgctcccgataaaaaaatccattgtcctattaaaatttgaaataaaaattttaatttattacatttattttattttcaaaatttatgtcaaaattttctgcactaattatttagtttcattagtcttataaaatgcacatactgtgcacccaaacaaaattttttcaattgttttttaagcttatatttaaacctaaagcatctagggcaaaaaggatatttgcaaccaaacgtaacagtgaaatgatggaaaatgtaacggtaggggcatggaagggatcaaattgaattttcaggggtatagaagggattgggtaaatttcaggggtatgaaagggattgagtgagttttcaggggtacacagggaatttactcataataactagaggtttcttataatagcactaacagttggaattgttttttaactggttatgaaaaaaaagggaaatgattttttctttttcttcttcccatatttttattttctttcagcctaagtataacattctaaattctctttatttattttacttttacattattaaatcctcgatggttaaaaatcttatcatttgtatctctaccgcgctctctgttttttccaaatatttgcttatcttctcagtagtcgaaaatagtcatgactcatgactacgagaggaccacatagttcacacactatttgaagagccacatgtgaatggagagggacacgcctccatatcttctattgcgagtagtacaccatttagatgtcacaattcgtagcctcatatgtataattcggaaaactatagctataccacctctcttagggcgttcgtagtgcaagaccctcctcaagtatcacgtaggatgagttagcatatctcaaatttgtttatcctataatgcaaagtaactctagagatattcttgatttttcatgccgggccctcatatttcttactttagttcttatgtttttcaaatttatagaatagtccaacattacactaaataccctaaaaattagaaacaaatatacaaatctcacctccctatcctttcccaattccctgcttccatatcctagaaaattggcgcaccatcggcacaccaacttatagctggatatatttactcatttagaaaaattattgttgttgttgtctagagtttcaaatgcagtagatttacaagaacctatttaatgaattttgaaaagactgaggaacgattaacttatagtaataaccatatttatgtaaagatttaagcgttgtaaaagaattaatacataaagcaaaattatgtataaaaattatgtatagtacttgcctatttgctttcaaacctttgtttttctcttccattagacagagtaattaacacctattattaattggtaagattagatcattagtggaccgaaaactaaaggatatattttttgacaagtctctctaagagaaatttcttctgctaacataccagtgtcacctactcctctctgtagtctcatatacgatactccctccatcttaaaaataatacaagctaatcataggtacaatcgaacatagttagagcaatattatcaacaaatagagtaatatggttaattagtgtatgcatggctaattaattcttctctaccacatttagatagccgtacttctctgctgtatattataattcaacttgaaaaaagttttgctaatgaaagattaacttgtttaagcgtctataagtacctttggacaaatactttggaagatgtgtcttttgaattagtataatttacagaatttgttaacctataggaaaattacgaaatttatgtaaggcataattttttaggctaatgactctaattgtcagcttaatatccaaagccagtctttgtattaaaagattactctttgtattaaaagttaaaaccagtcttaaaaagttaaagcatcaaaggtcttggaaatcaatatgtgactatgtgagtactgacatagtttgtgcgtataaatacacgtgaagaaccatgttatattttaatttttctagagacttcggaagggttacatatccaacttctatcttaatttttctagagacttcggaagggttacatatccaacttcttcacaagggttaggcaaggtgatttattgactcctgacttttcctgagagttaagtggacagaagaatgcagtttaattatgtatacgggaggacacgtggcataatttcagagtagccctggaaaattttgtagagtgccacgtgggccaatggcagcctggatgctgcaccctgaaatcgttatttaagatatgaatttttgaagctgtatgcctgcatgaccagaaaatagaaaatcaaaaatttccgttgccgggactcgaacccgggtctctcgggtgagagccgagtatcctaaccagctagactacaacgaatttatccgtcgatgtgtaaaaaggtctttcacatcacctagttttactttccctcacgtcaaactaccgaatatatttaccgttcttatatcagtagctatatttatgacgccatatttttcaccaaaaaatagtcgatatgtatttacatcgtaagttcttaaattacatatgtaattttagtgtatttataatgtaagtctcaaaattacatatgtaagtcccaaaattacatatgtaattttagtgtatttacaatgtaagtttcaaaattgtatatgtaagtcataaaatagtatgtaattatagtgtaattagtatgtaatcgtctatcatcacgcgatatatgtgtgaaaataatcttctctctcatggaagcacatgcagtgggaagcctgtgccgctgtgtgaccaataggcatgtataccgactgtaatcaacgaaaatttatggcgacataaatgtagcaaatccgtctcaaaaagaccaagtaaacatgtaggaatatcataaaccctctttaacgaaactttccgaaccaacccggcattaaaggggacaacaaagctatggctgtgttttcacaccaaaactaaaagtttggttgaaattggaatgatgtgacggaaaaattggaattttgtgtgtgtaggaaagttttgatgtgatgaaaaagttggaattttgaaaaaaaaattacaactaaacacggcctatatgtttgatcctttttcgttttctacacgatgcactacaggtctacagcaaatgcatcagcattcggtagcttcttcttcgcttcgttcatcggtttacgtgtcgaacagccagctagctgctcacaattaagcttgatggcgcacgcggctctcgtcagctggcgagcgccggcgcatgcgatgcgaggctgccgagcgagacgacgacggcggaaacgacgggggcttcgcttcgttcggcgcttgactcggatcgctccactccccaattcgagcgcgaggcaggcagccaccgggacgcgacgctgacttcttccgtaatcctttctgacccaatcccgttcgtcctcgcctgacgcgctcccgtccatccagccttgctgaatccaaggagttgtgcgagtggacattactgcacgctagccctctcgtagccctcgcggcttccgttctttaccccgctccgctccgctgcacgcacgaacgcacgctcgttttgaaagcgcgagaggacaagacggccatgcgcgccggagagcaacgtgtggttttcatcgccatcgcatcgcgcgtcttgttcctggactggagtaccatctaaacagttccgttgcacggaaagctttggtcctctggatcctcgacgcgactgcaagtgaagttcacagggtaggacaatgaccggagtactggaccgaatcgcggatttgtactcgttccttcgattttcgttttctccatgaaagaaaaaaagacatcgtggcacacaccattgtggaatagtaacataggaagacactaaccctttgcttccactgattgccaagccactgcattttacaggagaatacaaatctgcttcacctgcaggcccaaggaaaggaaaaggagaacactgcatgttttgtaagtattcagagctaatcacttcgatatcatatcatgaattcgggatgatgattccaatgaatactcccaaaggttggagatagggatcaagagcagaacaaggacagcaccaagatgacagaaaagaaaaaagaaggtgacagatagggggaaaaacttcacactccagtagagtatacgagaggaggagcgaagcaagaaaccaacacacgcctatgatctcatcgcctgccacgctgcctagtgttcagaacggaattgaagccagccagccgatcccccttgacttgtaccgtatctgtacgctgtactagtacagtactgacagtaccagctacaaagtgaaatggaaatttggaaattacctaccgaagtccaaacacgcacacacacagaaacacacagaaacacacaaacacaatgaacaccatgcatcggcagcacagtagcatgctactaacatgacagccgtagcaagcataacaaatgcttgatcaacaatgatgctggatacttggtcgctacttgatggtagtactaaatatgatcctgagtggctagctcgctagctggtaggtgtttattcggggtgaatggccatcatgtacataaatcgggggcgcacctaatgcgtacccatcataaccagagagatccctaaagcggttagttggaaaggctagctctcgcagatgctttgcttgcttgcctgctaagtgctaagctctcaacgagcatgcagcagctggtgcatatgcatgcctggtggttaaaattggcaggaagataatgtgaaggggaggccaggagtaattccagggagattaagaacaagatgaggctggatttggatgggcataattctgagagatccgctgatgagatgcatgcatgctggccgggcactcggtcaggctttgtgggtaagcaactaacgtgctgctaataagggattaatcgttgcctaaaccgtatcgagatcttttgttcccaccatacccagatcttaatttaatgagaaaggtataaaaacagtggtgcattgtaagtgactcttgtgatttagaccccggctgattaatctgccacttattactatcactgattccccaagccacactccaccctgtgttcgctttgttctcactggtctacccatcttcccaaccttcttgtcacctactctttgttcccatctcattctgagccctctattcagacatatctcacccaacttactgaacgcctgagctgcaccaaggtgtggcctttggatgatcaggatataaaaatggtggtttaacaaggcaaagctatattaaggagatccatcaaaagggcaatttgacagccatgaagtgtagtggcatcttccaaggcgggtaattttcagagctattgcattgagtacagcagcatcccacagtacattccctcgcatagaaagccatatggcacgtatgcaaaagccatttctgtatggtagcaaataaagatttttaattaggactaatctgatcaccaaaatagccaccatctcagcaatacaaccgctactgctaaaaactacgcactggaccacatgatggtacatggcaaaacattagactcatttcatcgaaaagaacaataggctcattcctttcatccgtactaacaattaactacaagcatcagtccgaaatcttccatacggttgggcttggttctacacgagcagtaaaagaaatgctgcaaatacaaccagtcaagaatacaatgagtcacccagaaaaaaaggggggaaataaaaggaaaacaataaacgagaggaagctggcagttccgctctattctaactccccacggaagcagcgctttcatctctctccgtttcctctgaaagctcgtatttttagctctcctaagctctgtgcctcatcaagctctatccaagctctcgccatggccaaaaacacatgcaagttctgctaccgccgtttgggaaacccccgcgccttcgccggccacatgcgttcccactcagtcgccgcctcgaggtcgcagatctcctcgacgtcctccgcgtccacatccgtcgcggtcggggacaacaacggcggcgggtgatgccaagaggcccatccagggatacgtgctgcgggagaagcccaagcggagggtccgcctcgccgagtccgacttctcggatcgcgagagcgagacggagtactactcctcgccgcttacggcaagcgcgcgaacaccggatcgggcgatgtcgagcaggtgagctcggtgtccgacgccacgtcggaggaggacgtagcgctgtccctcatgatgctctcccgcgacacctggccagccacgccgccgccgccgccgccctaccgtctccgcggcgcaggctacgacgacgggagcgacgggggcgacgcacctccggctccggccgcagcggccgcgcagaagcggacgcggttccagtgccccgcatgcaagaaggtgttccgatcgtaccaggccctcggcggccatcgcgctagccacatgcgcggcggcaggggcggctgctgcgcgcctccgcctaaccctcctccttctcccgctacgcctctccagccattgccggagtgcgacggcggcgaggaggagggcgcgaagccgcatccgcacgagtgcccctactgcttccgcgtgttcgcgtccggccaagctctgggcggccacaagcggtcccagctgtgctcagccgcggcggcggccgcatcgggcgacgatattccagccatgattaaaagcaacggcttcattgatctgaacctcccggcgccgttcgacgacgtggagctctccgccgtttcagatcctttcctctcctcgaagccaggttcttgaaagcaagcagagcatgagagagcgagcatactggctgttcagtgctctctctcctttcggttgattccaaagaagatggttagagctatggattcgagagaaagagctgcttaaccaggcagccgaaaaggtaaagaaaatatcataaaaaggagacatctttgctttggtagttttttttttctcagttgttttgttcattcagctacaaaaattgcttgatgctgtcctccattctgttctgtctttttgtttgtttcaagctacccgaacagtgtacattggggcaactagcagagcttagcatcttgcttacttcttgatcataatctagcatgaaaatattccaccgaaaaacagagagagccacaggagaaaaattatagctgaactgttgctttctgttgcagtctccagctgttcttgttccaattgtccatggtacgggatttggccaaacaataggcgagatagtaagcagtgtagtagaaaagaaaagcaacaaaatggcagtaccaatgcaggatcagcctagtagtccctagtgtgttcatggttgcatccacatgcagggtgcagcaacagcggcattctgctcctgctttcttcctccctgcttccactgcccaccaccacgaccacctgcctgcccggtttggctgctgcatatgccgccgtgacggggtccccccttcccttctcacgctaggagcaaagcagaaaagaaagcctcgtactttgcctagtccattttgtccgtctcttgcttggctgctgctccgttcattcctctcactgggcgatgggcccccacttgtccggcgcaaacatatgcgctggatcctaacaaatcgtctgtctaatgcaacagaattgctgttcctaaactaagcatgcagcactgagaaaaaaaaatgtagaacttttagttgtttaaaaatgcttgggagaattagttggatctcgatggacagtttgtgtggttccgcagcaaaactggagctcgattttgcaggagctgctctcctcgtttggtgggcaggtagttataagcatggcccacgtctcgcgtccacgtggcaccgttcttttctcctcgctgggcccacctggattgcatcggcgtgtcagtggccactgactttgcgcggtgtgggcgttactgacccagggtgggattagcacgacaattaacgcagttaatcaggggttaattctcggttaatgagtctggccatcgtacttctctcccctgtggaagctgtgtgggcacgcatcccgaggcggatctcccggcgtaatcggttggtccacaccgagcagcaagacgggacaaggtattgatacgttggcccgaccttgtgctgtccccccgtgtccgtgtggccgtagcgcggggcgccgcctggacaaaggcagtggggtttgctcatttgctgtctcacgtggcgacacgtgatggatcatggttggacggctgcgatcaggtggcgcttacccttgcgctttttttagacgaagcaggtgatctcccttccttcttctcgcgctctctgcttgtacttttcttgccgctgttaagccgcacctaaattatcttagcaaaaaagtggaattcgtacaagaagcattcgttcacctcttttctttttacggggagagtggcagctcaggaaagaatcgctgaaaagtaccacaagtgtttttagcgctctcttttctttttttccccttcacttttgctgcgcgatggggtcactagcacgcaagactttcgtgagtcgaagagaacccttccaggtaagctaagccacggcatgcagtccttctgcaccatggttcacgccatagccgtcccatccccggctagaatttcctcgcctttggagtttggaccggtctcccactggcactcaaaaggcgaccggctaatccacccaaaactcgcggcactactgaatggtgtagtagcaatagcaacctttgctctacgatcttatccttctctcagttgttctcaccaatggtaaaccggttaagttgcacgggtcaaagcgactcgacggtaaattcgggcgatggtaaccgctgtggctatgactgttccgcgcaccgcgcgcgcgaagggggcaagtagcctgtacgattgactacggagtcgctgttgattgggtggtctagcttacgcaccggcgccactggtggctgtctggtgaatcccacgcccctgaacagagcgcgcgccgcgggcagtttaacgaccatccgtttcgcacttgcgtgcacagtgcgcggcgtcgttcgtgtgcgctctggaggaggaggttttccgtaagaagaggctcagaataacgctagtcgtacgggctcgatggctccatgggttcaccaatggcttaattagaggctggatttacgcataatgcatgcatggtgcaactgaggcgtggaagaagacaatgttctttttacctttaccacacgcttatacccggtagagagagacctgatgcaagttttggtttggtttttcggcaagctagaacgtacaagatcgaacataatatctagatcaatagatcgggttgtacacatccccgtgagttgaatgtaatcgtttactttctccagtatccctgtcccaaaaaggccgaggtgtgtaataaataccaacagctagctcgcgatcgaggccctgctgccgctgccgacgatcgatcgggcatgtgtattatggagcagtgtggtactactatactactccatgcgcacggaggtgtgtgcgcatcaatgagagctaagtccctctcctccatggagctagctagcacagagtggtcgctgctaaccgtcatacacacgaacgcacagatggatggatggatatatgcatcctgaattcttgaagtttttggttggtgcagctagggcctgcagactgttgaggagctactgttagtaggactggaagatctagcgtactccaagtggcacgtaggattcttgcttgcttctgcagccaagccggccctctctccaatcttcgtctctagatctcagtatctcacgagcaagtgatcaactagagcgaacttggattccctcacattcaatatcataaaaatcctagagggaaaagaatagcctagtgctgtctctgctacgtggaaaagaaaacatactgtcaaggatgcacgaaaggagtaaaaggcacctttgtgggggctaattctgaaacttggcttgtaagacattatgtgtatgccctatttttgtgctatcaaatctgctacaatgaatgcttgttcttgcccgttatcattttttagtcagatacatatgctttaactgcgttttaactgtaagcagtaaggatagttcactggaagtctggaaatgaacatctgaagccgagtttttactgtccttgagcaactgcagtaccaaatcgtgactgttgattcgagatcatccaacggtccaaaaggcgtcggtacctcatggtaccgcacctcccattgacgcggtaccgtggtatggagggtagttttgtactttcgcgttgtataccgattcacggcttcacgcacgcggcatctgtttcttcgctgtttcgcgagagaggaggaagcgctgggctgaagcgagagaaagaaccctagatggcggcgggaggaggggcatgtagcgaatcctggatcagcgactcgatggcggctagatcagggatgggtggaggtcatcagcggcaggcccaaatcggccaaccgtcgggagctcgaagatggttgtggcggcgattcatcgacgacggttagggctgtcaaaaaagctcggagctcgcgagcagctcgagctcggctcgtcgcaagctcagctcgagttcgactcggcaaggattcgagccgagctcgagcttgtctcgaagctcgcgagctctaccgagccgagctcgagctattcggcagaagcttgaaattttcactcccgctacctatcccaatttctcccgcactccaattccaaaatcctaccaccaacagcagtccatcacctaaccatttatttcccttatatccccatcccgtatccaaaccctagctcatttgctctcttcctcgaaacatttctcttctagatctacaatcctaggctgctctagtgctccactgaccactgctgtggatctagccaagcaccgtccatccttcgcctctcctgtccaggaagaaccccatggaggacagcagcagcccaccgcctccgccgtgagtgacgaaccgacgactcggatctgagtaagtttcctcttctttctttgttttacatttttatttcttttgcacccacatgtatctagggccctacatgtattaattgtgtagtgtttagttgcttgatggatgttattgatttacattgaattttatggactaggtggagacatagagtagtacttatcttgctgtcctcctcttctgaagaaagactgaaggttgcagaacaccgtgtgtttgccatttgccaaggtaaattgatggcaatgcttttcttgttgtacttgtttgattccttaccttgtgcagaatatatattgatagcagttggtatttttattttttgtagatgtctgtaaacctgcaaagacagctatctatagagatcgagtcaccgagcaatagggatggcatagcagcaacagaagcacaaccgaatcagcagctagtaccaggtgaagtaaggggagaagagggccaagagggaaacccaactaaagccaccaggaaaaagaaatctccattgtgggatttctttgaagaatgcactgtgccatcaaagaagaagaaaggagaaatggaaaataaggtcaaatgtaaggcatgtgaaactctgctcaccaagaatagtagtggcactacaacacattggcggaggcatttagagcagtgtgattatcacaagcttcaacaaaaatccataaaacaacagaatatcaatttccctagccttgatgaaggtgatgttgatcttgatgctccttgtgtttctgtccctggttattatgatcctacaaagatacgtgagcttatttgcaaaatgatcattgtccatgagttgccattttaccttgtggagtatacatggtttaatgttttgctaaagaggctaaacccttcttacaaaaaggtctctagaaataccattagaagtgattgtatgaggctttatgaatctgaaaaagaaaaactgaagaggactttcaaagatgttagaaagataagcctcacatgtgatctttggacctctaaccaaacaatttgctacatgagccttgttgcccactacatagatgctgattggtcaatgcattgtcgtgttattaactttcttgagttggagcctccacatactggtgtagttattgctaatgccatttctgattgtcttgcttcatggagaattgaggacaagatagctagcatcacatttgacaatgcctcaagtaatgatagtgctgctaacctgttgcttgccaagtttacaaaacgtggttcactttggttttatggaaaattccttcatatccgatgttgtgctcacattctgaacttaattgtccaagatggtctggctgtgattaagcatataattgacaaagttagggacactatcaagtacatcaagaaatcaaacaatcgagcatacaagttcagtgctgatattgattctctcaaccttaaaagtgacatgggtttggctattgattcctgcacaaggtggggctcaaccttcaaaatgctgcaatctgcatttttttataggtctgccttggatgtatatgctgcaggagatgcaaactataggtggctgccaacaccagaggaatggaatctatattgtgaagtcaatgatgccctttctgtcattcatgcagccactgaggagttctcaggttcaacctacccaacatctaaccttttttattctcacattgtcgatattaagagagtactaggtcagttgttgaagtgtcacgccccgagctagtcctgactggaattagcccgtgacgctccaaattaacctgttaatcgataccagtcccaggaaaacagtgctggtatcatagagagacagaatatcacagcaacagaggtctctttattatagagtagaagtacagtcatgttgggctgcggacagatcccgagctcacaactgcattacaaaagggaaacggaagccagggcttggaccaaacatcataggcgcgacttgggaactaggtcgaaaccctaaaactcatcgaagccggcttgctcctggaagaactcttcatcagcaggatccgcttcatcttcttcagcaactgggggggttatttatatagagcaaaggtgagtacaggagtactcagcaagccaggggaaataagtgtttaatgcaggcttcaaggaaaggctgttgttttcgtaattgattttatttgaactcttttctgaaacaactaagtgagtgcttctcaaacgacacggatgagacagtgcgtcttgtccgaacggagtatgtgcaatgtatcagtctttagattttgaaacaaggttggcacccggccaacagcttttcaacggccacccgggccaacaacttttcaaacggccacccgggccaaccactttcaaacgcccacccgggcctagctgatcccgtcagctacagatttttcaaacatcaaaccccttttcacaacagcaatttcacaagcagtagtcaaacaaaactacgctaagaatcacctcacatccgcccatgaccgtgggcacggctgttcgaacagttagttaacctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggctaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgtttggatgaaattccaaggaaacggtccttaagtgcaagagcgg

SEQ ID NO: 29067 - DNA, 6095 bp, Oryza sativa
atactcgcacagagtgcacgaatattgaggcgcaactgggtgggtaccaggggacatggtataaccattaaccaaaggaaggatcaaatgcaacaaattaggcaggtccgccaatctgccttgcagacgggacaaccgattaagtgcgatcctatcaatgcataatattttgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattaggtagatctcgagatttggggaattttggaagttgaacggagtcaatcggatttacggttgggaagatattgaatttctaagattattggatttttggtctgaaggaaaaaggatttaggcccgggtggccgtttgaaaagttgttggcccgggtggctgttgaaaagctgttggccgggtgccaaccttgtttcaaaatctaaagactgatacattgcacatactccgttcggacaagacgcactgtctcatccgtgtcgtttgagaagcactcacttagttgtttcagaaaagagttcaaataaaatcaattacgaaaacaacagcctttccttgaagcctgcattaaacacttatttcccctggcttgctgagtactcctgtactcacccttgctctatataaataaccccccagttgctgaagaagatgaagcggatcctgctgatgaagagttcttccaggagtaagccggcttcgatgagttttagggtttcggcctaattcccaagtcgcgcctgtgatgtttggtccaagccctggcttccgtttcccttttgtaatgcagttgtgagctcgggatctgtccgcagcccaacatgactgtacctctactctataataaagagacctctgttgctgtgatattctgtctccctgtgataccagcactgttttcctgggactggtatcgattaacaggttaatttggagcgtcacgggctaattccagtcgggactagctcggggcgtgacatgaagtccaaagacccaattcttaaagaaatggcaaatgcaatgcttgaaaaatttgagaagtactggggcccagaatgcaatactttgtttgcagttgctttggttctagacccaaggtttaagatgggtatgattaactacacattccctgctttgtatgaagaaactgtacttcctaagaaacttgcaaatgtggaatccacattgaaatctttgcatgcatcatatgaaagtgaactccagagcacatcaaaggaaaatgatgccaccactcaatctactagtacatctctgggcactactagtagtcatttctttgctgctagccaatttcatgagtatatgaaatcaaagaatgctgctagtcttcctaagtcagatttaaagaggtacttagatgatcctgttgaggatattcctgcaaaaagtttcaatctacttcagtggtggaggatgaatgaattaaagtatccaattgtggcaaagttggccaaggatattcttactattcccatcacctcagtctcatctgaatcagctttcagcacagggggtcaagtgattagtgattatcacagctctttactcccatcaacagcacaagctttggtgtgtacatctagttggattagaggaggccaccacaaaagcacatatttagtaagttcttatattttcatgtttctaaccaattaatagagatacacaatctaataatctgtgtttacttgtttgttgcatactaggaggatgatactaattctattatccttgtcccaactcaagcttcaactgcaaattcggttgtgggcagcaattagactcgtttgtcaggtatatgtttgaggttatataaattatctattgctaccatatcaattcctcatcactgatgaaacattacctataatctttgcacatggtttcagatttaactttacgaaacattaatgcaggcatatagtatagcatcaacaattagtttgaagaaagtgcttggaggtttcacattggcgtactgccattgccaatagtggagtaaatattttgtgacagttgaaatttgaagtacgctgtgttagtagtataagtaatatttagatattagagcttttagatggaacatatgttgggaacttccggtgggctacttttgatgttaattgatgctctatgttctgtcaagtcattgacacatgatattgtaatgtttcttatggtgttatacacaccggtctattataaagtagtaattctattatgacttatgcactactatgaatttgtaatctttctagtatatacctgtcgagaagctattatattctattatgaatttgtaatcctactttggcttgttaagaagcttttattgggagataagttcagattgctgaaggaaacagtcttaacgagcttctacgaatcgagctcgagtcgagccgagccttgatcgagctcgaaccgagcctaccttcaagctcgaaggtaatgctgggcccgagctcgagcctgtaccgagcttgagcttaggtaggtaagctcgctcgagctcggctcgttgacagccctagcgacggtgagctcggaggtttctatgctacatcggcgagctcgaagatggttgcattggccgttcgtcgggagctcggcgatggttgtggcggcgtttcgtcgggatctcggtgaccaaaagcgggagggagataggcagtcttcagtcttcactcgttccctccagcccaggcgtcgccgtccagtgctgcggctgcgcgcgtccgtgcgcggcgtctcagggtctagctcgccgttgaccatgcagcccccgaacggtggcgagcgggggcacggcaatccgggtcgccgccgtggatcttcaaggtatgtgtgcctgctcccgtccttcttcaaggtccaagtgtactgcttcgaggtccttttattcaatcagtgcttttcgagttttatgatttattcatgacaataccagcatggacaacgttccgaggggaaaaccagtcattttgatttctgacagtgaagatggtaaaccaaattctttttcctacttattcatgtcctttcttctttgtttcgaactaaaatggtgcttacaaaccaaaaacacgggaaatattattgtagatgatgatgaagttgctaagatatatcaaagcgtgcgcaagtgctccattgaaagaggtgattattttcatataaataattaataagtccgaatgtacagaatgttaggtactgctagtcagatgatgtgcttgtcaaacttccaatttcaggtcaatatggacctcgcaccttccctggatttgataggtagtactggtatgggactgaacatgcagtacaaaattgctcacattgctgtaagcaatttgcctaccattccactctatgtgtatgagatccagatgactaatttgacaaaagggaaaatggtatggttcacaaatctgactgccctgtatttgcatttgtttatacataaatgtcctgagtctaaatgtcttgtttatattttttaggccttcagtttgccatttagcaagcagtacataaacaaccacctttcaacaccaattgatgatttacttgtgactctggttggatcagctgaatcctttgagatgagactgaagaaatccaaagataagcgggctacctttacaactagatggaacaagttggttcaagccaatttattcgagcttggtgatgtttgtgtgtttctgttcactgaagttgatgatgacctatgtattactcttgaggttctcaactagtgtaatggatgaagaactttgatgtgccccctcataatgtagtagtatgccccctcctagtgtagtatctgcaccttatgtaatggatactatgcagcagcttttgttcaactttaatggaggccatgcagcagcttatgttctaagttaagacaatgttattctgatgtaatatatttatcatctatttccctaaaattacctagttgtttgcatcacttcaaatctgatatggcaagtgtacagtttttatgctactggagttgttgattgttgttggaatcactgctacaaaattaaaatggctgcccgttctgttctgaaaactaaaaacatgctacggaagcttcatcttgattgttgctggaatactatacttaattgggctgaaaacacacagaacagaagcagctggcatgaatacaaatgagtttaagaaactttagttggctggaatacaaatgtaaggtgcacacacaagagcgtcggacgatgcaggaacaacagagaccacaacagcaggaagcgacgcccgagtattccggctggatgcgacggtggatgcggcagggtggaggcggcgattttgatgcgcctggcgtcgtcgtggatgagtcgatgcgcctgcggatggctggatgagacaacgagttcttgcgacggcgggatggatgcgccggggtggaggctgccgctgtatgcgacgacgggatgcgccgctattgacgacgggatgcgggttggacgtctgccgcggcgtcctcgacggcggcagacgcgtgttcgacgcgcggccgcggtggcgtcgagggtacgtcggccgcgggggaatacctgcgatgagacggcggctgcggcggacaagatgagacgccggcaacagatattggcgcttggcggccgccgcagactattggctgggatgggcggtgattaacgctaccctaatttgtttagccccatcatacccttcctaaatcaacggtcagattacattggtacctcatggtaccttcttaaggatgggaaagatgctctctgaagccaaatctcaacagcaagagcaagctgcttgtagctctactccatcgagcatgctttatggagatttttagtggccggagctgataacatattattgcactcagggaaataacatcgatagtgtgactagacaagtatgcatccaacgaatcaggttggtaaaagacagatcaaaagtctacggcataagtgcctcttatcttccttcaagttggtaactggtaaaggttaagctagtaaccaaggacttagcctcgactattacatagatgcagccattacagatgaagtcatggaggggatatttggatgtcatggagctagttggagaaagaataaataagtagacagcatgttttctgaaaaccaattaagggtttctcttttgatgggtagccaagaaggctagcctttcttcaagcatggacggccaaatttaaaacttacagttaattaatgtgacatctcaggcttttaagcatatggtaaagctcctgtaactgtaccgttggttttacacttgtaggaaatgttgaactagttgctatcttacagttttatcaacaacctgcaagtcaaaattaaacactggttatattccagcagagcgaaactataagttagccaatgtcggtgttctgtgtgctgcttgttgtttacgaggatattaccaacatttgggaatatatcaagcatattttgctcactttgcccataaaagctcaactgatgccatgccgaaaggagatagcttgttctacatcattgccccaatgtcacagaacaggaaagcacagcagaggcacgaagcatcaatgagaagagttcaaaaaaaaaaaaaagggagaagaaaagacagagaatcagtttgtttttgcttgtccggtagccatcagtccctacttccagccactaacaacagaagagaggatggtcttttcagcagccagcacccacgaattgactaggtgatcgacgatcactgagctgcccatgtagggatggcaattttaccatgagtctgggtatccatggatacccgacctgacgggcatgggcgtgtgtgtgactttttacccataggcacgtccgtccaagatccgaagatgttatgggcaataggtggg

SEQ ID NO: 29068 - DNA, 26950 bp, Oryza sativa
atcgatcgctgttgcaacttgcaagcagttgaacacggcaaactaacgcatgtgcgactttggcctgacatgcaagccccatttttgagatagtaagtcaatagcgagatagccacagcttcactactgccactaatctttcgtgtacgtgaattaattctcaggttgaattttgcatgggaggatgaagatgcaagtaaggattaatggaggcttatacccgtgtgttaatggtgttctgttccggatcgggtggctgcgtgtgcgcccgttccgtattgtgtttgtgattagttgttgcgccgctatggtacaaagcatgaaaagttaaacgaaccaataaaaataatttataaataatatttttccaataaaaataatttataaataatattttttctaaacaactaaaagtcagcaataaaaaataaactacgaaaaacaaaatcaaaaccatcatgctaaaattaagttttaaaacatagattaacttttgtcaaagttgacttatcttgggccttggcccagtgatcccatcacatgagagctcagaaagcccaacatcaagaagcccacaagaacaaccactaccttcccgcagcacgaagccatccccatcacctccgtccgtccgacccacccaatcgcccaccacccacccaccgccaccgtcccgatctccggccaccgtcatgccgtccgccggtgccggcgccgccttcctactccgtccaatctccggtaccacccaccctctcatcagcttatcctgtaccggcgccggcgacagcgcgaaccacaagtctcaccttctcttccgcctccaccattcgtgccgccgcctgcccgtgccccgcctctccctcaccccggcccccaccggcagcaataattctccgccctcgcctccgccggcgtccccggagcccccgccccctcccttctccaggtggtccccgccgcgcgcgatctggcgggggctctcggcgctgcttctcgcggggcaggtcttccaccgcgtcctcaccggccgcgtccaccgccgcaacctcctcgcgcagctccgccgcgtgggccccgggagcgcgggggtctcgctcctcaccgcggcattcgtcggcatggccttcaccatccagttcgtgcgcgagttcactcgcctcggcctccaccgctccgtcggcggcgtcctcgccctcgcgctctcccgcgagctctccccggtcgtcaccgccgtcgtcgccgcgggccgggtcggctccgcgtttgctgcagagctggggaccatgcaggtgtcggagcagaccgacaccctccgcgtccttggtgcgcagcccgtcgattacctcgtggtccctcgcgtcgtcgcttgtgtgcttgcgctgcccgtgctaaccctcatgagcttcgcgctcggtctggcgtcctcggcattcttagctgattcgatcttcggtgtcagtaccagcatcattctggagtcagcgcgaagggcgctgcggccatgggacttgatcagttccttgctaaaatctcaggtgtttggcgccattattgctgttgtgagctgtgcttggggtgtcaccacccatggtggagccaagggcgttggagagtccaccacatctgcagtggtcgtttctttagttgggattttcgttgcggatttcgctctatcatgcctgttcttccaaggagctggtgattctctcaaatatgcaatgggttgaagcaggaacgcagcagagaaaccttttggcttcatcgcagcatagtgtagtggtgtacattgacatgtatggtgtagtggactcgaagtggtcggcgtttcaacatcagccactctcaggtgaaatgaatcaatgttcttgtggcatccattggaagtcgatgctatgctttttgtgtgttgtgctaaattattgctcaactttttgcttctatttcgtgtataactttactattacttcagaaaaggaaataacactacatatgtctattttggctttctaatgaattgttaaattctgatactccatcagtccaatttaagaccagcttaagcagcgggtgtaagatacatattgcttgccatggtgtttagagaaaaatcacccaaaaaaaaaatcaggagagcacacaagtttcataagctcggtcttattaagaaagcgaagcagtgaatgtaggagagcacacaagtttcataagctcagtcttattaagaaagcgaagcagtgaatgcaatcttgctatctgagctttttagttattcttggatgagaagaactgcagtactttttgtcaacaaatctatgagtgtaaaacaaaagtgtttgttgaggcgaacagcggttcctctgactttctgtatgagctggcaagtgaaacaaaagtgctagatacatgaagatggtaagcaagatcattaactgttcatagaccatgaatctgggcaccgtagataatgatatttcactattatatgatgacatatgcagggaccctgtcagcacgcaggattggcaagccatctgagcatgtgaggtaaatccataccttattgactgtatttcaatcatgtggtctgcttttattcttgcacctttgattttcaggcttcacttgatgaattgataggaacaattttgtgaacttttctgatatattgttatctgacatggatttgactggatcaattttgtttgctttgggggacagttaaccttaactttatgtgaactaggattgaaatgtgggttgcatgccccaacacatctctgaatttatacactggacctagttagcttatgcattgaaataattgaggaacatagtttcgttttcaacatgagagaacctaaatttcgaaggtatggacaccaattctataatccataacctaaattcatgatataccagtgtataaattcgaaacttatgcaatggctctttcaaagtctgacctaaatgtatgatataccagaatagacagctaagtttcaaattcacctaaagtactttgaaacttagtctcaaattcaaattcacctaactagtggtatatcatacacctaaagtactttacacctcatgcaatggacacctaagtttcaaattcgaaagaatctaaattttgaagctatggacacttgggtttcgaatttatacactgtatctccatcatgtgtgcccaggccagggtagcagtgactgacacgaagaatgacggtgcctatctgcatcatggtgaatattggtgctgttggattgatcattggtggcaaaactggctctcagcgtcacatacctatatataagtgactggttgaaatcataaagaccaggttcttcaacataccttgtagattttcaatctaatgtttgtgtaggtagattttcaatctaatgcttgtggaacatgcacttctcaaatttattaaccagtgacttgaataatcatttggcattaaaaactgtttctgttctccaattgagtctgacttctgaatttggtatttgaactggcaagggtcgaagcacctatgacatgtgtagaccatgttcagtttcagaaaagcacagccgccgccaaaattcaagcacacaggaactgtcttactacttactagctgtgtttctttatattttagctattgtcattacctggcagaagtttgttgtggtattatattgatgtgatctttttgaatgaaaacgactggtattgccatgtggtagaaacggtcaagcagccgtacatttgtttctcttgctgttgcttgtgttctcatctagcaacacgtgcgtttgtgggttcacctgctgaagtgctaatacttgttccgtggattatacatctgatcgagttttatctgttctgtactcgagtgtagtctacggttatacgtgataaaaatacgcagcttttcacttgttgagaaacaatcatgcaaactgtaaatccaaggcacgatggaagatcataatttttttttaatggaatgcccattgaaatgaaagctgctgaacaggtgcacatttgtattgcgtatctacatctcatcctcacataaagcggctcacggctaagccggtcagcactaacttattcactctttatttactacagtatgcttcataattctggtaaaaaaaatgtagatcaaacaaattgtgccttgctctgtacaccggtagagcacataaggttcatccacttcttgtcatgagagcaacaaagagccgtttatgacaggaagaactgatgtaactttgtcgacaactccgggaacacacgggttgggcggtatttgttgtcgaggcaaacggcggttgctttggcatccactacgagctgggagaagcagcagtaaaatcattgtgtgagatcgatcgatcaccattagctaaaattagagaaactttactatgcttgaaaagtacctaaagataattaaaatttacactaaattatcccaaggtatcaagctttacactaaaaagtataatacctcttaataaaatcacctctaaattaacagagaatgaattagctgtagaatccctgtgtattcatgcttaccttacgatctggcagcgtctcgatcaaatgttcgacgattattctcacacctttgatcttcacgaccttcatcctgacgacgaatctatcatccttctggaaataacgcaaggcaaatgtttgttagattttctcggtgtgtgtgccgtgaccataaaaacatgaagttgatcaagattgggagatagatgtccaaaatagtaataagtaaaacaagaaagaagatgtacccgtaagggcgtgtagaacttgaggttcaattctgaaagagccagcgcgttgcccgtcgacgtccagtagtccacgccaacgccgacattttcaaggaaaacgtcacggcctgatacacatgaaacgcacggttcagattatttataacaggtttagcatgcagatgcttcagttacttttggagatgtattagcttaccactgtggatgtagctggcgtagatggcgttgttgacgacgccgtactcgtcaagctcgtcgtcctggaccgtcatctcgacctcgtaaaacccgtccttcgtcctgagagatttcataatacccaaaacatcagagttaattttttttctctgaaatatcaaaagatcaacaatagaaattacaatctccatttttaaatgaatttatgatgatggtgattttagacatgatatttgatcatttattttatttaaaaggacttttatgtaagtaagtattatttattctgtggggacttgttttaacattaattgtactttaggtatgatatacccttcgtttcaggttagaagatgttttgattttagtaaaagtcaaactacttcaaatttaactaagtttatacacaaatatactaatatttataattacaaattagttttattaaatcaataattaaatatattttcataataaatttgttttgagttgaaaatattattattattttttctataaactagattaaatttaaagcagtttgactttgactgaagtcaaaacatcttataccctgaaacggatggagtattttttatattaaaaaattgagtaagatggtaaatatcaatgtctgaaagtttacaatgtcatgcatatattcaaaaatgaagtgaggaaattaatgattaatggagtagattggtgaaatgatctcgatcgaaggaggaccttgagccgttctgctgttttgctgacttcttggcgggagcataatcctgcagcagctgcaggctgggattcgaggcagcaacgtggacatcctgaagcaggctggattttgcggcatcgacgacgcggcgagtcgtcgggtaggcgtaccccgtgacctttccgaggctcgcccgccggcggccgaggggcaccacgcggcggccggagccggggctggcgatgctgccggcacgggcagggaggcagtggctgctgcacagctgctgctgctgcattgtgaattcagtactagtatctctagctgctatatatattcaggcctcaggctagcttatcgccgcctgaactgtgtgtgtgtatcaactgctagtgtgtagtagaactcacgttgcaatcggcgagctgatgaagcgattgctgtgatatttccctcatggcggtgcatgcatggcgcttatataggtgatgatccgtgggacaggaaaggacaggtgattagctgttcaacgctgcacacgtagtttttgcaacggaaagtccaatccggcgtgtaagctagctaggtgattaccgttcttctctctaccctcaaaagtctgagtttgctcgcatgcggtttttgcgttgaagactgttcggttgtatagagcagagtacgcgcgctggattttacctttcctggtcgtcggaccggtcaccatgagacaacggcagagaatgaactgggcttccatatgcacaaaccacagtgtagtggcacgtttcttgaccagagtattggggcgccgtcgctggtggcgcacccagctaagtgacggcccatgggggtcaccggctggccggccggtcgtcgaccgttagggctgatacgatattgcggtgatggagttgggaagcattaaaatactgttactccgatcctgacagtgttgatttgtcaggttggggtatgtacagtgggtctgtgagatatcgtatctaggttgcgtcatttgatctttcggaaacagtctgcacacacgcagattcttagcaattgccatgccttactataatctgaacacacaaatttgcaacgtgtgaaattcatatgcactctgtaaaatttcacacacacaaagaggcatatactacatgctaaatgtgtgcatttttcacgatcgcgcaaaaaaattatacgtctatattagaaggaaattcacatgtgtgcatgggacaccgacatctaagcctatatacacgtgcaaagggtaaactatgacagaaatcattttaaatcccctcgttagaggcaaggcctgcaccgtgacaaatactattttaaatcccctcgttgtttgcatgcctcttgaacaggtataaaaaaaatttaagaatgtgtattaatatattatatatcactccataaacataaaatttacaattcaacttctacatgtcgcaagacaaaacaaatttagtaatgtagaagttgagtcaaatttattttttccgttgtgacatgttgaattctaaattggatatttgtagagtgatatatcacatattaatacatcttcatattttttaaaaaaatcgtaattatttaagtgatataattaacgcgagactttaaaatccactccggtgcgtgaggacattatgatcgagttttgacttctgctgtaaaaaacgtgctggtcctcatcgtcgaaaactagccacacgcttattcgacatgattattttttatgaaaaatgctgcaaacaatagtgatcctatctttcatcagaaggaggaaaaaataagcataaacacgacaattcctctgcaccagagagatgtttcaaaaactagatactctcgagcaaacaaattcccgctcaaacagtaaaggtttttaccatgtactggtgcacgtgccacatacgtcacatatattctgataattcacacttagtcacagcaccacttaccgcaatttgacaaccagattagtaataacatttttaaatggggaactatgccacgagcaaaattcaaggaagagtggtgtattttctaggttgacctatatatgatgatgtggaaatcaagcacacaggaaaaagtttcgtgcgcgcacaattaatttggctagttatctctttcacctgacgcaccctacgcagtaatctgacattaattatcccattgttagagtacttagtcggtagctaggttctgacaggagcatgcattatgacagcgagagttgtcaaggtccatgcaatatatttatgcatgttaatgtggatttcaaaagaaaatgccgatatatgcacgtaacctatatgtttttctctaaaacgagcagaatcatttccttcgtttgctatttttctcttcaaagaaaagctccagctgtgtgttgcctacgtgtacatggacgcgttctcgtcgtcctgcctgccttgcgtgcgtgcgtcagaggccgtcacgttggaccaaccagctctcctggcgagatcggctgatctggaccgtctgggccatcaggcggagctgaaccgacggctaggattcgatgggggtacggcgcacgagggcagcagctaggcaggttccccattccgatgaatgtgatggctttacgacaaccccgcgcgccgtgaacggtggaacgtcgtcccgtccccccgatccggttcaacatagggcgccgcacgcacgagcagcagcggcacgaaggcgaacgagtggacagactggtcgccatcggcgggcggaaggggagacgagcggcaagccggcaaggtcgcctgcagggaaggcacatgccatccgcgcgcgcgcgcgagagagagagagagagcgtattgcggcgctccatgcgcggagcgcgcgccatgcccgctccatggctggctccggtcgggcgtgcgcggtgcgcctccagcttctcctgctagctccctgcagctacaccgcgcgcatcaagagactgcccgattttatccggggtgttttcgttcgacctagtatggatatatttcggatgggcacttttaaaatattggtcgacgtatattgtgattgatgaaattattatgaacaccttgctgttaacgggtaaatactagcacacatattctaccaacgctcacttcgctatttggaagcttttgcatatacaacttctccaagaactaaaaaatttttagaaaataaattagaaacttgaagatgggatttttagctttttcatattctcaggaacggaactatcaactaacttttttttgcgaattttaaactcccctaaatatagtctatatcaaactcctacacggctaaaaaggtataccaatgatgtattcggttttttttttcggctagtggaatttaatccaatcttaattggccaaaatttcaagcttatggtggtttcatccagggttcaacttaccgtcggtaaccgtgcggttaccgcggttaccggccgcgggggtacggtaatagaaaaaccgcggtaacctccttaaattcaaataaatttaaaaaataatttgaatttttgataaattttgcacggtttcgtacggttttttacggttaccgtgcttactgccggggcacgataaccccggccccggtggtttgggaaaccctagtttcatccattgcgaaatccgactttaacacaaacaagaccttccgagtgcggcagaccttgaatttcttttccggggagtggatatttaggaattcttgttaagggataaaaaggcactaagctttttgcggtcaagcggccatttggaaacatttctccccggcacggtacgttctcgctgatcctgttatgtgggttcatttagtgctttcgcataggttacctagtggatttgtccacgtaatttcgttctagatattgccacgtagtagcatattggcgaggctatccgaaatcgccatatgtattcggctgcgttcggtagcttttgattgattgcccgaactactaaacgatatactccccctggttcttggacaaggttaatgttaaccttttataactttaaccatcaataactttaaagatatttagtttaaagaaactagaaaaacatatatagatttgtctttcaaaacactataataaaaataaacatgtatttatttattgtatatattataataaaaaaataaggtcaaatgtatatcttgtagagcgtgtcattgtccaaagcgtcaattaaaatgaaaccggagggagtattcttttagaaaaaaatatagaaaagttactttaaaaattatatattaataactcattttcaaatttaaaataattaataattaattaaccatacgctaatgctaatggcttatcttgttttgcgtatcctcgatcttctcttttcctcgcatgtcaaacacagcagccattgtgagctaaccagtgaaataaaaaaaaatctgaactactatgttcaatgttagtagatgttttgaactaagaatgtgcaaatttttaactcaaaactgaaaattttgcataaagttaaaatttcgatagcttttttccattgggagatgttcactacttatactagtcaattggtgaacattcactctatcacaactagtaattggatgcctgggactgaaaggttcatccattgtggggaaagggttccaaaaaaccttaaaatttccttattaaataaaaacctttgaacccctttgcccttaactaaaagcccggttcttcatagaatatggtaacctagcacagaaagaaccagtgctcaacacccccccccccccccaaaaaaaaaaaaaaagtttctcacatcatatccatgagctcaacatagccattcaaagtttttgctgaatttggacgatgtattcaaacgttggaacgcgtgctcactccaagaaaatcaaataaagaatgcagttagatttatcacagattagaaatgtcactgaagtcaaatgcttcaatcaattggttcatttgaacaaagacaatacgatggaaaatggatacagtgatttatcgcaggttatgacgatgagtacagtgacttaactgctactgccttcagaagtgaagaactgcagcttggacaggaactctggagatatacgggtggggcggtagtctttgttcaaacaaaccgctgttgccttcgcttccaaaatgagctgctaggagaagaatatggaaaagtgtgatctatgcaaagagcagttgcaaaggaaatcctacgaccaatttgtgactgaaataacatatagatttcataagttggtactatgttgcgaaaaatgctagtacgttgctactgatggcattgtgccattgctgccaagatttgttaccaacatgattgagaatttgaaacgtactgtgcttttaattccttttcctattctaaaatctgcaattatttgtgctgcatacctcacgattaggcagcttttcaatgaagtgctcgaatatcatccttataccttttgtgctcgcaagcctgaccttaacgacgaacttgtcaccactctgacaagtcaaagaaacaaagggagaagttagacccaaatgaacctattatcaatatttagagtttgatctgttattagtttcatagtatcacatcaacatttttcagttctggttttttcacaacttgggaaacaaggatgttactctcaaaggcgcgtagtacttgaggtgcagttcagagagggccagcgactcaccgctgcgtgctactgcatctgcacttatgcctacactttcaagtagctcatgacgacctgctcaatttttttaaaaaataaatgaatccttaattttgtcagaaccaaccatggtaatcatattattttaattaaattctaaacatgctataggaatcatattaactgacctaattaatatacatgagatgttcttttagtttgtttcattggtagaacagaactcaccatgttggcagtaactagcatagatggcattgttgacaaccccatattggtcgagttcataatctcgtaccttcatctccacctcgaaaaactgatccaacctgaaaattcaaggactaacaacaatttcatatccagggcatcatccaggatcatagaaaagttgaacaagcgaggtatattgatcatgataccatccaatatctaaagatatccggactactcaggggatcatagacaaaagttttagccaaagactaacacataattcggcattacaatgcacatcacataatccaaaaactgaattcacaagctttagcactagaaggcataaaattggcacttcccccaaataacaccagtttagctgtgcggcattgttcctcccatccagtaagggtaccaggtattacattccaccacaaaccacaattccaactcttcctcagattccatgaatagcgatgaaggaaattcgacgagtaagtgcggacctcaagccggcgtgggggctggcggactgggcggagacagcgaggaggcgacatgtgcgccgggtggcgaggtgcgtgagcgcgagcgcccgccgtcgttgcggtgaagggcggcctaccgcgccggcgggcggctcggccggggagctccggcgtggatcggcgagagggcgctggggaggaggcgccaaatctggtggtgcattgcgctgcggcggagggggggactggtgcggcggccgcgtgccaacgtggtctacgcggttgggggtgggggcaaccaccagtccaccaccaccaccactcagatccgcattgatgccgatttggcaacactattggttagtttctctgtgttatctccggctctccgccgcgaaaaccaaacgcaaatttccaaatccccgagcccctcaacgcgtccgacgcagcggccgccggccgccttccatggcctcgtctctacctcaggcggccgtgagggcatatgctctcggtctcgggcagcacggtcgaaggcttcatcgtcggcgaggttaatccccaaaggttcgcaatgacgcactctaccctccgctctgcgctctgcttcgccgcatgatcctagctgttgcatcctctgcagccccgcggtttctctttggagcaaagatgaggagaatcaatacggtgataattcactaaggtgaaatccaatttctgcagtatttttggcattggggaactcgtggatgtagtagtagtactagtgtactccctccatcctataaaaaacgaatctaaaaccgaatataatacatatgaatctaaatatctgaatatatatatatattcagattcatactactaagatatatcatatccggttttagattcggtttttatgggacgaagggagtaaatatataacgagagtactctctggtgtggcctttttgctccttctcaactattttctcctttttcacacatgcttttaaactgctaaataatatattttttaaaatatctatagaaaagttgctttaaaaatatattaatttatttttaaaaattttaaactaataaatttatacttatgtgctaatccattactctattttaatgtgtggcaccaaaccaaacaacctattagttttcaaactacactaacgaacacagcgtgtgtaatttagggctttagggacagaggtagtatttgccatgtactgaggtacatagtgctgagtgctactatgcatcattggtctctaagccattgtataacaatagtatattttgaacatctagggtgaatacaatttttcttttcatatgggttttatcttattctcaaagacataactataaggaagggggataaaaaaataatctcataagggataggattaattttctatacttgacaatagggaatatattttttgtagaaaatattggcgccacactatcaataatagattgtttttccattttacccccttgaaggtccaaccataggtttttgttttctttttcaaaactaaggtgtttcccatgatggcatgatgggtgagaattttctgtagtgttagcttgatattaagatatctgtagtgattagatatttttgaactataattgttcttgacgtctcgcttctaagctaagggcattttaattattttctatagaaaagttttaattccataggacgtgtattgcttatatatatatatatatatatatatatatatatatatatatatatatatatatatatatatatatatatatataattttgagaacttcacaaagaggccaaacgggtcaagttcaatggaacaccaattatcataagaaaaatggtgtgcagaaataaagctcttaataatgtcaagagagattagaacattgttaagaacaaagcagcaattagcactacgccggaccaggtcatctctaacgggcccaaaccctcacctttgacgggtttggtcttggtcagtgattagtggtcactgatgacaaaatcacctgtgacggatgaaacacccgtcacagataacccatctctgaccggtatataagtcatctctgacgggttaaaacttgtcacccgtcacagatgagtcatcagtgacgtgtcgtaactacctaaccgtcactgatgactcatctctgacgggttgtaacttacgacccgtcactgatgacaaagcaagaaatacaatttttgaattttaaacgtatcaaaaaacctaaaaaaaatattttgaattttactagccatcctatacatggttacacatcactacctacaaattcacaatttttcacgcaatataacttgtatgctacacgtgagattcgaactcaagacctcaacctccatatagagctcccttaccaactcacctactcaacacatattgattactcatccaatgttattattttgtctatgcttgtctgaatcatttaacatatatttaacaccctaaatgacttcaaatgaaaatattatcaactaagtagttatagatcttatcgtgttttataacttttacatagaaaatatcttcatccgatgttgtttgaagaattcaaaatttcatttttcaaaatatatctcactttataacatgtaaattttgtgaaatgaaaatattttcaattataatgttgtagatctggttgagttctatgactttgatacggggcatgtatccatccatgtcatttgaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaattcgaggttttttgcaaaatttaaaaatttgaattttcactcatcactgacgggtcataactaccacccgtcagagataacattatctgtgacgtgtgttagttaaagacccgtcagagatgagtggtctcttttgtgatggttcataatactacacccgtcacagatgacatgtcatctatgacgagccatggttgtgacccgtcacagacgatctgtgacgggttacaagtgcaagccgtcacagatgacttcacatctgtgacgggtcctccctggtagccatatattgaagaggatatttttttggcccgtcagagattacttatctttgacgagttgcgttggcccgtcacagatgacccgtcactgaagcccggatctatagtagtgtaggatagtgtaagtaagcacgtccaacggaagtaatagggagaagacagccactgccaacaataatatgagagggggtattgtcggtggagctgtgagtagtgaagagggtaccggtgttgtgacacaatcaacagtatcgccgatgatggtagcaatgacggtgtcatcaacctgcaaacctagggccgtctggaaggaggagcggaatgcgttttatatcatagtcataaggaggagcggactgcgttggcgatgatcttgattgtgtcgtcgaggacagagtctatagggagttgggaggaggagaccagggcggcgagagatgtcggcctgccaggttagggtttgagatgcgaaaataagaaacctaatatgatatcataagagtgtgataggactcagcgcaatcgattgtaataccaatagagcggtgtacatataggctcgtacgttccgttatctccacaaccgatttatagcaacagtattgagagagatagcggaaaatatgtaaaaaaaataaataaatatgagatatacaaaatctaacaagttttataacacttgaaaaatagatatatttgttattttaaaacaacttttatatagaaagttttcgcacaaaacgcgccgttttgtaatttgaaaagcgtgctaacggaaaataagataaaatctttatctttatgaagagagaaaagtctgtattttatctggccttggtttgactttgtccttcaattagaagaacattaaaatgttcactattcatcccccaactcttataactgtctatatttcatccctgatccaaatcggaactcttagaagtgattggcgcccatagatgaaatatggtcaatttcaaaagttgataatggagaccgatcttatagtcgagggatcaaaatctactaaggtcatagttaagggatcaaatttggatttttccttaaagtaacaacaaaatcaattatatattcactattcacctcacatgcatgggtacatgtctacatgacaaagcttttaaaacagtactacatagctactatagatcttgtaaagagctgtgcttgaattctatagcagctatcattataagccggatcagacaaaacgaatgaacgaatgaatctaccgctatatactgcactagtcacttcaatactttatatttatcgtaatgttctattcttcgcttttgctgtactaacaaatgtacgttcttgtctccagtaaattaattgtggtgccgaaaaacggctttcagacgtcaggtgtaagccagtggaatccgttgacgaagctcttgccgaggaaggggcgcgcggcgaagtagtcgagctcccgcgcccacggcacgccgtgcaccgcgtcggcgccgggcccccagttcctgtacatcccgaagaacgccgtcctgcacgcatgcacgccgtcgacaacatttgcacaggcgttagctggctgggaattgaataatatagtttcatttttttatcaagttgatcaggctagctagctagctgaagcagtacgtacatgctcttgttgctggcgtggtcccagtcgtcccagccgccgggggcgatgacgctgtcgaagtaggtgtaggcgtagacgatccgcgagtactggcccatggcacggccgacgtagaggcggccagtgccggtgacccggcagttgacgaaggcgaagccggtgcgctcgcacgggtcgtgccgcccctgcgccgccaccgagccgaaccgctgcgccgtcgagtgcagctcgcagtccttgtagagggagcggccgttgccgaagacgaagtcgatggagccctcgatgtagcagtcgcggaagtagtgccggccggcgtcgtcgcagagcgtgtcctgggcgccgtagaacccgcagccgaagaagaaggccttgtcgccggagatgcggaacgccaccgcctgccacccttgcatgccgggcattggtgccggagccgtgttctgccaagccataggattcaggaacccagcgtcagctgttgtttgctacttacatgcatgcaattcactggaaaaaaaaagttggccggccgcgtcgatcaggctgtagcctctctccgccgtagccggaagaagccatctgctttggctgctccaagaacccgaaaatacatccctgtacaaacggattcaaaatatcaaaagaacaagggatacacagagaagaagagacgcccggcatgcagcatttgcaaatttgcaagatgtggctcgtgacactgaagggttttgtcactttgtctgcctctctgcctcggcagtcggcactgtactgcaccgcatctccctgtgcgtcttgtgagtcgcgtacgttggcggccgggtccatggagacggaccactggctaatgcatggcatggcgcgcgaacggtgtttgctagctcaccttgaagctgatgttcttagcagtgaaatagttagagagaacggttacggaggcggtgttgtaggttcggagctgctgcccgtcggggccgcggtcgctcgccctgtcgtgccactccaccaccgtcacgtcgcgccctgctccctggaacgtgatgtacggcttcgtcgccggcaccaccaccttctctctgcacgcacacatatatcacgtcagaaacgcaaactctgcacacgcatgcatgagcatgagcatgagctaactgggtatagcttacatgtaggaccctgcgttgatctgcatgatgacgcgcacggtgttgttctccggcacggagttgacggcctgctggatggagaggaagtcgccgccgccgctcgcgtccaccacgatccgccgcacgcccaccggctgcctgtactggtggtgcccgcgcgtcgggcgctcgcacggcgccggcgccgcctggcacgccagcggcggcaggaggctcgtcgcgagcgtcgccaccgcgaacgccatcaccaccaccacccgctcacgaaccatatcgatcggtttgcgtgtgtatcccccccgtgtatcgatcactcaaaagcgtgacaacgttttcgcgcgtacgtgcgtctttgtcactcaaactttcgctagctctcctctctatatctctctcttcacatgcacgcggaatatgtggtgagagagaccgagactgtgaggcagggggtcggaatttataggcctgtgagggggaagaaaccgcccatgcaaataatggaggagaagagttaagctataccgcccgacgggaccactccaaaagttaagctagctgctggcgctgcggccccggtttggaatttctgctttggtcggacgccaacggtcatgcatgcagctagctagcatgctttcgatcgctagctttcacctggtagtttagctaccgtagctaacgtataataattctgcgttaatgtttcagaaaaagagagatatttacggacactgatgagtgatgactgatatatcaaaatcatacaatgtacggatacctcgtccatatgtttattcactgagataccaggttgagttcctgcacttagctgatattttaacatttttcttgtcatagaacaattgcaacgtcatcgacggagctctaaacacacaatagacttaccgatctctccaaaatgtcgtcgcccagctagcttttgtgtataccccaagtacaattttcagtccgtagcatctgagtatatctgcgtaccaaaacccgagtcacatcgcgtatcaacattgcatcaaaatatgtgttggacatatacaccagcttttccgaatccctagacgcgagagagcgatggtcctgatataccgtgggccaacaccggatagagacacggcgtgtacatggataggagcgtaactgtgatcagagcatgcatggccaaccataagtctcccttcgctgcaaattaatatgccgtgaaacttggctagattacaaactggggacaccgagagatgccaccactacgcacgagatagaacagtacgatccctctgctaccttcctatcggttagctgcaggcttttacagtcacagcatgcatgatactccaacgacatatacaaggtacggagtatatagtatatatcactatatatactaatgcaagaagcctaattgattagctgggtgtctgcagtgtaccggtaggattaagttaaactaacgcagggaggaatgatccaagaattagcgtacaggcgcatcatgccgcgcttgctctcgcggctgcgcccatgcgttgcacagcacatgcagagcatatgtgcgtgcgtgccgtgcaggtaggtcgaaaccccctctcgcgttgggagcgcgcggcacgccgggcggcacggtgtaccccgccgcaagtagtaaagtcgaggcactttggatcaatccgtccattctctttgtagcggcgagtagatcacagcgttaaaaggctaacccttttcgtctctgatccttgttctcttctgtgtgttatgggcgcctctccctactaattgcattgtctgatatattacacggctctttagttgttgtctgctgctgatgagtttgaggaccacatggtgttgctaaaaattaagggcccctttaaattgtatagaaaaaaacgaaggaccagaaaaaacacaggattttggtaagaatgcaagtgtaaaacagaggattacaaaaacacatgaaaaatatagaaatgactgtttgattagaccgcaggaaaaatataggaatcagataagagagatagactcaaggaaagttttctaagaggttagagtggatgttaattttcctacgtttttgctctagaattgtaggaataggaaagtttcctacgtttttcctttttttattcctatgaatcaaaggcataaatagtgtatgatttcaatttctttgtttttcctccatttttcctctaattcaaagggggcctaaagcagcggaggtggaggtgtagcgtgtactggtagtatgtactctgagaaagtgagaataaaccttggcttttgggttgggattcatccctcctttatacctttttcgcagtgcaaattcagagacgagaaggtacgcaccatcggatcggcagctcggctttgacaaatccgtatcgtgtacacccatcctgccattcacgctccaagctagtactacgtccatttctgaacgccaaacgcatcggcggcagggcatcgttgtctgcagttgcactagctctgcagcctggtcgttctggaacaaccgaacaagtgcgttagttacagagaagaacgttacgttcttcgtgtcagactcacagaaccgtcgatgcagatggaaccgaggaattcttggagtagagcggaacagagagactagctagtccagtacatacggtggcgttcgcggatcggtcggccgggtgggtaaacgcaacggtcactttacgcgcgagttgggcggctgcatcgcccggcgctagctgtcacctttacgcagcgatgggccgatggctcggcgcggccttgtaccgtagtggcacagggcgtcgtcgtccccttgcgaaaacctggagaaaaaagacgggttttaaacgttggaaagtgtcgggcgggcggcgaggcaggcggcgagagaacgacgggtcgaagaaacggaggactctgagaaagaaacaaattcctaaaggaggtgcggctcgccggcccacacgcgatcgatctcatctcctcgtcctcggtgttgagggcccagagcaccagggtgctcgtccagacaatgacatgtgggactcacgagaaatattccgtttataggccaaggagaacagagggggtggggcttccgcaatcgattatctttcgcacgctctctctgtggtcgccggctacactagcggtagcagctagcaaacgcccaagtgcccaacgtggctcgagtttgcgttgccagcaatactaccctcccgccggccgccgcacgagctctcgcgccttcgcactccaccgcgctaagctcgtccattggccattagagctcgttcactcttcacaccgcacaggatcggcggctgcccccatcaatctcgcttgaattggcccggaggttatctatctatctattatattattaaaacagctttgaaaagagacaccatattcgctgtggggactagaaattcccacattaatagaagaaaaagaaaagaaaagaatagaagagtccaagtagaaatacaatctaaaaatagctaaaattcgaaattaaaacaagcaatattgaaagaagtttccatataagaacccaatacgagattaatcaaaattcgaattaaaataaataaaatctaaaattagaaaaaaaaagaagagtccaagcaatagaagtttccatatgagaacccaatacgagattaattaaaattcaaaataaaaataaaataaaatccaaaattagaaaagaaaaggatagttaatacaattttaaaatagctgaaattcagaattaaaaataagaaatattaaaagaagagtccatataaaaacccaatacgagattaattaaaattaaaaataaaaataaaaataaaacccgaaattagcaaaagaaaataaaagaagagttcaagtaggaataaaatttaaaattagctgaaattcggaattaaaaataagcaatattgaaagaagaatccatacaagaacctgttaacaaccaaatttggtaaattctatcactattggcatcggaggtgaagatcagatcaaagtggaatccaagatgaagatcgttgcggaaacagagtaagaatcgactgcagtccaaatcggctaaggtcaggttggcagagttcgagtcggacggggttagccgatacagccgattccgataatttgactcggtgtacgtcatcgggttcaagttgatgtgcttcaagatgattgccatgcatggatagagtcatgggaaggcaattatatctattaattaggatattctatgtaatttccttagagatatgtttgggcaaaagtctgccgtaaagacttatggtatcttagagtttgttagagataatagtcatgtctgttatggacgtatcttttctcgggtataatagacccgagccctatgtaaaaaggagacatccaatacaatctcggcgcatcgccaccctttatgctttacttttatttcgatgagttcgtgctctcgggttgagctgcatcggtttcgatcttcaacaagaggtaaaacttgtcatgagacttatgttctcaagattagtgcttccatctttatgacactctaatcttgtctatataattcgtcgagttatcatatatctcacataatctttgataatatcttcatctaacctataatcggctaacatctgttaatggaaggtagtcgattaggttagataatgatgttaacttagactatgtgatatatctaccactctatgaaacttccagcggcttgattgtctagatattgtttttcttttcatacttaatgctgcatcagttaagtttgatatattaagtcgtgcttagaattgcaatctctagcctgctttctggttgctgattagggtagtatcggagtttcagccgatcttatctgatttaactacttttattctatatgcttgattgacatgttaaatctggttgctgattagggtagtatcggagtttcagccgatcttatctgatttaactacttttattctatatgcttgattgacatgttaaatctgccctttatgttaagatcttgtcgcatataagtatattaagcttatgtttagtatattttacttgctttaaaatcttagtatagagtagtcgtgcttagaattgcaatctctagcctgctttctggttgctgattagggtagtatcggagtttcagccgatcttatctgattaactacttttatttacttgctttaaaatcttagtatagagtagtatcggagtattgccgatacatgctagatctacctgatcggctatgctatgaattggctttcataggtcatagactaccctcacagaccaacacatgtcttttctgcacactttgtcctcactcgtgtgcacccgggaagaatttccgggtcggtcacccatcccaaattgctccacgccaagcacgcttaaccctggagctggagttctttggagattggcttccggaaaagaagttgcaacttgttgatatgagtattctattaatcctattaagccctagccgggatgttacatgaatgtatataatcctactattaatatatatttcgatctaagtgatttatactgtctcggcaaggcgaccgatctatctcaatcatttgatttaagtatatatcgatataaggattatatatcattaatatctacagccgatcgagtagatttagttctggtttgcttattgatatttgtcgatcgatgtacacatgacaccggcttgaaataaatgatgtgtcatcggcacttagccgatcggctatcatttataggattaattgcggtttctttgttctatttcttgttgatttcaagatcaaatcaactagcacgctcatacatccgaaggcgagctttggacctgcactggagttaagcagatctcccaggcctcgtgttttctgtcaacagaacccaatacaagattaattaaaattcaaagtaaaaaataaaataatattcaaaattagaaaaattaaaagagagttcaagtaggaatacaattttgaaacaactgaaattgaaaaaaaaagaacacaatacgatattaattaaaatttgaaaaaaataaattctgaaattagagaaagaaaaataagatttcaattaggaatataatttataaataactaaaatttgtgataaaaataaaaactattgaaagaaaataccatctaaaacacatgacgagataaattaagtaacatgcctataaaggagtagagtggtggcggttgatacgacatataaaaaactgttaataaaacaccaatagatcctaatgatgattaaaaggagggacgatcggcgggccgtgaagcaaacgagcaaggcggttgccaggacttctagaaagtaaaaaaaacccgttgaatatcatatttgatttttaaaatctcaatgactaaggagaagcaatgagcggggtgtataggagtatagttgcagagccgccaacggttgatgggacttctagaaaataaaaaaaaaattctaacgatagttatgttcgatttctagaatcacaatgataataaagagtaggcggcggatgtgccgtagaggaggatagaggcatcgttttatgggacttctaaaaattataaaaaataaaacccaacaaggcaataaactctataaactacaaggtcttatttttaaaggttcggaacttctaaaaagtaaaaaaaacaatgataatcatgctcgattttaaaatctcaatgataacccgaagcatctttgaaaggaggcaccatatttgctatgaaggctacatattaccacattaatcgaaaaaaaaagagaaaaatctataccattgaattatgatagatctataatttaaccattgagattgattggacaaatataaataagagtcctactcaaactttgtaaaaaagaaaaccgtgcagcaaaaaataaaagtccaagttatattcggactctcaagccccaaccgggcaatgctgcacgttcctttctttttatcaaagaagctcagtaaaaaagaaaatctatcctcttgctcggtagtctgcccgctacagcagcaatggctcatacaattaataatatatccaaatattatacaaggagatctagaaattaccaaattaataagtaaagaaaaagaaaaaaatatgcaccaatttatggtgggcatatgttaaaaataactaaaatcagaaacaaaaaatatttagagaaaactactaagtagaataaaagataaaatgaattgtattgtattattaagagatgggcactagcgaaacttctacatactataaaaatagaaaaccaaagaatgattaggttcgatttttaaaatcctaataataataatgaagagttctaataggaatagaatttataaataattaaaattccgattaaaaaatgaattatattaaaagaatagtccagatagggtacaacatgagattaattaaataaaccataatgataatcaaatttgattttaaaatctcaatgatattaaagagaggagacaacggacgagccatagtggagtacggtgataaagccgctgattatttggcgagacttctagaaagtaaaaaataaacccaataacaataaagagaggagagagtggatgaatcatagaggagtatagtgcagcgtttgacgggactcctaaagtttctactaatgaaacccaacgatacaacaaactataaaaactacaaggtccaatttttaaaggctcgagacttctaaaaagtaaaaaaaaaattgataatcttgctcgattttaaatctcaatgacaataaacaggggaggcaatgggtgagccatagagaaatacagtgaaaagccgttaatggtttggcgggacttctaaaagtaaaaaatgaacccaaatgataattatcatcaatttttgaaatcccaatggcaataaagagagaaggcaatggacgggttgtggatgagtatagtgacaatgtttgatgggacttctaaaaattataaaaacaaaacccaacgagagattaatctctaaaaactataaggtataatttttaaaggtccaaggagaatgaatcgaaacaacggtagatcaagcaagcaaatgaagaaggggtgtgatagaagtaaggggtagcaactggtgtgacttttaaaaactataaaagtagaaacatggggataataagggttggcttttcaaagccttaagacaacgagatagctatttgataaattttaagtaaaatcatattagaaaataaatgattttgtatgaatgctagccgcgcaattgcgcaagccattcaactagtttattgaaaacaatagaaagttcggaggatttcaatcctattaaaataattttctatgaatatctttattattaagattattaagaattaaatcttatcgtatcatttgaaatttctatggaatgaagatcccattgagattgagaaaacttagccagagttattacctcttgaaaaattttctttgagtctacctcttcatcttatttctacgtttttcataccggccaatcaaacgggtatttctatattttctccatattttacaatcgtatatgaattcaatggtttttctatttctactattcaaaatggctcttaagatttaagaaaaagggatgacctggttcccattgttgaaaaaaagtatggatgagaacacgttatattagata

SEQ ID NO: 29069 - DNA, 5939 bp, Oryza sativa
  unsure (1)..(5939): unsure at all n locations
tatatatatatatatatatatatatatatatatatatatatatatatatatatatatatatatatatccaaacgaactcccccaatgaatttcaccttaactaaaccatataacaataataaaaattaaaatagccttcacctgttggctgttgcaacttgcaacacacgggtatttttctagttaacaaaaatataagaaatacaagtgcaaaacaaattgtaaaacacaaaagaatgtagaaatagtcatttgattagaccaacacaagaatcaaatgagagtgagagacttcaaggatattttcaaggggttaaagctcttgctaattttcctctgaaatctctatagaattatcccttacataagaattttagaggaagaatataattaaatcatttgtttcaaaagacttcttagtattttcttttaggattaaaatcctccaatatttgttgttttctctacaaatcaaagaggccaaaattcatttgaaaaaatataaaaaatgaagattttacaaaatattattagtcgagtgttaggttaagcaaaatgatggttttgcccttgtaaccaacccatagcaaaagaatagagggtagctcaacttgttagattacttgtaagggttgcaaattggcaatgggccgggcgggggcggggttaggttggaacgttcccgtcccttcgctcttgcgggtatccctgtccccggcccccgagggatgaacagggcgaaaatcagtacccgccccgaggccccgcaacctaaccaagaaagtcgtcgatgaggtggacggcgaggttgcaggcgatgacgtggcaacggcgagggggctcagtgatgaggtggacgaggagggggtgcgacgacgaggtggccaacgagggggcacaacgaggcggcggacggcgagggagtgaactctgtttgcgccccctacccacgggtgagaattccaccttgcccccggccccttagggtcgccccgatggagaaattgacacccctagtcccttgtggtggagccagccacctaagttcaagttttaaagctgactcggatgttcatatttatggctaattattctttcaatggtaagcgatgtacccgttgccagcgaggcatctgtggtgatttcgtttatctcaagatatgtcggcttagtctttcaaaggtgctaatggaggtaggatgtacctgtgtgcgtttataggggtgaatctatgcgcgcaagatatacggcccaatcttctggaggtgctcataagggtatagtgtatgtacgttgatagggataagtgtgcacgcgcaagatatgcacctagttttcatggtgttcataaaagtggggcgtgcgtgtttgcgtttatagagatgaggcacaaacgttgtgagcgtttgcgtttgtgacgtgtttttttttaaaagaagagagcgggaaagatttaaaaacacttgtaatacactgaaacatcgacattgagaggagggtttcttccgggttgaacctataacctcagttacctctatcactgggccgtgcccatgagaaacacctttgtcgtatccaacgtcgttgtcaagacgagacaagacaacattctgaagtggacgattggattttgtgccgccatatatttgcaaagcttattactttggtgtttgcaacgtcaccactcacccccctatagggaaaggcaaatgcatatccagtggtagtacatagttttctttttccaatcagcattttgcaaagaacacctgaatctcatgatagtggacgtgtggaactgatgatatcaattacaagaaagccaagaatgtgttggctcttttagaggagcagtaaatgaagtaacaaaaaaattactctataatgttcctctgcagttccacttccacaaccaacaccccccacacacaaacatcaaactatgttctctccctttgccctgtatgtcacctacgcaattacgaagaatatcacgggctccaaaggtttcaggtggtgttaaaggtgcaactgtagtttcatctgcggttttacttgtacaactgaattggccatcagaatagccaatgcgaatcggaattagctgatgaaatgcaatgacatgtatctgcaatacacacctcaataaagcttcgtgaactcggctgtctggttaggttcaccaagtctgaatgcatccctttcaatcaggatctgcaaggagctcattgtcttaaccaaagatccccagatcaagggagcgcagcaaaatgcataggcgaacactgccaaggcccttacaacaccgtttaaataccatgggaatgccatcacgaagagagcaccgatgatccccaaccatgttgtgaggaccgcaagggggtggaggaggaatacattgatcacgattgaagaaaaggagaaagcaccaagcaaatatagtggccaacctagtagcggatgcaccgtccgtgggatcaggaagaagggtatggtgtaagctgcaagtatggaccatgctgccactactctgagtgttgtgagcaaaactatagtacttttctccattcttctgttgtagcacatctttgacaaactaggccgcgcaagtcgggtgactgcaatgactccaatgtaaaatagggcctggattaatacaaccggtagctccgatgaatacttgctttgcatcaagtttacatatagtcaggaaaggcaaccctctggtcagaattaagatgcacaaatgaatactgttatatgcttcattatcctaaaaaacatgacagaaggttgaagactttgcaatccactactttatggaactttatcctgacaaaaaaaaagaagcacaataattccttgccttgtgcaactttattctaaaatgtaaaaggctcgataatgacctgttacacatctttattctaaagaagatagaaagcaattcacaaagggcatttaaccaatcacacgagtgcacatgatacactgttatggatgatattaccatccatgatccatgctaacaaattttgtacatgaagcaatgcattagtggaagattctattaacatcagaattcaatcatgcaaataaaatgcaagacaaaatatctgagaaaattactcaccccaagttttcacggcgttgttcatgccaagaaagtcccagaggtaaaactggccaagaccaccaataccatggcttaaaccatggagcgctaggaaatgtaatcacgctgttcggcccacatggaatgctccagcggagtttcaaatctgaacaaatatcccattagtctagggggaaaatgcatgagcatacgaattcgtatatgtctattgatactcacaatagtaagatgcgtccatttgatagcctaacggaagacgatatgttccttcaagtttggtaccattaactggtggatggaacattggtcggtcaagcaagtctgggaaatagctagcaaggaagccctgatctgcaccatctgggttatcacgcccaacagctagctcatgtagcatgttcttaaaaacgtccattgagggctgaaaacaaaatagaaagaaaaaaaaattcatgacgacataaatttcaatattcaggttcatttgatgaactttagatggttctggactagagaaaatcaggttgattaataagtaacaactggttagtatgacaaaaaaaatgagtgcacaaagtaggagttgtcataaccattttgaatttgcctactgcagaatattgtgccaaaaaaaacagcaattggcccgtgcattagataggtttagatttaagaagtattgtagattctgtgtttcgcgcccctgaaaaatacatctgtgctttgagaaaggccaacagaaagctaaagactaatatccaggaagaaaacagattcaatataagcttgcagcttctaaaaccaagcttattaatttcaggtaaaagatttgcagtaaaccagttggcaacaaaactgcatagatcttttaattaaacaataatgaaggattacttatcaaatggcagttagatcacccctaatatgaagtgctaaacaaaacagaatgcctttgtagatgcaatggactaaaggaggtcgattcatagtcattcctagtaatgaagagattaagagctaatatctttccttacatggagaaagttaaaagaaattttgcagaagaaaggagaaacccatatagcaagtaatcctacctgaagcacaaagagccctgtatggaagatacaagggttaatgaagacagcacagaactggccacactgaaataattcatcagtgttctggaggaaaatgttgtcagagtctagcataacaactcggtcataggaaactaggctccatgcatacagcttgttaagagtcaacttgaatcgcatgttgaagttcccttgtttttcataaggattcttcaaattctccacagagaccaccttcacaccatcatctttcctaaagaaacagttgaagatgcataaatactagaagaatcaagaccacacaagacaaaaagagcatgtatttcagctgacggaaaatatatctagtaacaataattgcatgccaattctaccagtaacttaagttatcaaatgacaaactgaattcaaatatcattttttttctgaaagatgcatgtattattaccccattaatcacctcattggttccactaataatgccactgttattcttgcatggtacttataagttacaacatcactaatgttcctctagttttgttatgtccatatttgttcctccatgattagttgtaacttcattagtgccaataacataatattatatactcttgctagttacatgactcaataatggctaagcttcctggcccaacatggctacctacttcaactaatcatataccatattaaattgaatatctattactaaactccacaattaaaaatgctcaatctggccagcacaggtatgatattctcagaacagaggggaaaggatggaccactaggatacaaagaaagctgacaaattcttcagaacaaagctagcattctctgaaactgtaagttcttaggcaacggccaacaagccataacagggacaaaatcaactcaggtcgacatccacatgtggtcagttggacaatatgaggggttcacatgctagtccaactggagtattgtaatagaacaatgcagtcacaatcagcaaacttccatgtagaataatcggcagtggaaattaacaggtcaattctcaccacttttgaacaaatctgtaacaaaggccaaatcagtagtccaacagaaaaaactgttctataataaagcttaggcaatgagttaatcagttaactgcaatttgcgcagcaacttgaggtcgaaattagcagcacaaatatcacaatttatcgaatatctcacaaccaggacgcacaatctctctcaacaaacttcaatgactctaggctacaaagtcaacatgaatgcatatgcaaactcaatgaccgtaacaaggtacgtaacagttacaggatatcattccgaacaagcagcatcttcgtcgaatagtacggggagaaacagtaatagtaaccaggacatggcaaggacactgccaatccgcaagccagaaaattcagagaaaaatacagcaaaacaaggccaaaaaaagagagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29070 - DNA, 402 bp, Oryza sativa
tagagcatcaggtttggtcagctcacatgcagaagctgcaattgcagatatccttgcacttggggcaagtccaggtgccgtcattggccaccttctcggcttcctggccgtacctgcgccacgaatcactcagaaatcacatggtcagccagccttgctctgctcctgaagctaagaaagaagacgagaagaaattcccccctcacctgttaaagagacacttgcggcagtactggatcgtgcactgcttgttgttcttcttgatcttgtggcatgacgcggcgaagtccatcgtcttctgacggcactgcgagggagcaagaaacagagcaaccgctaaacccaagggtgagcaagaattccccgcaaaaacaagggggggcgagcaagaattcctcagat

SEQ ID NO: 29071 - DNA, 610 bp, Oryza sativa
catcacgatcgccagatgcctccccgtcaccaccacctccttgaaccttattatgttcgggtgacgcagcgaacgatgattcacgatctcccggaacacgttctcgtcgatctgtaccaatttcatttcatgctatttctttctttcttttcatatatcattccaaaagtaatagttgcttgcttaccctgttccctctctcgatgaacttcatcggcaccagctcccgcgtctccttgttccgcatcagcttcgctaccccgaagttgccctccccgatctaccgaactggctcgtatttctccatatcctacctccttttcttctacagtcacttaaaatcttgctttcaattctgcttctccttctgcttctgcttctgcaagaggaacagtctctggaggaaagaagcagagcagagcaagaagatgaggaggagatgacagacgacgacgcatataacctgcagacagatagacgacggacaggctgaaagaataagaggaaagccaaccggccggtcttgggcgaaaaggatggatgcaaccagcgcacgactcggtcggaattaccatatttcttctcaattgcatgctcattaattttcaac

SEQ ID NO: 29072 - DNA, 13815 bp, Oryza sativa
gtcggccaccacaacttctcaattcattctctaggtcggccaccacaacttctcaattcgcatgctcaaagtacgattgtaagtaatgcatttctgggatggattagggggggggggggggttgttaaattcacacataaatttgaggcattagatgatgtaagtataactggtgagattttttttgtgtttcgtctaagaaaggccaatgaatcaaaagttttgcaagtttactccctacctggtaagttgccaagtggtacgcttgggcactttgggtgtctaattgaagagcacttgctgtcgaccttctgcatttaatttatggatgtgtttttgctggcaatttgaaacattgttactatgttattatctgtaacgcaagcaggtcgatcatgtatcgcgcgcctatgtttcaggattttttttagtcatgcccagtggccatctgtgaaaggacaaaattcctcggtttcattcttccagaggaggacaactttttttttaacatttttaaaaaaatcaacggcggcaaacattttgagatggagggagtatttgaaaaggtacacgagcggagaggtgaaatgtgtgatttactttccctaatttatatggcaaaaggcagaatgacgtccgtggaatctgggtagaaatgagccgtcggagaggagagattctgggatgcgaatccaatgagcagtacagtataactatgaattccgaaatcaaagttgtcacttctgaagtaacagtaaaatggtgattgtgcctgaacataccctgcagttacatccatcatctagtggtctctgattctgatcacaattaagcagagagatgataacaggctactcgtagcaggggagatttacatcaatgaatgctgccttactcatataaacaggtgatgtaataatgtacccaaagtttgtttggggactgatcgatcgagtatctatctatgtatgaatgagaaaatgcatgcaatcagtgcagatggggttgatccaaaacgaaatgatcgatgctggtcagaagaacacaacactagtgaagtggagtatggacgacgatggatcaggagatttggaggtttgacatgtcgaggtcgacgctggcgtgaacctcgcgcaccgtcctgtcgtagtcgtcttcttcgtcctcctcctcagctggttgttggtcgtcgtcgtcgtcgtcggtgccccagccgtagccagagacgggcttgtcgggcttggggacggtctgcgcctcctgcacgatcctcatgatgtcctccacgctctgcggcgagaaggcagctgcagcagccgcactacttgcgctggaagccgcgtgatcggctccccggcggttgtagtagacggcctgcgcctcctccttgagctcgcgcggcaggttcttgaggaaccaggggtggtcttgatctcgcccatgctgatgcgctggaatgaagacatgcatatgcatatgaattgggaatagataatgttgattgatgagctactccatatatagtctgtaccttgtaggggttggcgacgaagatgcgggagaggaggtggcggcagggctgggagacgtggacgtactcggggatcttgtactggacggacatgatgcgctgcgggcgattgcaaatgaagcatataggtcatatatatgcaaagaaagaaatcaagaaagcatcaagcgcagactacgtaccgagatggtctttctgaagttcttggggtccttgggatcctcgaaagggtaagcgccgacgagcatgacgtagagggtgacgccgcaggaccagacgtcggcgagcttgccgtcgtactcgcggcgggagaggacctcgggggcgatgtaggcgggggtgccgacggtggatttggggcgggagtggaggagggaggacttggagtagccgaagtcgcagatctttgacgcgctgggcatgactgactctgatggttgtattctacatgttgaggtcgctgtggcagatctgcctggagcgccattagcttgcttgccacacacactgatttaaaagctaggccacgtgatgcttaccatacctgctcgcgttggatgtcctgtcgagcatctgacttgccgtcggattctcgatgggcatcgccaaaggggtggccataggaaccacctcgttgaacgatagtatatccgggcgacaccaccttggagaaagaaatacttctgtgatcacgttgtagcggatctgcaccaatgacgtgggctgctatatgtgacgttctttacgttatgatgacgaaagtaatagttgcttgcttaccctgttccctctctcgatgaacttcatcgccaccagctcccgcgtctccttgttccgcatcagcttcgctaccccgaagttgcccgccccgatctcccgaactggctcgtatttctccatatcctacctcctcttcttctcctctcacttaatttcttgctttcaattctccttctccttctgcttctgcttctgcaggaggaacagtatctggaggaaagaagcagagcagagcaagaagatgaggaggagatgacagacgacgacgcagataacctgcagacagatagacgacggacaggctgaaagaataagaggaaagccagccggccggccttgtgcgaaaaggatggatgcaaccagcgcacgactcggtcggaatttccatatttctcctcatttgcatgctcattaattttcaactgatcaatcatcaccgctgttaatctcttgggagtagtactaagctatggtagatggcgaccactgctgtttgtctgtctgtctgtacctttcagttactactacctccgtcccaagttaaattaagggcaaccatgagtttccgcgtccaactttaatcgttcgtcttatttgaaatttttttataattagtatttttgttgttataaggtgataaaacatgaatagtactttactcttgactaattttttttaatttttttaaataagacgaataattaaagttggacgcggaaaactatgactatagttattttgggacggagggagtactgtgctagctagtgtacagttaatcatatactccttccttggatggactaattaattaactaccactgtgtacaacgacctcaatatatatattccggccggttaattaatgttagctgctcgatgtttgctttccaaacgcactgttgcatatgctaaagggcaaccactatatatgtctaacgctgacacgacaccacacatggatggatggataggtggatggcaaccttacctgctcatgctgtccgcctcctaccgatccagccatcagcagccacagcccacacacgaaacaacaaatatccaagcaggcaggcaccattttgcagatctaattgactactactcatcagcatcgatcactaataatatcgtacttagtagattattaacttgctttccttgtaacatatagtactatccatccatcgtcgatcgccaacgcattctttcggtgtatatttgtcaatccaaattaattaacgtgagtacatatatcaccgtcaccgatgtgctgtgctgtgatgttctgacgaggaaaccacccatgtatatatatgtacggttaaactaacaagctgcaacccggccaatgacgctcatcgatcatcaacaagcctaccaactgcgactgatctacttaattaggagtattaaatatgccatcctaaccttccaaccccaataccccatcatcaatttttatctctctaggtaccttacttagagtatgttgctgctatagaacatattttttttgttgccattgggtcactcaaattcagaccgactgttcttcctagcctagctatcaggtactgtatcagttacctagactatctgtatgagccggaatcatatcactgttcatgtggactagccctacgtactcttacacttgtactcttactagtacttggcatcagtacctgaatcagggaccatcagatttagaaaatgattactcctaattgtcgactgatctgtagtagtagtactagtccagttgggatccaatctggtagtattagtactaagtgaaaaggtactagtagctaatcaagcttatcatcagaaggggcagattaaaagtgatggattggatatctgaacttttgggttggagctgatggtgcatatacatggatgggaggatcatgcagcttctttcgtttgctttacacaagcagctagctagctcagtgctcatgtgccttgctgtccacttattactatggcctcctgtctaatcagatcagctcatgatcttggacattcatgaatccctcgtcggtcaatttcctaacttgatcaacatggagattcagtatttgttttaacctttggagcttaggctttcattgactttgatggctactccagtttgtaactactagcttgtggagattaccataccataaccataaccattacatcacaaacgactgagtcgactaagacctgcagcattggacttgttgtcaagtcaatggacatatgaatggatggatgatgcacagcgcatgcagctggttttactaggaaagtttcagttttggttgcaattaagttttcaattgatgtttgccagaaaaatggaagcagcattcagctataactgaacaaactgaattcgatcgaaagtacgtttgtactatacagtatatactagtacatggatgattgtatacgtgggatgtatagatagatgagatagatcgtgatcgatggcatggagagcaagttgttagtgcgaatctctggtcggattcgattgatcacaataatacaattaagatccagtccaagtctgcaacagtgcaaaagcatggcctaccaacaaagccatccacaccgatagattccttcgatccagtattaagctgacagcgatgcatggcccgcactgcactctaaaatataatctttcaggtaacagtgtattccatattcagtgtcctccatataatccactgctcctagcagggaaagcgaggagaagggcctccccctacctcaaggctgtgtttgtaaaatagttttgggatatgattttccacctctcacagagtaaacttcaatagtagccatccattcttctgatcccatttcatcacatccctccatttattttcatttcctaatcccacccctcctaacccatttaccaaaaacacctcaaatgttagtgttggttaaggcagctcagctcattagtattagtacggaggacctgtacagtttattgtcatttttaaccttaccaatttatcataatgtaaaatacgaatattaagaaaagacctaatatcaaataatagaaggggtgtagcttcagacctagaccggctagcccaccaccttgtagggctagctggaagaccctgagcgtttctcaaattatggcaatgtaacaaactaaatacacttcaatcattgctaccttaccaaattttagcatctttagaagcttcctctcttaaaactctccaaaaatttagcaaatatattaaaacaaaagaaagaaaaaaaaatctaaattacccctaaactattttggaagtacgaattaccccataaattcaaaaacaagatatttttcattctcaacctatcggaccgaacgaattacctcatagccgacttcggagtggttttagtcctatatcaagcacaagtgaaactacaactttgtaactttagaaaacaatagtgatatggtatgaactctaaaatatgtagtccttttttataaatttatttatgactaagtctgtagttttgtgatatgtttataacacaaaggaacaggtacacccaaggtccctcaacttgtcagtgagataaaaaaacgtcatcgaaccgcaaaaacagatatatagggtcccttaactatacaaaaccggtcacccgagattcttcggtggttttgaccccggttttggtctatgtgacggctgagtcagcatggaaccaacgtgggtcccatatgtcagaatgccacgtcagctgctcctcggttcctcctctctctctctctctctgcctgttgagcgcgagcgcgaggcttgcaggcaagcagatggttgaggacccggcgagctcggaccggtgcacgacgcggaaggggtctgggtgaccggcgagggcgcggccgacggctgcaacgcccacggcctcggcggcggagaggaggagatcggcgaccagcgccgccgccgccgcgcttcctccacgcgctggccaccaccgcctccacggggacctcgccgtgggcggcggccatcgtcgacctcgccgcccctagggccctccacgccggcgcacaaggggcttgccgcggaggacgagcggcgtggagctccagacgcgccgccagcggaaggcgagcgcggcggtgcgagtcgcgtccttgacgggaggcgggcgacgaggaggtcgtcggggagtgcgctgacgcggtcctcgccgtcgtagccctcggcggcggaaagcgtggcgccgttgtcggaggcgggatggccggggaaccaccggaggcggccttggacgtggcgctgtcgtcgtcgtcgtcctaggcgtcggggaagaaggtgggcgcggcggcggcggaggctagggggttgccgcggctagtgtggatggaaagctgaacattgcttcttcagctccaagatactgtaattcacgagcctttttattttgatggttgcttcttcagttcgaaaggtgtctctgtttttattcttgttcaagccatcggcaagtctgaagaacctagactgaattctatactgtagtacagttctaccatcgtcagtacagtataaagaagcaatcttttgaatccttttcaagtaggagtatagtatgagattattatagcctgtcaacttgctgtttgtagctagccaatgctaatcttttgagctcgattatgatatatatcgcgtcgtcagatttgtgcagaatactaaaattggtatagagacattctgaccgggttatggtcgatgacactgtccatcatctgagagtttgcaagtctctgaactctgaacattgcccagaatctcttacagggatctttttgttggtgtcctcatacagtatacatcattggccccttgcaagcagaggacaaattctctctgcattcgtatgcattttaattctgcgaaacctgtagcttgtcctgtgtataaacaacgagaatatcatctgtttttcgttccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcatccatgtttcccaagatagaatgacgcgtacacaaacttccagcgtgtcgagggcgaggtcaacggcggcgccgcaccgcgtgtgccagcaaccccgggcgccgcaccccgggagcggcccgctcttgggcgccgccaccgacgcctgcctgctgtacagaaactgcagcacgagcacgagcaccagcaccttgtaccgcaccagccgcggcaaccccctagcctccgccgccgcgcccaccttcttccccgacgcctaggacgacgacgacgacagtgccacgacctcctcctcggcaccgccgccgcccacctctgccgcgtgccccccgcagcaccaccctccccggtggcgccgccgcgccactatgttcgttgccggccggcttgcaacaggagaaaagagtgagagagagaagaggaagggaggatgctgacggcggcgttgcctccgccggcgcgacgccggctgccggacctcctcctctcccctccccccggcggcctcttcccccacagcgctgcccgtcgccggctgagaaaagtgagagagagagagagaaagggagaagaggggaaataagagggaagagatgaggtggcgtgggtttcacgtgggtcccacgctgactcgtccgccacatagtacaaatccggcattaaaaacgccgaaggatgtcgggtgaccgattttgtatagttaagggactccgcatatctgcatatctggttttgcggtttgaggatgatttcgctgacaagttgagggaccttcggtgtacttcttcctaacacaaacatattggatcgtaacatctgttctcctcaaggcctactcacgatgacgggctgaattttctgggccacagcgtaatgaatggcccaagtaaattctagggcctagaagggatcgggaggacgccctggcccagctagcctttccgcccctcctacacatcgacaaagctatcgatcaggattcaggagaagcctgccagccatcagccgcctctgcctccggcctcctgcagtctgcagatgaacaacaagctaggctgccacagccggtgatggtgagggtgaaagaagaagatgactcaaaatgttatgttgtccaacacgctgcctgtatgtgtgttgtccaactcgcatccttagctgttagttgactggcatgtgctctcctttgtaatttagtaattttaatttcacttttttcttgtgtaagttaatgatataattcaggagtataagcattcacatccaacagagtcgagaatttggaaggttcacccatcatgcattcaggagtaccgattgattgttgtgtcctgaatttttgctagtatatgcatataagtagatactactccactacagtacagaggagaggattgacattgactagctagtccacttaaccgtctccttactactatcagaagaagctaatttaattaagtggagtaaaagcaaaatgaggggtgggctgggctcattggtcgtcgttgtcgtcggtgacgaacttgccggttccggggttgatggcggcgaagaagaagaagaggatgttgaagaggaggagcggctcgatctcgttgatggggacgccggtctcgatgttgagctgcgccagcgcgcccttcccggtgatgatctcgccgatgagggagaaggcgatccccagctgcgcgaggcgacccacgaagagctcgttcgccttggtgaacccgaacagcgggccaccctcgctgagccccagcgccgcgcggaaccccttccccggcgggatcacggcgcgctccagcccggtggcgtcgtccacgaagcgcccccggtcgcccagcgcgccgatggcgcccagcagcgtgaagaggatgaagaagaggagcagcggctcggcctcgtagatggggatgcccgtctccaggttgagctgcgccaggatgcccttgccggtgaccgcctcgccgaggagggacgccgcgaaccccagcatgggcaccctccccacgaacagctcgttctccttggtgaacccgatgccgccggaggtgccgaagatgccgtcctccacgatcgacttgttcttgttcgacttgtccaccttgggggaagccttggttctgctcttgaacgccgccaccaccaccagatgcttcttcatcctctgcagctgaaccatcggcgatgaccgaggagcggtgccaaggtcagacactaccatcatcggcatcgccatgctctgctgcagagccattaagcttagatggattcaacaattagctagatggatcgatcaaagcatgcagtcgctaatagcttgcagctgcactagctagctgctaaattactacaaaatacgatatgatcgatctcttgatcttggcttgctctcttggaatgaattcgagtcccacgcccgcccggggttttaatagttgaggaaggatgaggcctcgagcaacaagggttaggaagcagccacgtcgcccacttgggatccatccatccatccactgtcctccagcatctaaatctcagtgatcaccattcatttgatttttgttaccaactcttgtactattacgtacgtacacttggccctatgctttagtacatacatactccatgtcacaacaaacaaacaaacaaacaaacaaaaggatcgatcgagcaacatgcctgcctgccaacatgtgcatagtaactactcctcgtccacaaatattggaagcaaactgacacccatcgctcttttcgcttctacaagtttcctccagaagatcgttcattcagtgattcagacacgagacaagcaatcacgaagcagcgccctgcacttgtctcatcgctcaaactcctccagagaatgtcgcccacgctacctgtatccgtgtatactcctataacaaattagtactaaaatccttctattttggaacataataatgtaataactgctcgcgactttgcaatttttcttcttaccgtcaactctatctctccctctcaaaacataaatattttttcttttttgttttgaagaaaacatataccattttgttttctatgttaagtaaacaagcgacgcgatcgagctatccgtcaagattgatcatatcaaattttctccaaggtcgatcctttagtacagcaccgtatacatacacgtatcacactgtaccgctgttgcgccgcgcatacattttcgggtcaaatttcagtttgttttgaactcaaagccttatatagaattcacaggcaatgaacaagatcggttccatggtgtagtggttagcactccagactttgaatctggcgacctgggttcgaatcccggtgggaccttttttttcactattctttttcaatattttattaagctatctcactatctctttgcttcattttcatgttcgtgtcacgttcagtatttagaatggaagtatgatgcacggaatcgaagggccaaaaaacctccaatcctccatgcatgttatgtgttaaaacgagaccaaatgcagtctctctttagtaaacgatctgatcatgaatttctccattgcacgaagggttttcttacttttcccaatgctcaaggtaaaatgctaaatggtgaaatttaactccaaagcttgttaataaaccgtgtagatcgacatccttctgtcatccccgaatagtacgggctgctggatttacataaggtcttgtgtagttcctaattttttttccgaaaaacgtcacatcgactctatgaatatatgtttgaagcattaaataatgataaaataaaaaactaattgcacagttcgtatggaaatcgcgagacgaatcttttgagcctaattagtccatgattagccataagtgctatagtaacctacatgtgctaatgacatattaattaggcttaataaattcgtctcgcggtttccagggttacaaaattagttttttcattcgtgtccgaaaaccccttccgacatccagtcaaacgtccgatataatgtgacacccaaattttctttttttgaactaaacaaggcctaaatattcgcacagtaaacacagtgcatatatataactacactactggatgtcaactttgaactgcactgtcatacaaatgttttccctgcttgttcttcaatttggcctaatgagggtatactctccaaattaacccttccccacaaattaactatgaactacatatttatggcattgtatcacaaaattatagatttaatatcaattttctcataaaactacagctttgtaactttagaaaacaatagttatatatggtctgaactctaaaatatatagttattatttataactttatgactaagtatgtagttttgtgataaatgtcctacatctatagctttgtgataattttggtgcaaaatctttagtttgattgaatacagatgaaggctgattggaacataaatttgttcatactatgaacaaatagattaaaatacaaatgaaggatagtaatttagaacacagattacattttattggaagcgtgatgcgaatacttcatggcaataatctagccgatcaagttattgccaaagattacgcgtgataaatagagatgggtacgtagtagaccagatttagacaagcctagtccatttattttatatttgtccaaggcaagtctgggcttcaatgaagatacgaattggtgctagttgttaccatgcataataagggcatatacaaagctagagtctaatatgagctctctatattaattaatatcactagagactatccttctagtagagacaataagatttctaatccattaatacactaaatatttttttattatacttttttccttttctccacccctcatgcaacaaactttccgttaataaacgctaagagttgactctgagccgttgtcatgcataacaacgatgtttctccttccttccctctctttcttccatgtcaccaaatttacctacatgacaacgaagagagcccgttattagacaccattgtacatgccctaatagcctcatagcaaatgagtcgaaggcaacgtttctcaacccaggaacattgtgcatgtcttaggaatacagaacatagagatatttttgtcctcgtgtagaaatattcgcaagtaactattgaatgtttctcgacatgagaactttgtgttgtggtggtgaaaatgatcaccaaatgctgtattggcttcatacggaatgggattaattaattgtttagctggcattccgcaacaaggtttgcaatacagtaataatgtgtgcaaaaggtactactccgtcccagaaaaaacgaattcctatctacgaatctagacacacatatatccagattcgtagataggatttgtcttttttgagacggaggggtgaattaattatgaattgtgggccagatgtcatccatgaacgacatgttatatcacgtatctgtgctagttgtgtactccttctgtcaaaaaaaaaagccaacctaggtggggatgggacactaactaggacaacgaatctagacatacataatgaatctggacatgtatgtctagattcgttgtcctatgtggtgcccatccccatctaggttgttttttttcaacttttttgctattttacattgtaaattatttctaaaggtcacactattaaggggttgtttggttcagaacttcaatttgccatgtttcaccttagacgtgccacactatcttaatcttatggcgggctcatcaccatagttataacttgttacactttttagcaccttgttctatgctttatctgtcccgaaataaataaaatcagtacgggatgtgacatactttctatctagattcacgatactagaatattgtcatatcacgtactagttttgtttattttggaagatcgggagtacgtcatagagtgaattgtttgtctaacttaatcacaagtgcagcttactataatttagtggtcctaaaaagtgtggcaagtgaaatttgttttaaaccgtataataagatggctatgtgaaactaatttgcaggttttcctcctatctcaaaggagaattcttggtcgtgcttatctcctcggaataaagaaaagaaaagaaaagcaacgtgggagaattgagacgtgcgggttgttggcaactgaatcgcgccattgcccgtgtaaatttggttggtctttcttggccggcccggtaaaaaaataattcattaaagacagacaggggaaattagaaaagtgtgtacaaatttaaagacaggtcgcttcccttggccttaatttgggcacgggggagactaaattctcg

SEQ ID NO: 29073 - DNA, 15759 bp, Oryza sativa
  unsure (1)..(15759): unsure at all n locations
cacgccgagcagtgtcccgcccctctcccggatccgctcccctccgcccaccgattcttcctctgcaccatcaccgccgtcgacctctccgccgacaccaccaccggcgagccctacgccaccatctccctcctccctcttcgccacgacgcccccgcccccgcccccgcccccgcccccgccgccgccgaattagcagaagcagaatcacaggagttccgctactacgccaagcagctgacgcagagcgacgccaacaacggcggcggcttctccgtgccaaggttgtgcgccgatcacatcttcccggcgctcaacctggatgatgacccgcccgtccagagcctcaccatgggggacctgcagggcgactcgtgggaattccgccacatctaccgcggcacgccgcgccggcacctgctgacgaccgggtggagcaagttcgtgaacgccaagcagctggtggccggggacacggtggtgttcatgtggtgcggggccccggcccccgagaggaagctgttggtcggggtgcgacgcgcggccaggtactcgggcgagtcggcgtgcaacgcgcgggggcgggtgcagccccaggaggtgatggaggcggtccgactggcggcggagcaggcggcgttcagggtgacctactacccgcggcatggggcgggggagttcgtggtgccgcgggtggaggtggataagggattgactactccgtggaggtgcgggatgcaggtgcgcgcccaggtgatggaggccgaggacacccgccgcctcgcttggctcaatggcaccctcactaacctccgccaccaacaaatctggcgcactctcgaggtacctacctcttcatcgtcccgtcccgtccctcgttaatattaatataatcaccatccccgatcgaggattgcatgcgtctcatgattgcccaatgtcactctctatgttactccctccatcccatagtataaacacttttaaattttgacacagtctccgatatgctattttgatcaataatatctataaaagtaaaatattttaaataaaatgagttgcatattatgataatttggttaatgataaatctagtaatatcgattttatatgattgatcttttttatttttatgctattaatggtcaaagaaaaacattttgacttatcactatgctaaaaatgcttatattttaagacgcaagaagtatgtatgtactccttccgttctaaaaaacaaaagcaaattagtactgtatgtaacacattttagtacactgaatctgaatagagatatatccagatttatagtattagaacgtatcacatccggtactagatttgttttttacatgacggggcagtagttatgtttgatgatagtgatgcttatgcctcgtcacctttgtccccgtccttacaccatgtttttgtagatgagtgttcatttcagcaagcttaattgttatcttcttataatggatattgctttgctcttgttcgtggctatcgcagctgatcatcttcaatttctgcttgtatctctacagttacatattgcattgcgcatcgcatatatagccgatctgacattactgctcgatcggtgcttgtgtgcaggttgaatgggatgcctccgccgcgtcatcttccatgaaaaacagatttgttaatccttggcaggtccagcctgttgatttccctcctcttcccatggggctaaagatttctaacaacaatattagtgcacctgtgtgcaatggggattcactgctggtgccaccgatactaatgcacccgcaacctcaacctcccgctgacattcagggagccaggcataacaatggccatgcctatgcagatataccctcttcatcaacaccatcaatggtgaggactcagcagctgttcccaagggatcttcagattttagttccccacaccgacattgtcactcctcaaaatggatcaccgcccgacaaccccgtaaacacgcctctttctgcatctgacggaatgaagaccatacagctgtttggcgtcacaataacatcacctgtgcaaggagacaccaatggcgctttcgcttcagcacaagtgaatcaggttccagagggtgtagatgatgaaactgctaccgaagaagcttctgacacaagcctacctgactctcttaccaatggccacaatcaagatggtgctaggctttgaaggaatatcccattaaacgtttccaagatgtactagtactttcttattgatattcatgcatttacttgcaattaatggaaaaaaaattcagaaatgcacttactaatcggtctctagttctcaatgccatatatactcaattatactatatgtatagttgtaaaagtactttcttattgatattcatgcatttacttgcaattaatggaaaaagaaattcagaaatgcacgtactaaccggtctctagttctcaatgccatatatactcaattatactatatgtatagttgtaaaagtactttcttattgatattcatgcatttacctgcaattaatggaaaaaattcagaaatgcacttactaaccggtctctagttctcaatgccatatatactcaattatactatatgtatagttgtctggttaccctttgttctctgcaattcgtgctgctcattatttgtcgatgaacaaaagccatattcaatagagtctcctgctctccttcattttttcctgactggattgtcattttctacatcaaccgatttagaagtaactatgttttttttgcagagatacgatgtacttcctccgtttcacaatataagtcattctagcatttcccacatttaaatatgaatgtggaaaatcctagaatgacttacattgtaaaacagagggagtaatatatttttatcagccacctgtttactgactgtttgtttactgttttctacagatggctggaccagatttgtttctaacattttggtctgttctgtttcaccctccggcagtttgacgggatgtggtgttcttatgcatgcatttaatctggagtttaggctggcaactatgccgcatggtccagttaagtttggagtaatctggagaaacgttcatttctttgttagaattgttatagagcagcactgctctgttttattttccttgaattttcacacctgcactttgtttgcttgttgtttgtttacctgtattgatctgataaacatctttaatttcctggggaaccgttgaactctgctttgctgttgcggctagcttttccaattggtatggcataaggatttggcacttccaagtgacatggtgatgattttactagtagtaacaatttgtattgtttacttgtgattgatcgatggagtggatgatgctggtaaggaatatatattggtgtggtatactaggatatacccttttgcaggagaaggggatttcagccagcctgagattgagagacgacgtgttcaaacgattgagcagtctatccttgttggaaatgaagacattgcaactcaccacccacctcaactcgccaccaaagctgaaagagatgctacaatcaatagcaacagtatgtttctgtcaaggtgatcaagtgcagattgattgatttttcagctacactagtctaccatcatgcacggtactccagctctgtgttcccaattcccttctttttgtccaagataggctgtatgcatcttttctttacattcatgattcatcaaaaggcagtcaaaatggtcctttttaatctccttttgccttggaaggatgaaactttacatcttgtgactttaattccttgttaaaagtcctggaccgcagcttgtatttgagtaggtagacaggtagtactagtagtagtagtattttctgagctactgcgagaggaagtaggaaaaagtagataccaagcaaaagcttgagacttggtactatgggacatatcaagcgtgcacatgtgtgtctgtctgtccctgtatctaaaccttctctatggaccatatggatggagtattacttcaaccactggtcaagctaagctagcaaaacgaaatcatgtaatcgttatagttgccaatacactgtccttgctgccagctgccttataacaagcttcagagtaggagccaggctaggcaattcagagtaacagtccatgactccaacagatatttcctcaaacaaaaaaaaaaggttttacaagtacatgaatgaacattcttctgatagataattttttccccagaaaaataggaggcccttaaaagcagttttacacaagtacatgaatgaacattcagatatttacacacaagctccaagtcatttttttccatcttggccaaagttcaagatcgatgagcagaaacctcgtcattcccagttgcaagttaaaaaaacaagaagaagatggatgagacggatagatggatcgatgtctctgcattacattacagaaaacacaatgctgcatgcagctgctttccttgtttgtctgctagctgtgattcattcgtcagtccatatacatgtacctccaatccgatcctccgtggatatcatatcatatactactacggagtactaggtagtaatatgcatgtagttacagtaaacaaatgaagagtattactatattcagagcaatccgacgagattaagagtacgtgaagagagtgagggaggtaagaagctactcctagctgagaggcatggcgggtgggcgcctggtgatggtgagggtccggatccagctcctccccctccccctccccctcaccgtcgtccccttggacgacgaccgctccgccgtcttcttgccgtcgatccccagctggtggcacgccgccgccttgccgttgccggacctcttccaccgcgccagctgcagcagccgccccaccacctgcttccgccaccgggttacgccgccccgcttcacgtgctccaccaccgccgtggtcgtcgtatctgtctttttctcgccggcggcggccttctggctgtcccacgtagccttgccgttgtcctcgaacttgatggagatgaaggaatctgttggttttaattaaattggcagcagcaatagtagagtacgtacaagaacacaattagcttgcttgcgagcgacagagaattgaaggcgaggcgaggtgaggtgtaccatcgaggctagcgatggaggcggtgtcggcgtcggagttggcgtcggagtcgtggggggcggggcgaaggtggtggcgagaggagtcgaggcgctggaggaaggaggagccgagcgcgaacaccttggggagagagatgctgctgttcttgcggtggagcggtcggtcggcgaggaggtgggcagcggcaggcgaggtcttggaggcgaggaggaggaggaggcgctcccggaggcattgcgagcacacgcccaccacctcctcccgcgggtggaagtagcacatgcatggcctctcgcctcctcctcctgctactccatccttcatggctcacttcttcttcttcttcttcttctcctccttgagttgagttgatatatactctagatagcaagctgctaggtcggtatctggagttgcacataagctgatgagcgtatatagattaggagaggaggtagctacttgagtttcttgctttgtgcacaattgtgttgttcttgcttggataaagatactagtagcactcaagagcccaagaggagaggacataccatgcaggcatgcatcatattcagactttcagacagttatgaaaaggaaaagagagagagagagagtagaggggattggtactgtttggaggagctagctaggcagatggattaattattgagagtggcctgattgcacgtagctaggcgcgtgtaatgttattgagttaggaggagcaaggacacggcgcgtgtgtggccatgcatgggtaggctgcctcctgcctaattagctagctagctttgtggttgaagcctttatgatcgatcactcaatccatcgatatattactccgtatttgactatatatgttcgcattgaaggattgaattggatctgcctgcatcctcatcgatttatctctggcagtgatcagtcaggtatatttgcactcaagcatggagatccatgcatgtttgctcatcgttcatagctcgctatcgatctcaagcttaattggaccatcatatatactactatcatgttgcagtagcatcgtatattcgtatcaatataatctccaacaataatgaccatcaattaatataatctcaacaataataatgatcgatcaatatgtggggggtaattgctctactaacaattggcacactcactgatcacctagctacctagtaggtatgtacgtgtacggtttacatattgcgtgcagtgaaggaaaccatccatccagctagctagtgtacgccgtgagtgagtaagcttttttttgccgtacttttttttcaagcttaccaaaggtaaggttatcaatgcaaattcctagccatatttttactatatgacacacaaagtcatggccaacaaaattaagccatgtcacatttttcatagtcactgatatgtgggtcttagattatagaagatgaatcttgctacatatatttgtagtagccaaccaaacattaacttagttagcataatcaaatttgcttaaccacaaatgttcatcgaccaaacaacctctaactacatggttagtatatataagtatacacaggctaagctagccaccttaattatcatctgtgtgctgtttaaagggtgtgtatgtgtatggacagaagaaaactattaattaatgatttaatcgatctgcagtttgctggactgctggcttgtcaacggatcagatatacattaatagtatattagcatacaggatgggcaactgcatttcgttactgtttgaacttatgacaatgagttgatcggatggatgaatgattgatcgaactatagggtcggacgtgatggagctggtcgatcattcatactactagtagttagcttggggtacgtggtccaatttcgatggagaaaaaccaaggaccacttagctactacctccgtcacattataaatccaactttgaccgtccatcttatttcaattttttttaaaaaaattaaaaacataagtcacgagtaaagtactattcatgttttatcatctcataacaacgaaaatactaattataaaaaagtttcaaataagacgaacgatcaaagttggacgcgaaaacttatggttgcacttataatgggacggagggagtagttattagaagatactaatacaatacaaaagggaattatctaattcgatcgatcattttccgttttaagtggtgtttacgtagagcagtattaagcgagtgaaagaaggaaggaatgggcagatgcccccacgtacgtctgaatgaatgaatgaatgaatgaaaggcccaaattattagggaaggagaggcctaattaatctaaatcgatggagggtggtcggcaaatgaagcaaggacgatgggaagagaaggaaaaggcgaatgagttgaatctagctaggaatgcttacttatatcggtgcatgcacgcatgtttattggagagaaaagaaaaaggaaagaaagaaaaaaaagaaagagaagtttctctgctacttggtaggaagaaaaacgagatctatatgaatgtgtgagagagggagaaagggagagagatgcacatgggctgtgggccattccttgttgtaccaatatgtacagtgccatacctgcacgcctgtccctccagttaatctgcctgatttaatctctccaccttctcctcagatcaattctgaccaggtaaaacaatcagtttctgctctagcacaatgcagcggtaaaatacaaggaaattgaccgttaataaatctgctctctacttgtacctgcatacatataccacagcacaacacaagtaccagctgcaagcgtgtccttcaattccatggggccttgttgccatgtccacatgcatggtcaaacacccaacaaatgccaccgtccaatttcgccttttctttattaaaaatgatatatgcatgacacttttatccaactctaatgtacaaccagagagataataaacatcttacacagtagatggctcatgccatgataaatcctagcgtgcacttaccaacgctactcacgctgcaacacggtcggacaacagtagaacaaaaatgtcgtactatcagccctcttttctttatttatttatcccaaacaaggaaagaacttttcgtctttgcacctcctgtatgtatgaaaattagaaaaaaaaaaggtaaactgcacgctccagatcataagtttcggaaaagaaaagaaatctcttcatgcatctttccatccctgggttggatgctggactgtacaagcggagatgtgtaggtagctatcacctccatcaaacactcaaacaggacagtgagcatgaatgcacgaacacacgcacccaccgtaacgccaccggcatgcgaccaaacccagcccaatgcttgtcttggagttgttaagacagccgatggatcttctccttggacaattgtagggtcaaacaaaccatctcgacacacaaacacacacctatccatcgacaaatatactaccactatacccagcacacgcacggcacaataatcaggtcaaagatactactggtaccatctgtccatcatcatctcctacacaaccttcctcgtgaaaccctgtaccccaaccccatacacatcgtcatcatgctcatacccagtcggtgcgccagcggtatcacacaacaaaacaacaattgacacggtatatacatactacattacaaacatacttgctgttttatgttcatgtttcctttcagagatccttgaatgatgtatgcagtgcagcaggagaatatgccgttgatgtgcatttgtcattaccatccaaatagcatccatccaaatatccaattgcgttgtaccaaagcaccgcattgtgtgcactctgaatttagacgctgttgcaatcaacagctccatctctcttgttaggtcggcggcgcggaatcaagtgactgttgctagattccgtgcagccagccatgaaccatctctgcctgatgagctgcacggtgacacagagcttcactgtccttttgcgcttcacaaagcaaaagcaggagcacaaaggcagcagagaattttgttagacgaacatgattcatattgttcgcagtaaaattagagctacccagctactaacacatcgctagaccagcatggaatttgtgacctctggggatcaaaatttgttactacttactacaccacaacatacaaacaagcaaatgaccgatcaaccaacttcagcatgccagcttcccatggttcaggatatcagtaagctcaagcgtaggagctgagaacacgaacatcatggttcacaaagatttcccaagctcagaggatggcagtcccacaatacaagatgattacctctgggaaataaaaagggagttagtgaactggtaattatgggtaacatatagcaaaaagaacagctgaaggactcttaacaattattgcaaagtacaactaaaaattctcatgtttcttcaccatttcagtccaaaattaggttcagtcaatgaagcagggtactgagaaagtatgttgcattacattacaaaaagtggagtacacagaaaagcatgactgatgattaatgaactactcaccgtgtatgcaaaaaatctagatcaatgaactagagaactcaaccgttgtggtgtgtaaatcatctacaagcatgcaagtagtataaaaaggtacagacaaagaagaaaaggtagtaagcatgtctagtcaacatctttcatttctatatggaactggggagatgattaatacaaaaacatagtattcatcaccagagcacatcagtcatagtcaacaggaattagtgcaactgcaaaccagaccaattacaactaatgacaaacattgtcagcatttttaatgaccatcctgggcctgtatatcatgtatttgtgtggccatgcagagacacgctgactgaaaattgaacaaattccaggccttccaggcttctcgctaaagcaggtgctatagtaaaactgattgcaatttcatgcatgtttcttcagcattccactatcacatcagatggtcaggaggctggatacatccatcattatctattttcaattaatttcaaactcaatgtgatgaagtaatgtctgatatgtttgttattagtgcaagtgcctaaaacatcagtgttggtgttttagtcatcaaaatataacacatagcacgaatgtctaagctgtaggaagaaaacagtgtggggaatctatacccaagtatctcagatcaaacacccatgatacaaaagaagttcaagtagatctatgaagtcatatactcatatgttgaagttccaagaaatcaaggaaacatatctaaataggtgaaaggtggaacccaaaacgtaggatgagccacgtaagcaacaaaaatgtggctgtctgattcagtaaacaacaaagtagggagagaccgagagagcattgtaaccatcggatcagatggatggtaaaaaatatatagagagaaaaaacagtggtgtaaagaagcaactagagcccttgagaataaaaacgatagccatccaccgcctgtgactcttggtaccttttcattttagcccctattaatatctcttatcatgcactccactaaatagtacaaatatttgtgaaaatacccctacatcgtactcatatttttaagtcaaggatcttgcaagttttgattttaaaccattgtgcatgctaaattctaactagaaattacggcatgagcatggatttgctgtgacatagacatactaaactaactaaactcttttgttataattttactatgttatgggtataataaattctatagttttcttagaataaggacataataaattctatatatagggatggcaatggggacctgaaccccgatatccaacggggaaaaactccattaggggtgtaaacgggatgttatcggccaaaattttcatccgtcgggtaggccgggggcggggatgctccacaggcccccggccctgaatccccatgggggtgcacatccctctacagtcgcagcccacaatagaaaaataaaggctcaaggcccaatttggtggactgtatatataaagcaatgaaaccctctctcagatccaatcagcagcgggaggccgccaggctccgtaagaccgcggccatgctcagccgtcgcgcctcctggccgagcagccgtcgccacagccaaaagcagcacacgcgggtcgccgtcaccactaccatgcaggcgtgcagcagccgccacccccgctgcatggtgtcttcatctccttctagtctttcatgctctgccattgatgaagtctttccagctggcgacacaggcaagatgaaacggcaagatgcggaatcagcggccaagcgttgcgaacatgctacttgtttttttaaaaatttcttcttttgtatttcttgatttattttgttcttgtgatgattatttgtgcgaatgaatcgattacttcctattgatacgttcatatgtatgtgtgccattcttcctaaatctgtccttccaattgattcattttttctctaccctctgttccttcctgtttcaatttgttgagcagtggcctttgcgtttttccaggtgtgttgccccgtgggcccctgaaaccccggtgcagaatggagacggtagcaatacatcacccgacgccggggacggggacggggagcgggagatttcagtatgtccgggggtggggacggggtaccacaacccgacaggggcagccccgttgccatccctatctatatatgaagagcatctctctaagacttgccaacaaaaataaaatgaggatggtttcatagtgatatgctttgctataggtttaattaaaaattaaaagttcaaacttgtcatttcaaaaggtataattttcttaattcttgcataaattttacataagattaaacaaattccttgagagcctgcaaaattatgtgcataggctgtaaagcgggtgtgctaatggaaaataagggaagaataagggggtcatgcagaggtggtggaaacaccaggaagatggcgactcatgcagtggcgaagatggcaacaaataataaacggcaaagagaagatgaatggaaactctaaccctagctgttgcactcaccattttgtagccgaaagatgggatgtgcattttagattacaaacctatttacaacattactacatattacagatttagaaaatcattaaagagggaggtaatagtcgcagcagtaatgtatggtaaattttggtaaaaaaatctatggtaaattatttgttgttgtgataatatttttacttacaaatcaagataaatctgttaatgttatatctaacttcctgccaaagtatgttccacaaacacttatttacactgttagttgttattaccattttaaactaattactataaacaaacatataaacacttttaaaagggaggttatagttgcatgaacgcggaagtcaataggctagttatgagatgaaaacaacatgtttatggaagaaggagagcatacctaacagtatttcatcaaaaagcaacatacaacatgccatcaactcatcatcgctgggatttcctgaaatgtggaaagtgtcattataatatcttaagtggcaagggaaatcataaagagatatgcatatttatgtatgcaacagaaaatgcaatatcagcaagaacaaaaatattatgccccccccctccctctctctcatgtcaagtgaacccctaattcgttttaccatcagcaagaaaaataatcgacggaattaacaatgactcaatgagtaccagctaaacagccatctcacctgtgcaacagtagcgccccttctagtccacctatttccatggttgagggtaactgatgaagcagcagcagcagctgggacgttagtctgaggatggtcaggaatactcgaagtttgttgcccttgagaacagatatgttctggtagaacattttcagtaagtttatgtaaggtgtcacttctgtatagcgaacatgttcaagtgcaaaggattttcctcacccccttgaggttgtgacaaaaagaatctaaaaaagcttacttggattctgaaaactctatggtatcagactgctcttcataatcatcttccagattgattacaggaatcatttggccaatgctctgaccgtgaagcgtagcttgtccatctgcagcctggtctagaagcatctggtcttcctgtaactgagcactatctgcagcctgtttaccagcgccattgtttagaagcatttgttcactgttctggtcatgattatccaaatcatgcacacccataacatgattcaaaagcatttgctcattctttattgggcgatcatcgcctgaatgttcatcagcatcatgattgagctgcacctgttctccattcatattataattttccaacacttgtacagaggtactctgcccctgattcagaagcatttcttcagtttccaccaggtgtccatgatccgtgtgctcatctgcacaccgctttagaagcatttcctcaccgttcataaggccgttatctaaagtatgcacatccatgacatgatttatatgcatctggtcatcctccaactggtgattatcctgtccatgttcatcacctgtctgatttccaaccccttgttcattgttaaaatcatccgtaccatttctttgatttagaggcacttgttcatcctccgactggtggttgtcaaatgcatgttcatcttgaccttgagttcctgaagtgacgcagtttgctccttggctcatctgaccaacttgatcaggaacagagtcacgaccattatctaaaggcgaatcattggaaatctcaaccatttcacagttttcttgagattccacaacattgaggtcaaaaatcccataccaagctggcaggtcttgttcatctttggtaaggtctgcgttatcagtttcaacttcactctgcggagcctccattccatctctgacttcctcggccactggttctaccaagcatgaatccctgggagagatcggaccctccatgccctcctcagcatcgctgaactgggactgcctatgcagtggttcctcatcagactgtgatggatgaacaacatcctcgttggaattggacagcttgtgttgggtaacatttatttcagcaacgcttggataattgaaggcagcaacagcatcgtcaccatcgtcatcgtcatccccatatatatcttgagcttgatcgacctctatgatctctgactccacctctgctgtgtcttcattggctgcagcttggctggcactctcttttgtctccataacaaccactgaacggtgaggtgccttgagatctcttggcacatcatcagcatcaccgtatcccacatcagcatcaccgtcacggacaatgccaggctctggcaccttggaatgatccaaatcggcgccggatgctcgccaatctgaatccctccggctgccatagttatagctccttgtcctggttctgctcctgctcctgcttctgcttctgctcctgcttctgctcctgctcctccgtcttcgatccagcctgctatcactggagacacggcggtcgttttgtgaataggagcgtgacatggttggtctcctttggtcgtcgtagtcgtggctccggcgggcactccgatcggctgaggcggcatcattgtacttgcgcctgctgtcaaagctgttgctcctcctgtcccagccggatctacgggatagcctgtcatcgtcccctctgtcgcgggggaagtcggcattccggcgggacctggggtcgtcgacgtcatggttcctggcagcagggagggggtcctccctggcgcggagacggtgctcggggatgacgccctgggcgactaggtagcgggcggcgaggcggccggcctcgataaggacgtcagcgcgggagcggcggtcggcggcggcggtgagtagggcgtcgggtcggggtgggagatggacatggagagggaggctgtcctcgtggtggtgtcggcgggggcggtcggggtgcgtctgtctctgtgcgggttggggttggaggggggagcgcggtggtggcggcgcggggagggcgatcgtcggcggtatcgtcctcccgaggaggccgggggcgggtcgcggccgcgaatgcgagacctcgactgcatctgcatctgcatctgcaattttctcccttaccaccctaccctaggaggaggaggagaccggagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29074 - DNA, 25135 bp, Oryza sativa
aattctatgaaggattcaaactctgtcttctttatttgcttgatgatgaacctgtcatccaatgtttttgcaaagaaagccttactttttccaccttgagcatcccacttcatgcaccggctcaaggaagtgatatatgcaagctcagatgggcagcatttcttccgaagggtgtaaaactgattggcatgtacacaaataaccgagtatttccctttgagagatgatttcccattgacagatacttcaggatgaagtaaggatgacagaagtgagctatcatagctggagaagaggtcgtcagatgaaaagcttgcatctgagtctgaagatccaatagatgaccacgacgaagaggccgaagaagcttcagataatgagctgtaagatttctccatcttagagctctcactccccctgctgtaggctgcctcaccttcaaccatgagagcatctagtaaaagatggcgacgttcctccgatatggccagtgcgcgggatattatgctggatatttcatcctctgatatgcacaacacattgccacctggaccaactatgaactcagcagatgattgtttgtgcaggggggatagatgagatggagaatagttgttgacaagttcgaatctttccaaatacccggcctgcagttcatgcctgtaactctctcttaactcgtgcaatggactccaaatccatgtttccctgttatccccacattcaggatttatcaactgcgtatctgtaccttccaagactctgaaagaaggcacttttgtgatatgttgctcctcacgccgtgaattttcatcagttaaggtttcgctgctgtactgcatttccttgatatatccattctcaaagggcactgcactttcaccagttgcagctggttcaccggcaaattcagcagcttccttcttgccgacacaattagccattcttccagacttacactcaacaatttgatggaaacgacggtcccacacgtacagtcgaatcagaagatcctggtagagacaatttacaccaagaatctcattcacagaggagctagacatcccgctttcatcaacagccttcaccagagaatcctgtttgatgatattcatattggaattgacagttatcggagatgattagaatgcacacttatctctaggcttaccagttaccacaaggtaaagagaagaaaaaagaccagaaggtttaccacaaactgagctttttcttcaattagcatctcttcaagttgggaaacttctttgacaggaagagagtctccacagttaattgccacctcagagaaaatcttcatgtgctgtattaagctagaaacttcatagaaaagcttaactcctctcgcaagaaccttaaaaagtgcaacacaagcattaggcccaatctgacctatgaatgttcacaagataaatcatgtgatgaaaccgataaataaaatagtacatacatttcttccctcttgctcgaaccactcacgcatatcgggattgtgaaactcaagggttcgttgcggtttgcaggcagtgtaaatttcaactgatgaatattggaactttgcaactttggaacccaacctgaagtcaccattttttccaacaaaagaagaaagaaataaagaagggctaaaggatgtttagtatgtactacctccatattttaatgtatgatgccgttgattttttatccaacgtttgaccattcattttattcaaaaaatttatacaattatcatttattttattatgactcgattcatcatcaaatgttctttaagcatgatataaatactttcatatttgcacgaaaattttaaataaaacgaatggtcaaacgttggtcgaaaagtcaacggtgttatacattaaaatacggagggagtattatatagagagaacttttacacgacatgttcaaaatagttcttgagaaatgagaatacatacccaaaatatcgcaagcagtccctgttgaccaaatgcccacaaactgatagccttctagcagcagagtggcttgagaaactgagttcaaggaacttgccaaaggagagattacgcgcttcagttgatattagcactctccgagatgatttggatatccctctctcatgctcacatcttagacatctagtccacatccaaatttttccttcagattcaccaggcaaatgatgctgaggcagcaaacgcctcacattaatagttagatttccattgcggtgggtgtaagagtacatgtgagcatctggaggctctccacatgaggaacagcttaggttctgccacagttcagtaaaaaacatcacatcctgactagtagatatacaattgacctactatgtcatgtgttatcgaaattattcctaaaaaaatagataggtacctgattctgcaaaatgtcttgcaaatatcgtcctaaggagacatcgaaattcccataatagtttatgcggtatagatggctctcctcacagacaacctgcttcgtaacacattggctggataacaagatgagtatgctctgagaatccattacatcatcagcctcatctgtgtctgaatttatattttcgccggccctgtactgttccacattctgctgatgtttttcagtaccgaaaggatcaggctgtgacattttttggttggttttggcgaatacttgttcctggagatcatttaactgatccatatactcacaagaatgatcctttgttaaggtatcagacgccgtttcttggctggtttcagtatcttgttcattctgatgaccagttgtatcttgagaagaagttacaggtaaataaatattctgataacggaatatatcaatgaatcttctgagtgatccggagactgaggacagcaggttttcagatggaggtgcttcacagtggatggctgtaccctcatcttgtgtgtacgagtctggtttatttgtgaaaggaactgtagccttgtgatccccatcatggtattccagtaatgatcccctgctagtacaagtgacatcataatcagtaggaagtgaacgatttgagacaatggaagtctgatgagtgatttgtggtgtcccgtcaacatttgtatcattcaagaataccctctgatcttcaaagaaggatgtctcaacaaccagatggtatgcagcgaatattgtgtagtgcaagacttgcttgattttcttcagttcttgggtgcttgcgcctctgagcagtatctgcatgcgcgcgcgtattgagaataatgcagagtaattgatctaggtaattgaatgaaatggagtatttgatcgagtgcttacggtgcatcccaatgggttggaaaagccttccaagaacatcaatgttttagatggcttgttcagggcagcagcactagtagtggtggtggtgttatggtcctcgaagaacttgtcgatgtggaagtagtcgcagtgcttgaggtggttggggcaatcatggagaagctgggagaaggagagcaagggagcaccggaacagcgagcgattctctgcaagcggtggagcttcatgtcgagcagcagagtgacgccgtggtgcaggaggagctcctgaatgtcgcgggagacggtcttctcgaccatgacgacgttggggctgcaggtgtggatgatgtgggagatggaggctcggagaatgagcttgtcctgctccatggagtcgaaggaggagaagccgagatgggagtcgaggccgagggcgccgtggaggaggaggagggtggggcggtggcacttggtgggcatgtgcttgtgcgccgcgttcttgcggaacaccagcccccgcaccacctggctttgccgccgccttccggacgccacgcacttgatcttcacgtgggaggccgggtccatgtcgttgccggcggtgcaggcgtgggtctggatcagcagcgccgcctcccaggacagcgccgtcaccacctccagccactcctcctccacgcccgccgatgccaggaaccggctggccagcatgttcagctgcccgttcatggcgctcaccatctgcgccctctgccgctcctcctcctcgtcttcgcccctgctgccaggactaccagcaggagtcggatcgccatcgtcgtcgtcgtcgtccgccgcagcagcagcagcagcatcagcagggggtgggggtacccagtcccagtcccagtcgtcgtgggcgttagtatgatgggccgcaggtgaatcatcgccggcggcaacggaagaacagtagtaccggccatcctccggcgggtaactgatcgccatgatctctactacactattcatctatatatgcatgcacttacttgagttatttgctcgatcgaaagaagatcataaaaagaattgaaactaatgcaattaattagctagcgaagcgttaattaccttatagcaggaggagcaagtgtctaggtatctcttagaaatcgatcgagaatgagtatatcttgttgcagttggctcctgtcctgtccaccatcgataatctggaacaaaatatgcatgtactcctagctaggcacactcgtacagtatatagactgactagaagtatatattattattactcccctgtggctctgatcctaattaaattgcatgcatgatattgtttggtggtgttggtggctgggctgccttaactgtcatctatcatgcaattaggaagtactccagatcgatctggtactatcaatgttatataaggactcaaacgaaggactagctgatccaatcaaggcaaagcactacacacagactctaccggatctgccccctctgatgctcgatctgcttctcacactcacacgtcccattccagtgagactagagtatcttcgatattattattgtactccacctagctaaattaatacagtatatatatatccagcataaccaaaataataattcagacttttctttcctggctttttcttcaaattctttctttcttttgagcctaattaatgatttgttgtatagtatttgaccagaagaagaagaagataaagcagggcatgcatacgtggtgtgctgacaaatgtgtactagtagtacattatgtaagttccatccgatcatatatatgtgttgatgattgagtggagataaacatgcatgccgacgcgtggatgccgctcaggcttgactgcacagcagctacgtgtccggatggcaacaaagccacatacatacccccaatcagctactactactcatgcgtacatacggccggccggaggagtggacgactagtctgcattcatcatcatatgcaggtgaagcaaacccctagattttatattagtggagtagtaccacttaattactagctagtttatttaaactaattattactagctagctactagtagtatgtatgttatttcggcgaatgggggctgaattattgatccacatacacaatccaatcgaatggatgcaatgattgattagcttctcaataattctcacaaatacggacggatgtactacatgattaactagcaacgactaataccctgtttctttcagcttaaaattattataatctagattattgagccagattactataaactagattgttataatttgtaatataataagcagttagttgtttctttcctagattattgggtttgcaagtctaaagagggagtggggtggcatggtgggtaatttttcacccaataatctgaaaaaagctcatctaaataagcttatcagattataataagctgggctccagattataataagctacttcaataagttgtctgtttctttcagcttactcccaataatctggattataataatctcaagctgaaagaaatagggcctaatactagttatactccctcccagctttttaatggatgataacgttaaattttatcagacgtttgactattccttgtaaatatacattataagtaatatacataaagttactttaatgataaaccaaatcacaacaatataaaaggatatttacttaattttttaactaagataatgatcaaatatcatgcatgttaaaaatcaatggcattgtctattacaaaaggagagagtataagccccgttcttttctccaacaaaagttgaataaaattttggatacttgtagcatgcttttcaaactgctaaatggtgtgtttcgtgcaaaaactttctatatgaaagttactttaaaatatcatattaatctatttttcaagtttgtaataattaaaactcaattaagcatacgttaatatcacctcattttacgttaaaaacttaatcttcatctttatgttcattttcagaagaaaagaactcaattaatcatatatagataagtcgtaagtgattcttggatggaaaatcaagtgggcattaattccatgtattctccatgtgtgaaacagagactaataaggaattactaggttttatgtatcccaaatctcaatcacacgcttcatatccgttggatgtcagccaaaggagagggagtagtgggattcaggatggcttttgagggagggccaaggaggtggtggacatagatgggcgatggcagcagagttacgatgttatttaggaggataatgtgtaaggtcgatagtggagatgtcagatttgaagctgttaaaaggttggggcatctcgacaacgtgggtcggtagacaatgaagtcgagcaaggtaaagacatattggtgtcgtctaggctaaggtaggagaaataaggggagagggaaaggagagatgagtcagtcgggtagtgcatatcgacaccatcaaagccaaggaattggggcaggggagacgaggacgacgacattggtgtcgtagggtttcttatgagggtaatgggtgaggtttgtgctgggatgtcagacctaaagtggttaagaagtaagggtatctcaacaacgctaggtggcaaagatgggtgagacaagggcacctttgtgctgctaaggcttagggaggagggagcagagaagggaggagcgagaaaggaggcggtctgacatggcacgccggcgccgacgaggccgcagcatggagtgagaggtgaacggaaaaaaaaagaaaatataatattattgttctgcataaatcttcgcatatgatctgaattttctgaaatttatggttgtttttgtgtcactgaaaactaggcacccaaagtaataaaactcactgctgaacgtgtatatatctaagttgatcaatatgattcaggcgaatgtattttaatcagttcagttgatcgtgcgtgcatcctcgcggtccaagtgtacatcgtctggatatgccatgcaatcaggcaatcggccaacgtagcaatcagtaatcatgtatgtatactccagggcagccgaggctaattgtcaaattaattatcggacgacctcttgtggctatcgatagatccatcgatcaatggaatgggatgttgattcgccatcatcagaatagatcatagatctagctagcaagcaagcgcagaaattaagagagagacatggtaatataatcatgtatgcatggagattaattaatactcctaggtataactccaaggattagattgtaccacacatatggagtatgtagcagatagagaggaaaaattgtggaacatacattcagctggaatggaatgatgctgaacccctggaatcaactagaattcaatcattagctactgccatcgatccgattgctttcgattaatcgatggatggatatgattcaacattggtctggtggactatatagctagcttctgcagacctaattatcatcgtcgtggaaattggaattaatcatccgcatgcattgaatatttgaattcaagaaaatgtacatttagtgccatcgttgattaattacagatgaggatttcgtttcattttctcacgtcgatccagaaaacgggcgatttaatcttcaaagttttggggccttaatttgtctaaaagcgtaaatatatgggccaaattattctttatatgggctggattttgggccatatatctctgtgaaatatacatatgggctggatttcacatctcgaaaacaaataagtccactttgtcacatctcgaaaacaaataagaataccagatatcttatccgtaactattaaaaccaataaaaataaccctcttgatgtttttaaaagtggctttgaggttggttttttctgatgtggctcactaatctagtccaaccaactaaatcagcatgtgaaacccacatgtcatcatctctcttcttcccttcctcatcctcctatctcttgaaaaagtggacctctaaaaaattatcctagtacgcatgattgcagaagccagtccatgtatatgagactatccttcatttgccatattaggtcgatttggctcatgttcaacgtcatgggccaaaaatttagtatctcttctattactccaagacatatactctaataaattatttcatccgtttcaaagtataacaacatgtaacattcaatcataatataacaacttcttaacctacataatcttctcaaccaatcatcaatcacaaactgctatgttttagggctagttcactttattgctaattttaagcctatcaaattttagtagggtaaccaactaaacatagccggctagctgcaccattaccaccctatcgaaaattggtagtaatttcgaaagtttcctcctcacagtaactccaccaaaatttagcaaagctcccatccaaatacatccaatgcttctaaattttagtagcaccaaaacaagattgattttggtaataaagtgaacaagctattaatttattcacatattttctcttttcaacaaatcgtaacattctttcatttaaatcttcatactttcttaatacacatatccaactccagaacttcttatattgggtagtagtaattaacaaacacacgtttaaaggaagggagaaaattccttatatgaatgccattgaaagttcaccagtgtactagctcatatgccactgaaaatttgatattttcatatatgccacttaacgaatttttccttccctcatatgccatccttcatgtgatcattttagttagcatggaaagtacaaaatcaccctcagtttcctcctcttatgttatgcactagcactatctcccatttttgtcattgccaaggctcccatcgggcctaataagggcagttccaacccatagtggccataagcagtgtctatggtgacatgtcaataagacatcacaatagaaactacactctacaacccatagtttcttaaagtgtgccattaataaatacatcatctatcttctctactaatcatatttattctttatctattatgaagacactattctctcacaatgcaaaactttatagtgtctagtgcataggttattgtgttgaaactgtgtcttgcatgagacccagtttctttctctcttcactctctctcttaattaatatagtgtcacataagctaaaagtccgacatggcaatgtagttaatatcttaggtggagggttgggactgccctaagccaaggaaaaagcaaaaatttaaattttcaaacttaattttaagattgattttaagatatttttaacgtaatttcttttacagtattggcttttaagtcatcaagaacacatatataaaagttttacccacaaattcatttttattccctaataagtcgttttgacttattaaggaaaaggcaaacgatggagcctcaaatcttgtatggtactccacctccctccacatggctcaagaatagacaggtaaatagtccgaaatgactgctatctaccttaattttctcgctacgaataaatataaaactatctgttcaagaggttcggttggaaactcacctcccgggcacgtaaaacggagcgacatgttttcttataattaattaagtatttattattttttttaaaagaatatattaataatatttttaaagcaatttttgtatagaaaattttttaaataaaacacacaatttagcagtttgaaaagcgtgcgcgaaaaaataaggaagagagatgagttgggaaagttggggaaagaactcagccacccatggtgcaattcaattaagcattcaattaattcttcagttaaaatacaataatttgctaagtcgagaccctgttaccacacctcaattgctttgtaacgacatgaaaatggaataaacgaatgaagagaccgtaccgacgtaaggtggattagccggccgggcctgctactgcatatacacttatgttatactgccctactgtagaagtacgtgcagagagagagtcacggaggggcatgcatgcagggggcatttctacagttgcaggtagagacacgcacgtccaataattatgattctcttgtcgatccatcagctgatcgatcgcacgtcgctttctgatctctagatcaaagccccaaataacccacatattacatcatcacacatgcatatactccccgtcccataaaaatttagggccctttaaatcacagaaatgagaaaatatagaaatagaaaaaacgcagatttttataggaatgtaagtgtaaaacagaggattgcaaaacataggaaaaacagaggaatgaccgtttgatttgaccacggaaaaaacgcagaaattagaggagagataaagactcaaaggaaagtttccaagagattttacctaatgttagaattcctccaaaacttgtatggcattaggcaatccatgggatttttatatgattccataagatccattcctttgattcaaatggctatataggaaaaattcctatagtaatgaaatcctctaaaattcttatgaatttcctttgaatcaaaggggccttaacctaagataggatgttagatccttcctagtacaacgaatctggatttacgccgtgtttagttccaaaataattcttcaaccttccaacttttacatcacatcaaaacttttctacatacacaaactttcaacttttccatcacatcgtttcaatttcaaccaaacttctaattttgatgtgaactaaacacagctttacagtatgaggggttaagtttttttagatggagtatatatgcaggggtaaatgctctcgatctttcttgtagtcgtaattcctcacatatactccctccgtcccaaaatgtaagtattttttactatgaatctgaatagtaaaaaaatgatatattttgatatggaggtagtagaatatacttgaccaacaaaaggtcgattgatatacatcaagtggaagctagagcctagagctggggtatcgtgatgtacgcatgacatgtgcatatatatgaccaggttgatcttggccagttcttgacaaactcgagaaattattttgcacaagtatcacaataagcaagcaaaacattcatcatcgatcattcatgtgtgatctgcgtatacttatatactccttccatttctttttattatttcgattttttgggatttctcctgtgttgacgaggagaaggcacaggagcaaatatataatttcacagctttcttaattttgagggaaaggtcggaaacgtcaaataaaacgaaacggagggagtatatcgtccatcgtgccctgttaattagctctcggtcattaatggctgccctggcctgctgctggtacaatacaagtcggtcattgtgtttgttagcatgtcattctcctggcataaagagcacgcacccaatgccatgccgtatactccagtttgcatcattgcacttgcagactgcgtaccggccactggtggagaaagcgtttgtagtcccggttcgtaacctctctttagtcccggtttttaaaccgagactaccaatctgggactaaaaatcgctatctttagtcctgggtgaaataactgggactaaagatggctcagtcacgtggccggctgagccatctgttaccaaccgggactaaagatcgagctgaccttttttttgcatggccctgttgctgcatggtttatatatatatatatatatatatatataatatatatatttttatgtgcatatatatatatatgaccaaaatatatatttatattaaagaaaatatgtacatgcatatagaaaaatagacatgtattaattacaatccattatgatgtcctagctagctacgatttcgacgtagtagtaggcgtcatctcagaagctaaggacctatgaattgtatttccgtcgtagtagaattcacccttgggatcaaggatttgttcgttgatgaatcccatgagttgttcttgaaccgccgcgataaattccttgtgtgtgatcaggttatccctcatgcgaataaactatatgaatgtatgaaattaattagtaattaaacaaaaaatcgatacatacgcaatgaaattttgaatttatttgtacgtacatcgagctctcttgtgatgatgatttggtctgcaagacagtggcaatactcgcacacgtagtagccacacaagttagttccctgcttttgctttgcacactataaataaatgacaaacggcgagagatgtaattaatatacacttgtatgtatttgaattggaaattgaatataaatgtagagcatgtgtactcacaggaaaattgaacttccgcctaagtctttctctccatttgccgcggaccaaatgatggaaccgataccaagccctacatggagtttaaagctatgattcgtagtagcaattaattataacaagattcttaattaacataggaacttatgacagtacatgtctataagttcgaaaaccttgtcaaacgtagactcttttttatccattgagtcatatacgttgacggtgcaggcctccaggtcgaagagtaaaaggacctagtggaatctgcaatgtgcgtgggatgcattacatatgaaacacttagcatgttcgtacaggaatgaaatttgttataggaagacagtaaaaactaactctgtgttgtacggcaatagtatgaacgtcttgtaatgctgcgccttcaggagatggacgagattgtcctctgtggcttgcggatactggtcgagcattgcgacgtttactttccgagggtcgatgaatccagtatcgaaaaccccccaccgtcgggccctttgaatctccattctacaacgataaaaggaagtatatattatatatattctacttatatacaatgacctaattaattaaaggaaacgtaataagaaatctaactgaacgatacttacaatatccagtaactcataatagagacgtcgagggcatccagctggtatagttcgtagatacccttgaaattgatccagagaatgtcatctccttgcaagaagtccgtgtccctgatcctcactccgatcatctctctaccggtggcgctcatctccatgtacagttgatggaacttgtacatttgtgtgggtagggactacagctgcttaggcttgacaagcggtttactgagttcgtacatgtatttcactgacaggccctaacagcatttgaaccgggactaaagatgatctttagtcccggttatgcccgttaccctttttaatcgggactaaagatcatctttagctctggtttttattgcaaccgggattattgtagaattcggccgaccaacgaaagatgatttctccaccagtgggcctgaaggtggaggctatatatgctaattaacccatacctggcgaaatataaattgccgtttctaatacttcaattcaaatttacaaatttttaaataatatttttcctttgttcatattgaacacatgaaaaatatgttcgtaataatatacagcacgatgatcaaattattttttaatacatatatatactacatattttggtgaccgacaggatatgctagctaatgctaagccaacagttttcaaaccatcgcatcagcactaagtgtgtgcgtgcttgatcgcagaattgatatcgcgatcgatggtcctgtaaatgcatcatactcctatgtaataatggatggatgtgcacaggaattaataagatgggagcaactcccctccatccaagctatagaagatcactactagctcaggactcgtgttttcaaccgatcgttgatcgagcaatcacttcagatcgagtgtgtttaaaaaagattcaaattttgcctaaaaagggaactccaaatcgaggtggattactactacttatttgcctcaatgtatcatgtacttcatccattcgaaaatattactccctccgtttcaaaatatttgacaccgttgaatttttagctcatatttgaccgttcgtcttattaaaaaattatgaaatatgtaaaactatatgtatacatgaaagtatatttaacaatgaatcaaatgatatgaaaaaaaaataattacttaattttttttaataagacgaatggtcaaacacgtactaaaaagtaactgtgtcacatattttaaaacagaggagtatcatttctagctacaaagagcatcaatgtataattagcttacttatttgcctcgaccaaccgtggtagcaaataggaagagcgaagtaaacaagagctgtgcatgttttcctatagacatggattgaacgcttttcgaagatccaaaaaaaatagtaggagtaataagagcaagtttaatagtttaatagtatagccaactactagctccaattcatttataaacaatctaatagcttatccatacaatagttacatactacactattaatatatgatcccacctgtcatacacacactaagttttagagtccgtgctatagctggctacaaatctgtagcctgctacttttctctctcattatttatctcattaaaatatatttgcagttggcttatagcctgctattctatctgctctaagaagcatgagccagtggcatgtttgaagagagaaaatatggtgtagctagctaattaattgacttgctgtgcattagtgtaggtacttttgtgagggagaggaaagaaaagtatggcgcataggagtagaatagaatagaagcacgcgtgaagcagttggaacaagaacataggatacacaagtgcatttttggtaccacgtacgccacacaagtggtttatttatagaatgagtcgttagagtagagcaataccattacaggtagaactttattaataaagacaaaattattcttgtagtatgatgctagtactacacgtatgtactactagtatatatggagagatatgtcatggtacacacagtggcagtggcagaatgttcaatttctccacagagacgaccaaagggatagatgagaatatacacgcacattccacaggcacggaatgaaagaaaagagaaggaaaagaggaaaggcagaagaaactgcaggcgggcagcaagataggaatctcatcaagaaaaaaaagagaaaagaatggtgggcgaacgaaaagaatgtagcaacaaccaactttgctccttccagacttattagttgttcttcttctcttgcgcgcattatttgagcgcgaatgattgcgttggctcgccgggcggatggctgcctgtctgcgtctgcgtctaccaccgcccgggactggactggacctcgcgcgcgcgccttgtgaattttgagagtagaggacgggtaaaaactccccgtatgttatgatgcttctgctgcacgtacttggtccagatgacgagtgaattggcaaggacggacggacggacggaagggaacggaatgggtaggtacggtagtagttgtgttcagaggaggacgtcggacttggcgggtagtcgcttgtagaagttgaaggggacggacggctgcttgctgcggaagcgcggatggcggaggaggtacagccccaccaccaccgccaccacctggaacggcgtgacgtagagcaccaccgcgatgatgagcgagagcaggacgaagatggaggtggcacgggggtcgcgccagctgagcagcgcctgggcgcgctccccctgcgtggccaggtcacccaccaccgtctgcaccctcccggccacgctccgcagccggtcgtacctcatccgcaccacgtccccgggcttgctggtggggaacgtgtcgaactcctcgtccagctcgtccgggtgcacctgctccgcctccgcgtgcgacagcgccgtgtccatgtgcgccggcttccgcggccgcctccggtagttccacaccccgatgacgaacaggtagaggaagacggtggggaggatcagctccgggtagcacaccaggatgaggaacagcacgtgcaccaggatggtggtcaccgggttcttccacttgcagatcccatccatccaccgcgccaccgccaccgccccggagaagagcgacgtcatccgcttgaagttggccttgctccgacgcaggctgaacatgtgggagtccacgtccagcatgtactccaccacctcacggtgcagcgggggctccgcgcgacccagccgcgccgccaccatctgcatcgcctggaaccgcaggtagtccatctgcagcaccgagatggggtgggtgtagtgcatcttgggcagcagcggcttcccgtacatggccagcatgttggcccacgccgtgcacgtgaaccgcaccgccaggtggagctccccggtcttcttcaggccccccggcgtcagcgtcatcagcgggtagaagtgggtgtacacgcgctccgtctccagcgtcgacagccgcacccgcaccttgccgatccgctggtccttggcgtccccgccccccgtcaggtggcagttgtcgaacaccgccaccgtcaccaccgtgcacaggtcgaacacctcccacgtgtactgctcgttccaccggggcgccgccgtccccaccagcgtccgcgtccgcacccacttcgccccgtacttggccacgcagtaggggctcttcccgcccgccaggttccgcgccccgaggatgcccagctccaggatcccgatcgggctcttcctcagcttcttcgccgccggctgcaggtcgctgctgtagtgcgtcgactcgtccaacacgtggtacgccgtctccaggctcagccgcaggtggatcttgctcgcgaacgacgacttgagcttcgtcgcctccgccgccgcggcctcgtccgccgtcagcgcccgcgacaggctgaaccacttggcctcgatcgacttggccaggtcgttgcgaggcacgtagggcgccgccaccgggatgatcacgcgccccaccggctcgtcccgccccgccgccacgcgctcctccaccgtcaccaccagcggctcgtcgaacggctccgcggccacgaacaggaactcctcgttccacatcgggttggccgacccctgcgaccgcgtccgccgcgtctgcccgcccagctgtatcttgacgatggacggtgccagcgggcggcccttctcggcggggatgaggtcttgcgccgcgatggccaccaccttgaggtagatgagcttgggggagtagtacaccttggagcgcgtgctggcgaggctgtcaagggagacggagtgggcgtccgagtgccaggcctccgggaacgcctcgtcggcctgcgtgccgttccagacggcgagcatgatctcgccgtggcgaatcttctcgccggagcggtcggcgaggcggtaccactgcggggcgagggggctgtcgggcgggacgcggttggggatgtcggtcatgtcgaagacaacgcggccgacgaagtcgtccttgaggacgtccttgtccttgacgaccacctcaagctggctggactgcaggtgatcgcgggagaaggcgaagacctggcgccacaccgggttggggttcttctcgaggtggcgggtgacgcccttgaagttgccgagcctgacctcgacgtaggggtcgagcgcgccggtgatgtccatgttggggaggtcgcgcgccttgaccacgctcacgtacaggtacgacatgggctccaccatgtcgtaggtggaggcgatcttggccgcggcggccaccgcggcgcgtgggcccatcttggccggcagcggcggcttggtctccaccaggccgaacgccgaggggggggcccgggggcggggccgggagggcgcggcatgatcacggtctggcctggcggcggtggcggcgcggccaccgcgtggagcgtggcacgcctgggttgagaggcggcgggggcgggggcttggacggggacggagcggaacacacgaggaggctcgtggtcgtgggtggtcttgcccttggactccgactccgggggcggtggctgcgcctgcgcctgcgcctctccatggggaaaggcgggaggaggcctgctgtcgggttgctcggcggagacggactggggaggctggtgctggtggtggtggacagcgggagcaggaggaggatcaggggagtcgttggcgatgaggtagagtcggagggcgatgtcgccggagacgcgggagaagaggccgcgcttctcgagcgggtagcgctggaggagggcgtcctgcggggagggggcgagggaggcagcggagatgcggacgcggccgaggaaggtgtggaggcgggtggcgtggtggtcggtgaggctgcgatcgtggtggacggagacgtcgacggggagggaggggaggcgggaggggtcgcggacgtcgaacacgagggtgtggttccattgcggggaacgatcggcgggcttggtcggggtgcgctgcttctgcccgtcgaactccacctctacgaacgcgttgcaggcgccggcgccgtccttgggcgcaagctccgacgcgtccaatatctccacgcccaccttcatgctgcctctctgcttgctctctactctagtgctattccctcatctgcttctgctggaatgttgtggtctaatagcaggaggaattggagagggatgggcggcgtgggagagcatatcaacagggcagagcggcaccttccaacactctgtttggcggtggacatgatctccatccatccccaataatactccaaaacataatcaaggaggaagctaagggcctctatctaattgattgctagccattactgtacttgtactccttttcttatttatttatgggagtacctatacatctttcgaaagatttttataatcgtatcacacagatttttaatctttgtattaaaatccgatagatataataaaaagcaaaaagcaattaagaaacaccataataaacattaaattaccatatcctcaagaaaaagaccaaatccaatacaaaatttaaaatttacatgtgaagatttaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgtttatttattactactatacgctaataacaacaggccaccccgcccaggggaaaacgatggagtgacgccacacacacaccggtaacaaactctacttctacttttcatcttttcgtcggcagaatcgatcgggtcgggggggttttttcgaaccaaagaggccccttttccacagcgcacgctccctcccttggttctagaccatggagtaatggtcatggaatagtaaaaggtttactagtcctccttttcttccattccattcccttcccttccgttccaccaaacgcatgcatgattggatcaaattttatctctttcttctctatacatatgtatacttcaagataagatagatagatcacgcatggaaggcatgatcagacgatgtcatgttttcatttgcatcaatctcccaaacttgcttattttcattcattcctactgatacttttgcgagcacgggtagctttggaaagcagcacgacacgataagaaagagtatactagaacattcagagaatcaacctgctgctactacgactccagtagtattactaaaaaaaaggcacgcatgcatgccgagttgcctaactgcagcacaccgcgcagcgcaatccagcaaacccaaaaggttaacgttctaatagcagaccggcttcccgcccccccccccccccccctctctctctctctctccccctcaagtcttaactaaccgactagtacaacacaattccaaatcagataaacaaacgacttcgctctttcacttctccaaacctcacgattgcccagcaaattaacatccgcttatcaaactagttaggtactaatacatcgtatgttagctgtaggagaactatatatgaattataatttttttcttaggtactatacgattttttttcatgtgtttatatatttttgcaccttgataaattatctgaaggttataaatggtatatatgaattataatttttttacttattatatgattatgatttgctttcacgtgtttatatattttgtatcttgataaattatctacaagttataaatggttgtgttgtatggtgcgtttttagggagaacatatgcaatttgcatacttgataaatcatcaaaggctaaaaacaattaagatgacatgacttcttgagagaagagataattatcactaacttcacttggcaaggatgaactttatagatatatagcattatggagtatattttatcttgatcaattatctgaatgatatggtttgcatggtgtggtacatttttcaccattgatgaatcatccaaaactagaaacaattgagatgatgtctttacgagagaaaagataattaacattaactatacttattaggaaataacttatagatacataatattccaattacgtggaggtacctgcggacgatgcctccttccagcggcgcagtcacgacggtcgacagctaccaacacctccatacccgttgactagcagacgcacagaagttagagcacctcaaaaagcctctctacttaaatggctacttgagtgtgtgtgcgtgtgtgagagagagagagagagagagagaggagaatggacgagtggcgatagcggtatcgaggtgggagaagggagacgaggcggcgtgaaggagcggcggcgccagcgagatgggagacgaggcggtaaagaggccggtgcggtagggctccgtcgtcacctcacgcacgtacaaatccattgtcgccttcgctgttcgtcgccatcgttacctcacatggctcgaggaaaagggggagaaaagaggaggaagaataaggggtatttgaggctgacacacgggtcccactgtcatagacttataatagagagtgtagatggaaagtatgttggagtaagtaacgagtctgacttgacaaatcagatggagagttagctatattggagagttttttttatagtatgttgaagatgctcttagatgaccctaacaaattaccttggcgagcatgacacatgggttccatggagaggaagagaaaagaggagagggaagatgatatataggtctcactgttttttcagtttttttttctctggcttacatgtgtgtcacgtctatttctatcttttttaaaatatgtatattatgaaaaactgagtcaaagagccatgtaagcaccatatagcacgaaatcaccatagaaaaccacccacgaggttaaggaatgttaataaaactcggatcacagttgggggatatggaatagacttctttccttctagagaagtactgtgtggcgaagtatgtggtgagaattccataaatggcctaacccagtgaaagtccaatccggcccaacgtgaatcatcttaggctttaatatgtgggcatgcctgcctgccagcatgctttggattgctgagcatggccttctctaaactggccgtaaggcctgcataaatctgagagacagctttcagagacaaacatacatactaagtagtagtaaataagtctatattgcctccctcctctctttcaagccctcaaccgtaaaatttggttataacgtccatctttgaagctcggtgcaaaacgaatcattctatggttggtttttgctgacgtgaaaggttgaccatggttaactcgttgagtcagcagggggacccacatgttggagactcacatgcaaatctcttgggaaaaaaattagtagggtcaacatgtcattctctctacttccctccccttactctcttcccgtttttcttctccatctatcttaccgacgagagacagagagagggccagacgactacgagcagtggtagagcaaggcaacaacaattcgtggttgacgaggaggagaggagaggcaagggagaggggtggggaggatgaaggcgagggcaataaggggatgttctgtcaccacatgcaccttggtgtcgtgtgtggcagcgacgacgtctggcgcaactcctggccacgtgaaccctggaggccagggttaccgtgagcggcgggcgagggatcgcgctgatgcttcagcccgtgggtgacgttgtggtcctcctctagccaatgcggcgatgttttgcggttgtggcagcagcttgaccacaaggctactgaggagcggtgcacggggccacgacaccgacacaacggagtaagggtagtgtgggcaaggggaggaggagctcatgttgtcgaagtcagagttgaatgtgtctctgccacgcagccacattgatgtgttgtgtagtgcgcatgtgactagttgtcgggataacttggtccgagtcgctcgaacaaggcatggaggtgcgtgatgaatatttggattccatcgctgtgatgtccaccgccgcccacgtaggtctcacttgctaacttagtgagacaaccatatttattcaacctgccacgttagcataaaccacttcccaacccacggaagaagtatttgtaccgttttttgaagacggggagacactataccccggttttacaattgagggagatgattcaatgcaagaaacaagggagacggaatagacttattccaatatacgagtgatttggttccttaggttgtgtttagaggagaggttaggaacatttctctcgtgcacggaaatcagggttacttatttgcacatgattaattaaatattagctaaaaaaactgagaaatggattaatacgattttttttacaaaagaactttcttatagaaaattctggcaaaacaaacaccatttagtagttcggaaagtatgcgtgtggaaaatgagagagtggaggttaggaatctacgcttgcgaacatagccttagctactattccaaatggagtaactgcacttgtgtataaatccactcattttgcttacatcctttagtcataaatatttgacattttgaataaaattatatcaaaattttaaaattccaaccataaataacttctcaaatgctaagtttctttttttaaaaaagctaaatgtaaagttaacttgaaaagtactactgtaatattatacagtactagaagtattactcgctccatcttaaaacataataaaatatcagattggacatgtcgtactactacgaatcattggaaagacattattgtccgtataaagtttatgtacttaagaaaatgtgctgcgataaatccatctagggaatgcgatccccactttagatgatggcctaaactcaggtcaaacccaataagcagctcatgtgcaagtagtactgctatgcaactagtagtagtactgaaaatgagggcaaattggtaggtttggagcgcaaaagcgaaattcaaaatttgacctcatatcgtcatccaatcacacattttgaggaatatagaattttcttcttcttttgcttatctttaggaggatatagatttatttttaaaaaatagtaaagtgagagaggagtgagctgtgagcgaatcagggaggaattgtccccaagtccaagtgaagagaagaggtgtgagagaagagaagagaagcggcgcgggggagctctgctctgctcactactagtgtttctctactcgccgacggggcgccgggcgccgccaccccacccccccgagctcgccgtcagccgcaaccgccggggctggggctccctcctccactctaagcttgctgcaagggaagggttccgccggccggctgcatccatcccatcccctcccggccaattggggaactggaatcccgatttcatccaggtgagtgagtatcccactgcatctgcatctgcatccgcatctctccgtcgccgcctgctcatctgctcatctggatctgcagctaaattacctgccaccgcagatggccgccgcccacaagctagggttcagggaggaggacgccctcaggttcctcttcggcgaggatctcctcgccatgcaccactccgccgcagcctcctccttcgacaggtcgcaacccgaggtccaggtcttcagggacgtcttctctccgtctccacctcttcttcatgtggccgagacttcatccctgctccccactgctgctgctgctgcgcctgcgcctccgcctccgcctgcgcctgcgccttcactccaccaccacctgcacgcgctgcagcctcaacccgcgcccgtggaggtcgacgccgccgccatcgatcccaaacattctcacggccccgtgctacatgggaatgggaatgggaatgggaatggaggcctcgagttggacgccgcattgcagggcttcgttgcttactggcaaggcggaggcagctctctaagtgtaaccgacgctgacctcttccatgacatgatgcaaccaacgccgccgcaacactccgctggacctcctcctcctccccctcctgctgctgctggaatgtgcaccgccttggctgccagcagcagcaacagtggagtcgaagatcctttgccttcctatatggaggcactagcagacttctctgatttccacaatgacgctcttctttccgatccc

SEQ ID NO: 29075 - DNA, 24528 bp, Oryza sativa
  unsure (1)..(24528): unsure at all n locations
atctgtctgtcacaggaccagaccacttctcactctacagcaacacagtctatgatactacgcttctgcctcacctgtcccgcgactctactgcttctgctcactttgtccaacttgacaacctctgtcagaattttggtacgccaggcgcaagtattggttcgcttgatgatgctgctgatgtcgctgctgacaacactcaacactacggcactactgctgttgcttccaagaggaatttaagcagggaactccctgatcagctggaggtacatgctcagcaccttttcatggatgccggctggaccatcaagccacggaaaaggaatgacagggctaagatggcatcctatttcactgcaccacacagggaggttgttcatacctctctaactcaggcttggaagttctgtggcaagaaattgtatgaagctaccccgtgttcacaacgcggaaagtgtcctaaggagtggtcagatgtcgatacattttggaaggacctcacagatacaatggcttatgtcgataagatgctcgtgaaccgccaagatgcacccactcttcttcatcggtgggagcttttggatcctttcatagctgttgtgttcattggtaggaaaattactgctctgcaacaacataaaactcttagagctgttgatagttcgacctatgttctcaatgacagcaggaatgtcccctcagaaagtaagagcatgctgaaatccagtgatttgttgcccactcgcatgattcaacctactccagtgatcacggactctgattgtagcacactagcaactgagagtggcaacgggaatcatgctttacagagctgccatgacttggaggatggccacaacggggatactaacctgagtactctctgcacacagagccagctgtattgcgcggcaggtgacacaagtcaaagaacagaaaatcccatttctgaaagtaatggacaaagggaactttggtctggagcaacacttattaatagcgcagtgaaaaagactaagaagaaatccaaaaggatatcagatattgattcaactggactagatggactgcattctgaaagttttatgcagcctgctgtggaaattgtgttaaaccaagaaaccgaactagcaagtgtggaattgtcttttgcagaaacaatatgcgctctgaggaacatggtatctgttcatctgttggcacatcgaaaaggcacttgaaagctgaatccaaattagcaaagctaaatgcaaacaaccaaagcaacaagctcgacgtgctcttgccttcagaagtcatgcaaaccagcatattacagggcgaggagactgttgagcaacctgcaggattcaacatactcccagaaaatggttctactccaacggaatcaggttccagcaagttcatccccataggaaatgaagagaagaagttgctgtcgctgaaggaatcatccattggaattttccccaaggatgtacataatcttccaacggtcaactctgttcctgttaacctatcctacgaatctaatgctgctgtcctgaaaactgatttatctcaggagtcaccgacgtgcaaggcagttgctgctaaaagaaaacctcaagcttgggagaagtatgccaagaaaaggccccgtgtgttacgtatcaatgacgatgatcttttgatcacagctatggtgaaaaatagggatcttggctcctgccacaaatttgctgcagactccatttttttggatgcaaagaagtttacaaagtttaagagctcaaagaaatgtggcaggctacttgctcgaatgtccggaaaaggaggatcaaatctgttgggtgggaagagagtaagtttggcacggaaaacagttctctgctggttgattgccactggctttctgaccgtaaaagatgttatacagtaccagaatctgaagagcaacgaagttgttaaggatgggcaggttacctgggaaggcattctgtgcaattgttgcaccaagaccttttctatatcagacttcaaggttcatggcggttgcagtttaccaaagtcctcattgggcctctttctacagtctggcaaatcgtacactctatgccaggtagaagcttggtctgctgaatttctaagtaggaaatgtgatgcatctggtagaaaagttgaggcgatggatgaaaatgatgatacgtgtggtttctgtggagatggtggtgaattactttgctgcgacaattgcccatcaacatatcatcaaacttgtttgtctgaccaggtatctagcttctctactgtgtcattgtttgtatattcaataactccccttcatgtttcagttagagtacacattgtaccactttgttccagaaaattaaaccgatctgtttcataaattatttccttcctgttgcatttcaggaacttccagaaggcagttggtactgccataactgcacatgccggagttgtgggaatccacttagtgaaaaggaggtttcaacattctcggctatcttgaaatgtttgcagtgtggagattcatgtaataattatgatccctcctgttttgtcttgtccttttacattcttctgcgattgttgggctgtgctgctgtggtagtcagttagtgtgtattccacaagattggtactaaaacactttcaattaccgtaatttggatgggtattttggtattatatgttcattttcactgaagttgctttagagagtccatcttctatgtataattagggcttatgcatccaagagcccatctagcactttagctgcaccctatttgagagtgcttaagcttctagtagccatttaattttggccattatttataatgtacagcagatgaatttgatctttcaatttttgtatttaacttcgtttgatgcattcttgtttttttgctggcagaccatgatacttgcattgaccaggagatgctcccctgtggggataaacaatccaacatatggttttgtgggagatactgtaaagaggtaatgttttttatttataagatgctgcagtggaagattatttagttagtcactaagcctagttcagttctggctctgcattctttgttatacacaatagtttcatctacctcatgtgctccaccagaatcaaaccactaaacagtagaattttagcatgtgttgcatatattgttcctaatgcttggaaaagaaaaactttaggtgcagatctatggccacaaagaatcaaacctagtttttctttcatgtcactacaaattcactctaccttcgcataccttagaaaatgcagattttagttttagatatttcttggaaactggttttgaatgttgttttcttactattcaatatttcctcactaaacatttttgtgttgttattggtaacagatatttattggattacacaatcacgttggaatagagaattttcttgacaacgagctttcatggagcatattgaagtgcaacactgatgggcagaagctacattcttccaagaagattgcgcatatgacagaatgcaatacaaaattagctgtggctcttactatattggaggaatgttttgttcgcatggtggatcctagaactggtgtagacatgataccgcatgtcttgtacaataaggggcaagtttcttatttactctctacctattatcatttttcccagtagtaagctaagatagtaattggcgagagttatatgcatctatagggacaattgaacatgcgttctcccaacgtatggcatgctttcaattctctgtcttgtaaaaaatggatatctgactatcatcatatcaaatgaagtaatgaacaagagggccaagacaagaaaacccagtttggtcactgcattttcactgccttttatcctttttatgtgaattaaagatgcaacgtttctgcattagtccattgaaagattacattgcctattcagcagttcaaaatggaagtattggggtattgcacattgcttttgcatgctaatctacacagttgatatcatgccatactggagagacaagcctgtactgaaaccttatatccactaattctttttagataaaggaagcttttatttatctcagacgattactgaaaccttttatccactcatggaactgccagtatgagtaatatcaaattagtatatgaatgtgtccatttcctgttatattggaatttttttttgacatgttatattggaaaattgatttaccagtacttgcaccatttatattttagtgaacattgtaaagtttactaacattgagcacatttcaccagatcaaacttcgctcgcttagattaccaggggttctatacagtaatcctggagaaaggtgatgagattttatgtgtagcatctatcaggtaatgcctttgctgatcggtttttagtttttctgggctatacatttttttcttctttgccctgaagtattattcttgaaccgaggtgatttttgtgatatcttatgctcatgccattgactgttgtcattgttttccatgtaatccaaaacttgctaagagtatgcatgtgaacgggaaagtgcatgaactttgcattacctctgtaccaaaaatgaaatatgggcacctgcaacaggtggaatgcctacggtcccacctgtcatccatgattcttttgctagtttgtacattcacatgttgttaaacaatgtcgctgtaatgctattcccctttcccgtattccgttaaaaatccacgtttaacattttccgaagaatcgcatctcgcagttgattatttttagaggagcgcatacttatctctccacttcgtactggttatgcgtagctaatcagtgatgactttctacaatggagatgtctaacatggaaacctgcagtcatgtcatgtccattcattgtagttcttttgatttaatattgaaaaaaatcttggaaccctgaatggttagataacatataatcactagtgcaccgatattgttcctctagagctaattgccaattttcatatgatgaatacgtcagcaaagtgcgatggatgaaaacaatgttgttggaaattatttagtagacaataattgtgattgttgtttgcctcagttattttgactatatgttttaaatttctctttttccctgatacagagatggttatgatatttctgtttctatcttattcagagtacatgggaccaaagcagctgagcttccatttattgctacttctgtggattatcgccgccaaggaatgtgccgaagacttatggacaccattgaaatggtacattacactttggaaatgagatacaagtgtactaatcaaattatggacttatcatgataatgcaccatgacaacttcgattaataggactccaactgtgctatagattttaggatgtgtttttcttctaaaatacttgtctacttcagtaactgttagcatctaatcttatttgcatgtcaagatttgaccatgtgaattttcgttccattcaatgcagatgcttagatcattccatgttgagacattggtcctttctgccatcccagagttggttaatacatgggtgtcaggatttggtttcaaacccattgaagataatgagaagaaacaacttcgtaatgtgaacttgatgttatttcctggaacatccttgctaactaaaagattggatggaattacagctgccaaatcaggttaactatcttccggttaccattggtgacatttgcgttctctgctatatatttttggacttctctgcatttcttccatctttttttatgtgtagtaatactgggtgtttgactatgcagaagaggacaaggatgcatacaatgtttctggattacctaatggtaagtgtttgcctagcaggaaaggaaacgggcatcttgaactccatgatcttgacttgttagaggccgagttgaatactgaggatgcaaccaatgcttctttcagagcactgaaacatgaatgtggtcctgcaacatggtttaatcatgccaaggtttggtccatcaacattataaagctttatattttccttgatcaattacgcctcggatggagcattacgactgcatgattgagttgtttagtcagcaaggttaaaccacagcactttaaaatgcacctaatacaaagtgctaactcaatcaatcataatacagatgcgttgcaatttatcatagagaatctcttgggtctatcccaaacataatagctatcatggtcctatatttatgttgaacgtcaagaccatcatagtgctttcttctactctgggagaaatccatatgaagagattatatcttgaggccgtatatatgtagtctaaatcagttattaatatatttcaaaaattacattcctaccatggctctacatgtgggcataaatgcttggattgtgttcaaatgctctccctttcactatcactcatagcagcttcatgtgtgatgtaaattcagtgcaaataagcagaactttttgtgaattttgcatatgcatacagcccattttcgttataatggcttcatggtcaaacataaatgttttttctagctgtgcacatagtaatgttttatctcataactataactgattcgtgcattatgtatttatgttattgtccagctagctgttggggaagcgtgattttattctaaatcgaatttctgggctgtctctggctgttactctgtgttgggcaactgttcaggctactcatccttccagttccaggtattccccattgacttgtttgctagaaatttgggcacctttatttatcgcattgcatgagtttggggtagacgtgtgaaagttttggagtgtgtctgtgttggttgtgatattcctcccctttctttctttttatttttctgtttgttccttttttggaagattgagtttggaactgatattttattggtgggtcaatcccccagagtctaggctatctccacagtccataatttgttttagtatcatttgggttaattttaggtcctcaatccatcatcaaaagaatcagcaaaatagaacataatgtggggtttgaacttgatatgcatatgtaaaccttagtacactacatcaggtttgcactggagctccctgaagtgtcataactttcatcttgttaattgtggtctcacagagatccaggcctaccatttgttgcttctgatacccatttgatctggaaattagttgcattgctgaaacataagtggcaatctaaatggtattggcaattgtttcccatctaaaatagcaaaagattaccaagtaccagcatatgttttgtttttgttgctaatgttatattaacgtatttttattttctatatgactgtgttctgaagatcaaaatgccacacaagcatgccattgtagctttgatttgtcccttttcccctcttttcggatggcacttgaatctgtatcaatattcaatacatagtccacacatgttcatttttcaagagaccgtagtttaacaccatgtaaaatcattcatggaacaatagttcaaccactattcctcaattagaattcaatcgattcaatgacaccctacaaatctttagcgacaatatatactgtcatcattctttagtcataaagacaatcgtttcatcaaagatattccttcatttgtataaagtctcaagtaatgaagccaaaccaacttgcctgtgcaagtgggcagactggtatagtcgttctgtagctgatccatctccattttttggcctgataatcttgacgttctttgctctgcagtccagtactatgcaatgaattctcccggatgcaatttaccggaccacagctcttttattgcaaaacagaaagacatcttccaactgcagttcatgattcaattccctcagaggtgcaggttaatggatcaaattgagctggtcgagctagattttatattgaatacagtgaagctaagaaatctgagggacacaagatggcatcatcagatactcaaatgttcccgcctatcactgaaatatgaaaaatgagggtatcttccaactgcagttcatgattcaattacctctgagcagctggttaatggagcagatagtcatgcaagaaataacaagggatggatagatggtctcatctatccctgcaatatgaaaaatgaatgtttgagatgcaatgcgaaactgtatttttttgctttactgagtgaagcacctgagtcgcgatcacttggacaaaagcagaaatgactgacccttttctgagtgatgttgataggatttacctaagctgtatgcagtcactgttgatgggtcgtataagctgcatggtggccagaagggttacttgcagaaacatggttaacatttaaccctgcggaagatatgaatggttgcacctagcagccattgaagctcttttgagtgagcatggtggaccatagtggatattgtatgagtgactattnaatggggatcgcgtgcaaagttttaatgaaactgagcggagaaactaatgcaatttcgtcctcgaaacaagcacagataccaagctatcgagtaagctcccttcttttttgaatactacaatggtcatttgatgcattactgactccactgtaggctcgcatcttttctagttttctgtgtgcagtgtttgagaatttaatataagtctactaaactcttactccctccgtctcatttaagtgcaaccatgagtttctgtgtacaactttgatcatccgtcttattttaatagtatttttattgttatgagacgataaaacatgaataatactttatgtatgacttatgtttttaatttttttaaaaaaatttttaaataagacagacgatcaaagttaggtaaaaaaaaaatatggctgcacttaaaatgggacggatggagtacatcctcagtgttttgtttggtcagaataattaatatacctgtggcagaattaccgaccagatgtaactattatactcacgcacttgcacttcacaatctcggtgcattgcccatctctactgatttgtttgaccttgccaaaatagtcgcctccctcatctttatctgcctcgcttcagcatttgcattcgtcatcagataattgatcttcctattttgtcccaaactttcaggacaagtatcacaatgctggtgatcaacagatcatttgtcagatgtttcatttgagtcttcctcttcctgggtgcagttcctgcctgcctggtaattttgatcagctgctggggctggcgcgtcgcattgcagtggagattttcctttgctggtctgcagccagagattagttttctcacacctgatacatcccgggccatcaaatcttgcaagttacttacagtagtagtactacactagagaagttttccgaaccaaagaatactactatttagattgttacaaggcaagtatttttttgccaatttaacatgcagctgttcatgcgtttcttgcacattggaaatcaaaacgttgattcgtatttgtacttggatgggcaacacgacaaatgctaaactgcagaatgcaatgtctttcaataacgttgtaaaagtaaaatcaggaagtgaaacaaaatacagtgatccttcacaggaagagataattgcttccattagccttgggagactggggtggacgatgcaagcaaagtattcaggctcttcctaaccaccgccttttatttttcacgtgcatgtttttttaactattatatatttttttaaaaaaaataaaagaaaattgtttaaaagaatatattaattttttaagtttttttaaactaatgcttaattagtgtactagtccatcatttcgttgtgcgtgttgggagagagcgcttccaagttgttccaaccatcacaaagaacacgcccagcaggagcaggcgatgactgactgtttctcgtgttgcttgaccgtgcagcataggtcaaggggtttgtttctctataattaatttaagcggacagttatgtagtagaattctaccagtatcatgtataaacaagtttcccggatggtttaaaacaaatatcaaattgaaattctcgaatcatattaggaaccatcacaatgaaaccgggaagcttgctgaagaccgggaacgtagttcggaggtgttgtatcactagtcgaaggttattgagttcttttagtctttcgatgctatagaagccctaaataatttcttcgatgggatgggggctaggataacagaattacacaagcacattctactctagtagcattatattggtagtatggtttcactgagtaacaacatgcatatgagcagatgaaatgaaaagggaacatagcattgctgctggggaagttcgaaatccagagcaaataaaaatcaatggagtacatagtacagcacagattattacattacgaatttacgattacgggagaagaaaaatccatcaatcggaggaaggaggaggcgtgggtggctggtcctggtcttgggactgggactgggactggagaggcgggaggagctgggacttgcggcgggtgtcgcgcggggggagggggacggcgaggaagtgcttggtcttggagatggggcgggagcggcggagctcgacgacgtcgccgaccttgaactggttgtccgggtcgtgcgcctggtacttcttcttgatgcgctcccgccgcttgtactttgggtgaggagccagccgcaccacctccacccccaccgtcttgtccgccttcgtcgtcaccacacgccccgtcagctgcttcgccgcctggatcctcagcgccgtcgccgcgcccgcccacggcgaggcgccgctggccccattgccctggaccctcacaggggacgacacgaacggggtggtcagcagcatcttcaacgctctctcttccttgctatcgtatccttggctgcctctccacccgtggaagctcaagaagaagctgagcctgatggacgggtaggggataaggtttccggtcggacaacccagcataatgggctggctactgaacatcaccgggccagcccatttgaaaacacactagctactgtatgtatgcgtgcgttcgtcttgaagccggatggaaatggaaggtcagccaaagcaagacaaatgtgctcataactcgcactacccagacgttaggagtaagcgatatgccgctacataggcctacgaatctcaggcttggatgatcaggagtattttcttttaccatataccctctcaactcaccttgaacatcaggctcaaagcttgttcaatcttccttttgtttcagtctcaatgtttgttcaatactttttttttattggggaatgaatcaatacaaccctgtcgagcacaaaaggaaaaaaaataaaataaaagagagaagaccctacacctaaactcttggacccataaaatacacgctacaaaacctttccaacaactctatgttgctgctggggtgccagtgccagtgccagtggagtgacaaaaaaacagaaccgagtccactgaactgaccagtacaatagaacctacaatcaagcacagctcttcgacccaatcgactcaataaaccaaaagggaaggtactagccttcattctgtctgtcgtggtaattctttcttaccactcacttgtgctgaggacaacgcacatgatgctctcagacagcagtcctgtgcgaaccaatatatcactagcagtggagcatacaaaactaaccggccagaatccatcacatcataaaaatcacacactggcgctgcacgatgagttccctttcttctctttgcttccgtcccaacgtatagtaaagaatagacaaccaaaacaaattccgtcggtatcctcatactccgtatctgcctaatctctgaacgaccgctggctctagggtggacatgcactgttcccaacccccacttccgagcatctatggaaaatgttttttgttagtttgttgcatgtacggtaccgatacagaaccgcaatgaggaatcgttttacccgccctaagaaaaaaaaatatatacctgcttgtatccattcaaaatctggcacacttcattgtgtaaaccttcactctttatctcctgtataaacaaatatcgtgagcttcggtgcagaatactggtgcagaaagcatgtctaatatgacaggaatctcacgttccaacttgcacaggcctggcagataaaagttagtgaacccacagctccagttgggtttgctgctacctagtatagaatgacagtattttgtgtaagtcagacagctttgtaaattgtaacagtaagcaaaagcgtggatgtaccattgcacatagaccatggaatgcatcctctttctcaaaatcatctcgtatcctgtacatgacgaaaattagatccataaaagggcaccagagagcttaaaggacagacacttacatgcacaaggcattgcaccaggcttgcatgaaatggtccatgtggggggccacaatgtctggacagacccagcaaagcctcccaagagtgattgcgctattttcgagaagtgacttattcaagccctgtaatagtatgtcaggacacacgaggcatttagctgaaatgctcactcgagtaaaagacgtgatgagaacaacttaaaatgcaattacctcaggagattttaaaataggcaccaagcaagaaacaacagtgataaccacaggtgaaatttctttgccaatctggaaaggaataatcagttagacatacccacaacaattttacaaaataccaatgagtactagcacgtcataggcacagaaataaactaggagtgcatgttgctggccaagtttagtgtcaaagttgccatgtggcaaatgtgattggcagtagaagcagtaacaaaggtttaaggtatatcctgggaaacaggtatggtactagttgctcagaaaagaaaggaaacatctatgtgtatcaatctagggttgcaatatcttttgaaataaaaaaaactagggttgcaaaagtggtacaaaaccttgattgctaattctccaattgcccaacaggcgttgttagccactgacacagcctccttcacacattgcgggttctgcagcaacaacataatgtgaggagtgaatccgagatgttatactataccagatagaaaatacttaccagttgcttcgcagcaacattaaggaattcttgaaggcggggatgcagatgtatagggcaaacctacatgaatagttgttattttttttattggctacaaagcaacttaaaacaataaaaggtggactttggtggtctgcagcgaaccctagaaaggtcccccaggagggcgagagcactctgtcgaacatccgctgcttcatccatacaacattgcaaaagaatatctctcaaactgctttgtgaaacctaaaacaaaatgaagatggcttacacagatatcgaagagctacacacatcacactttgaagtgtcttacaaataataaagaaaaggcagtatgaagcacaatcttttctgaaacccccaagttttcattcaactaatgccctctttggttgggtttaggcttttaagccgacttttcagtttatatggtttataaccgattgacttttaaaaaagccaaacggaaaagctacatgtttgtttaggcttagactttttggcttataagcctataaacaaagagggcctaaaccatagttagtagcgtcaagaccaatttcccagtcactttgtttgataaccatcatctcaactatgtaccgacatgtaccttattgcagctcacattctaacatattatggacaacctacagaacttggatcctctttttttggagaagcatgtcttagtatttgtaaccctaccttttctttcatctattaatcagtatagccaatacaggaaaggaccaaatattacccacatgttgtctatcacttcaagctagacatgtgcaactagctcctagagagaaaagggtgatggggatccacaagtctaacagcttctgtgaaacttcagcctggaacatccataaacagtctccattcttccctgttgatatactcattgtgcaccccaaaaactatcatttattaacagaggcagaatgtctactttaatgtcatgcaccaatgaaacaggttggtttgtctgctccgctcatatggtctaaccccttagtgtaattctattccaagaaattcgtcacataatctatgtgcataaagaaagagtagggcttggaaaaggtatggatctcctacagattactgaggtcgataggtaagggaacaaagagtaattaacaaaaaaaaggaaatatcattggccatatagttgaatttaccaggctttcaataccagcgccaagtccttctgcaagtcctgacaacagatccaatgcacacacaatgaattccttatcatataatgcaccagctgcagcaggatcaacctgcatgtagaaaaagtgatcccgtataagtttctttgatgcagatggagtcagcagcatccagattccagtgaagatcaatgccgattgaattgactttttgtggaattgagaggaacagcgacaaccccaataaggtgacaagtcctgtctcctgatattcttctattttgattgtatccctaatcctatctctaggtttgttctttcaaaatagaatatgtaaaaaatataattacattaatgtgtacagtcattattcctgtatattttgattgtatccctaatccgatctaggtctgttctttcataatagaatatgtactaatataattacattaatgtgtacagtcattattcctgtatattttgattgtatccctaatctgatctaggtctgttctttcataatagaatatgtaaaaatataattacattaacgtgtacagtcattattcttgcagggcatgtaagtgatgggaagcaaccttaatgtggtttaacctttaatgtggctttcaagtttcaagaccataaaaatgatagatgcattatttattagatttaccgattagtaataaacagctacaaattaataggtttattacttgggttggaaataaccaacttgatatcagctattaatttatcttccactaaaataacgaaggagaccattaagcatttgatgctaaccgatctgtggactgtagtcacatgccagaaaaatagagttagctgcttggataggaaagatccagcatcatatccttaagattagagtggcaatgatctcattttttcctatcattaagattcagttgtaacagaaagttcccagttagttctacaactaaataatttcgttagcgttattgactggccctccaaatcaaagtggatatgtccagtgcaatgctactgttagaaggtgtgtaattgtgttttgtattgaagaatagtcagtcaagtttcagttccactaagaggccttgttcggttaatccctctcataaggggattgagggggatttggaggctattgtggtgtagaattatttcccttaaatcccctccaatccctccctctcggagattaactgaacaaggctaaagatcaataaataccacacctaaaaaaaattgaattctaaggaggtagaatacttgaaatagagaggatcagtggaccaatcaactaaaatccataagtataactaaaaaaagatactgcagatagctatgcttatgtgagaagcaaagaaactgtattttaatataagagggaaaaaagatttcacagacctttgccaggtgctgagattggataagattgatgcatctctgaaatactggctcagcaaactgtgaaaatcctggtcccagggcctgaaataaataaataaataaataaataaataaatcctgatcatgttgatgccagccctgattgacatatcagtatgtttcagacatctttacttgcattattggttaaatatttgagttaagtattgatgaggtaagaaactcatggtggatcacgatttgaagagtcagcttctatcctaattgcattattggttaaatatttgagtaaagtattgaggtaagaaactcatggtggatcacgatttgaagagtcagtttctattctaacttgttttctctattgttactgcaaattaaaatcttaagttaacacaagacaaaatggaccaaattttcatcaagaacatttaacatactgtctggagattataaccacgaatatcgcaaaagatgctctaaaatgggtatgaagggaccttcaaatcaaatttagcatgttcaaactagagaaggtaagcacagacaaaaactgtaagtacctgagcgatagatgtaaagcattcgagcagtgggaataaatctttatcagagttggcaagttgctgccattttgtgattagtggtggcataaatatatctagatattttgcctgcgcagcatattaaaagtagttagttataagtagaaggaatcaacacacaaaaggaatcagacaaacaaagagacataattgcttgttaatagaaaagaacaaacaagagagatattcatcaaaatgctttgcacctggttaagctcagctccaacagcatcagcaagagtgccgagagcatcatagagtattcgaaggtttcgtctctgctcatgaagcaacacgtagagttaaaactaatgaggccttaggaagcacttgttggattgcattgttcaatgcaattgaaaattatgactttaaattacaaagaacctggtattttccataggcacacataaggtgctgcaaaataattcccaagtgtggtactaactcttcagcagcctcctgaaaacagaagaaaatatataataattatacagaaaatctcaaacagaaatggttcaaagatcaagtagataacctcttcaagcgttgcaaatgccgaacacgccgcctcctgcactcttttgttagtatccaaaaccctccttaataaacctaagaggattttatcaaattgttcacgaccattgggatgctctaggctctgcatcagcaaaaaaggatgcacgataagttaagaatcatctatggattgcatatagataaataaagagcaagtccagttcatagagcattatatgaacacagcgaacctttggaccccccccccccaccaccaccaccaccagaaaaaaaaacccaaatagtacaaaatgcatgtcgttaggaatgaaaaaatgagtagtctgccaactgatgtttaaaaggcaaacacagcacgctgaacaaaaaaaaaaaagccaaagtccacattgtcatgtacctactttaaatgcataatacaaaaagggggtggggtgtgtgtggtgtggggttagcttttgaaggaaaacaaaaatcttccagtatagaagatggtagattcaacacttaggaatgctcatattacctgtacaatgaatttactatatcgggagagggtccaacaagtaatactccgtataagaggaaatttatcgtcaagaagtggaataagaaaagcaacaatctgcaaatgaatagaacatgttaggataggtacaattcacaatgagaagggaagcagaatagacagatgaagaaatcaaaagtgagtctcaatacacacatgctactcttttcctaatgaagttcaaggaattaaatacagcaatagttaattgataaaaatacctgcggaagatggggatatagcccagtaatgcatccctccgctatagcaccaatagacaaaacagcagcttccctctccttccacgcatcatcgtcagttcgagccagattttgctgcaaaatacagaaaaaggtgtatgtttatccaaatcattcaaggtcagaaacagcacacagcatcggaacatataaacacttggccaacaacccaataatgctgtggatagggttctacaataatgcttcaatattgaactcctacaaacaggtttctaagtaattgacaaaaacacggtataattcatctctttacaaaggaagttagaaagtcccaaatcccttaacttggcgaaccacaacagagttcattcattttataaaaaaaaaaagccatattacatcaacagccttcacaaaggtaactcgccccaaaaaagtacaggaataaagcaataagttggcaaaaaaaaacgtagttcaccttggaacattgattattatttgaagcctaaagccattttttgagattgacatataaacttaagcattatggtttatcagcttctacaaaacatatgatgatgcagctactgtaacgaaccagaaactgctagttcatatgttaccaactaatcaggaatcatcacaccagtttcgaaggaaaaaaaagattggaagtgcccagctgacaaggtgtgttcaagatcaaactctacaatttgcaaattcagatcagagcaatgccaaatatacctagaatttgagtagcagctcaggggctaatgcatcacaatatcaatcttgataaatatgctagccataataaatacaaaaccaaaagtacaacttacctgtatcaaaggcattaaagtaggaagaatgtcatcaccgaaaacattagaaaggacatccaggccagcagcactacatttcctcaaattccaaacatttacagcatcatcatcatcctgtccatacgacaacaaaacaatgttatcttcatctcgacagtttaagttggtggaagtcattaagctttttaaaaacaaataacatttctggactcacatcgtcttctccggtttcagatccatgtagtcgagaggcatggaaccggggcttcaagtcctgttatacaatgcctttcttgtttataaagaaataaaagcagagagcatatagctgtaaaacatacagtcactttccatatcttttataaattttagggttgcccaacctaataaaggagcaatagacaacgcaagctggtagtaactaatttcaaaaaacataaaaggtagcaaaacctctgatacaccagttccagaacaaaactacaggactgcaaggttaatctaggacattcactgagaactttatcgttacagaagatttaaccaacctgatccctgtctggaaacgattcgtcctcctgataacatataatatatatcagagcaagtcactatcaccaataacccaccagtgaaatatgcgagatataaagaaaatttaccacctcagcatcagcaagtgattcgtcatcatcagaatagctcatgtttgataagagtgtctacaaatgaatgcaagcaaaatatgtaaagaaactgtgaccagctctcaaatgcatcagaactaattataaagagggaaagggacagttactgggattaagcgtggcaagaactctctcaacccctcaggaggcatgctgacatcacagtatgccgacctagatatgcaccatagttacaacttcaataaagcattaatcaacataaaagaaactactgcctatatcgcagctgatgatagtttatttaaaatcagatggatgacgcctaataaaatgtgagcataacgaactactgaaattttaagaataagaacaagtagttgacacatagatatggacacaatatagttttgatatgcatgctggattaccatgtttacaggggacataccagaattcacaagcctcgagagcaacttcatcatctgaatctttattagcttgcagcatcaattcggtaacatttttcaaatgaggctgcagtttactatccaatgttagatccagcataacacaagatataagcaattgaaaaatctacaaatgaagatcaacaaccccagagataaacaagcaaccctagtcaacgacagttgtttatttcttaaaaaaatgaatagcatgaaatctgagctcaatagggtaacttcacggactacttaatgaaaaaataacaaaaatcagtgcaaagtaaaccttgcagcagggcatcaaaagtattgtgattaaaaacaaacaaaaagaaaacaacagatattggatagtttctgcacaaacataaacacaagggaaattaaacatttcattgcctggctacaaaccagggcatgagctgcaagtgaaatgtgtgtgtatgtggcatttaatctggtgtgaaatatttagatcttaggatttattattttttaaaaaaaatagaacttatggtaattttatttgagattgctgaaatgcccaggcaatgtgctagttacctccaaaattgatggccttacttcaataagctgaacccaggctgagcaaacctatcaaagagacaggaagcagaactatatcaaggtaaaacatgcaactgagcaactgaatagtacataggagcatctatagatactcactgtgctccctcctgtcataaaaacatgtaattttggacatgtttcaagtaaaactttaaaactttgaacatcaatgtctttttaaatattcggattagccttcactgcgttatagttttatcagggttttcaaatgatccccagtagaaaattatctgtcgaaattgcatttttgaagaccatgtccacgtcaacgtcaaaaacaacatgtttttgcaaccggagggagtggtcagctagaaaaatgaactcataaaaggatgaaaggaaatctaggtaggcctcattgttcttaaggggtataatcaagctttcgttattccggaactagaaagtgttctgagttttatcttattttggtttaatgtggatcttgtgggatgctctgtaaattgtgtacttctatacactaatataattattttggttatatttccataaaagaaagtagttggatagcaacatagtgtaatttctctatggtgaaataccagtttccgaacatctgctgacggatcctttgcaaggttgaataaaccctgaagatactgatccatcgacatgtacaaagcctgcatataaatgaaaatgattagaaaaattgttaagcaaggtaagacatagagagaggaggggtattcttactgctggcatgaccacgatgtactgattaatacagcccagagctagctttctaaggattgcatgtgttgattggaaaaactgaaaaatcaattgagcaggctgttagaacaaatgctgcaaacatgttgaccagagtgtgcaaacatgtatacacctccacagatgcatgttgtgaagagaatcagcattcagatggtgcacataaacagatagaatttatgattttacagattgtggaaatgaaagtacacacaccatgtttgatagttatagatgtaacacaaacctgcagtaatcttggcatgaatacattgattggccgttcaggcaaaccaggaacatcaacatcaagctcctcaggaacatcctcacagatctgtagaaaaacaagtttttgagcatgcaaatcatgttcaagttcacatagagtattcatgctacaggttcgctactgagttactgcttaagcacgtagacaccaactgttcgaagtcttctatgtgaaaatcacagatcaggctcaaaaatatgagagagaagtttaccttgtatatagcatccatagcaccttccatatgatccagatcattactgtccaagcattgatgtagagcttgaaacaactcgatccatccagcaactcgaacaatttgaaagagtacactgatgactgttccgactgtggatctgattgccttattggttgcccctatacatggcaacaactcagactttacgtactgctgggaagcaggaggcatggagctgaaagtagctcggaggttgtttttcagcagaagtccagcagcttgcctggcttcaaaagattttccctggcaagagatttgactacacgtcagagaagacataaacactaggaggttatagggttataaccgtatcaagattaaagaacacattttattccagaacaaggctgataatctgcagagttcttacaaggctaaatctgcatcaggtctacagtttcctagcattggttggccataaaaacgaaaaatagtatttcaaaggttgaaagaaagaaacaaacattttaaaaattttcatcctaccttgctgccattgtttagataaatatcatcccaactgtatgtgtaattttctagagggaaggagtggatatagaatcatattgaatgtattatttattgattgatattgatgaatcaagaccgcactactgtatggtgcacgaacaccttaaaccaaaacaacagtattgcttcaattcaatctgtacatctaattagggagcaatttggtttttaacaggtgtccacccctatatttaagctttcacgtgatgttgcctagttccataaaaagtaaacctcactaaaacctgaggtcatttcaaatacgttgcgctacgggctgacctatgacttgtcacaacagcaaataatgtgaggagtaatctaaaaattcggaggttgtactttagaaagcatgtatgacaagacggggcatcgcagtgacataaacgcatgatttagttgctgctcatttgcttaaagaaaactgaaacccttgtatatggagacatagcagctaaaacaagaaggcgaaggagtgtgcacgggcatgtagggttgtgtgagaagaaacaaaatgaatttctaacatagttgtaagcatgggcaatgtaattataatcaaacgcagtagataagatgaaacatgtggaagtatctccgacgaacagacaccacgccattgaagaggtggtatcagcagctgagcatcgaaaatcccacccaatcagcagtggcgattctacaacacgagtaacttctaatgtagcaaccaaccgagcaattggagcttctaatgtagcagtcaaacgggggcaaggcaagcaggaaaaaaacagtaaacgataagaagaagcggcgcgattcagatcgagagtaatcctgcagcagcgttagaggcaggggtatcgcatattcgcatcggtgaaaaccctagcgaggggggagttggggatggggaagggaagaggtagagtagatgatggatgacctctccgcgggcgaggaggaaaaccaagtagttgttgaagtcagggaactggctgtagtgctggagctgctgccagatgcgagcctggtcggagttgggggagatgtgcgcgtcgaggagggtgcagatctcgcggaggccctcctcctgcggctgccacagggccgccgccgccgccatcgccgccgacgaagctgcgagtcgagaggaagaggaagaggagggcgaggcggcggctgaggagaagacaactccggaggagaaagggaatcaatcaattggaggagtagtatttcccttcccttacttattagtattactgtttgctcctccaattttatctgctactccatttttcttttaccttttcatttaccccccccccccccatctctcatcttctgattctttctctaattttagcatccttgattaggggtttattatgtaaactaatggtgtagaaatttacttaggctactttcgatttgcttggttgaggtgcaatttaccattgaacagtttagaaaacgtgcccataataaataagggtggttcacgacgtaaataaagtaccgaaaatggagccttactctccaataattggcttttatacggaaacgttaaatggaaataaaagaaaatattattttcctattaaatgggagacccatgcgcgcacgcgtccacgggtgtgcatcctttattacaaactcaaatgaactgaggccaatgatttatcggttcatcagtatgtcatcttaaccatcgtagtgttgatgctttgcaaaatacacatattttaattgttatcaatatatgccatacgtgctggagaattaaggtcattctcaatgttactccaagaaagaaggtaattccaaaaaaaatttataaactaggttgtttatttttatgccaaaactttggctaagtttgttcaaatcaaagctttttattgctttgccattttagtactgaccattttttccaacaaacctatgggtattttggcattaccctttttttctattgctttattaggcattgaacaagcatgcacaccctaaaatatcaacccgattgaatgaaaataacattgttattaatttctgtcaacctacccatatatgtgcgtggaaataaataataatggacctcctttgttgtctttcatttgctcttcttttctttcatatccatgacacatagtactgcacaatggcaccacatatcagtgatacatatgatgatggtagttttgaatccaaaattttaaggatggcactaagggcctgtttggtacagctccagctcctaaatttaactccaggagttgagtctggagtggagttgtg

SEQ ID NO: 29076 - DNA, 20376 bp, Oryza sativa
cctagttattttcttcaactcgaaacttcaacttcttatttttcattagcatgtttttcaaattattaaatgttatagcatagaagcttataatagttaaattttaattattcatatactaataagccttctcatcctgcatgcgttaaaatctccatacgaacctatggaaagaatgcggccttaattaaggtgctctctctaactgagatgaatattgcactgatctaatgggttcaaacaaatttacaaattgtacgcccaataattaagttggtagtggttagtaagaaaataataaaactgtatattgattctccctactgagagagagagcttcgtataagttggtcaagaatagtcccataaaaaagataaatcggtatagtggtattaatatacgtatcttaattttgttttttctcaaaaacatagtataaacgtaaacattcacaacgtgtgactccgataaacgcccacacacacattatactctaatattagtatattaaagatgagcacgcacataattggtgttgcctgtgtatatccagctcgatggagatgattggagtactgggtagtagctggctggccagggaggccgaccggaccaactgcatatgcagcatgcttttcattcttgatgatatgacaggctcagcatgtatagcattataattagaggaaagcgaaaagggaaatggccgaatttcgcagcatgattgggtccaagcatacgtccaccacccatctattctcatactcctgctgccgcgctgtgttgttggacaatgctgttggttttatatattccgctgtgtgtgtgtgggtgggttcatgtatgtacacgctgcaattctgcaagagcaacgcaacaaaaagaaactcggagcaaaagcagcctctcttttggcaaaaggctttcttgctttgctttgctttgctcgtaatactgacagacacacacaactactactactacacgtgagattttcctgaacgtcgaccccgttagcttccaggtgggccgtaagtggagccgaaggccggcgccggggttagggccgcacgggataacacagtgttacaagcaaccgagcttgacgaacctatgcggttattacatgtgcgagatgcttagggtctgtgggagatacagaactaagggtatgtgggagatatagaactgagtttacagatgtaagtcctcatgctccttagatattgcaaatatttcatttaagttgattgtaacacaaatcatttgttttttactttccatagctcccgagcatcccttataacgcaagcccgttcgatcagaaaacgcttatctacttatgcgcggacttatgccggttcattcgtcgcgacacctacaactatccaggagagttccatgatcctcatagctaacttgctacggatcccaaattcaagaacctaatggagcgggagagggaacatgctatagactaaaatgtttatttgtcgcgggggatacttgtaatattacaaacactatacattatatgtaatttgatgtttataactgagctcggtcaattttcggctaatttttcatctattatcccgtgtggtcaaattataccggcccatgggataataggttaaaccagacggctagcatgtgctagagcgacggcacgaattatcccgtgcggtcgccttagcacacgctagctgaggggataacctattatcccgtgcgatcgtccttattacaccgcacaggacaatcaattattccgtgcggtccgtataacccgaccgcacgcaaaaatatcgattttcccagacgagtggttgcaggcgggccgagcgaccgcacgggataatatatccaactacccggaaaaatgggtattgtagtagtgacagtcccgcagactgctgtccaattggatccacgaagcagagcacgcaacacaaatattagaaagtcggtgaatcaaatttaaacaattttctaagaaatgataataaaaactattttttgcaaaaattgaagcttggaaaaggtttatgcagtaatccataagaccataatcaaataaaaggagactgggggtgggtatgcagatgcgatggtgtgttcgttcaaaccgatggagttggatttccgcggcacgcgaaaaccagagtcattagcatataattaaccatataactattacacacttgaaataaatatttttaaataactttcatgtagattttttaagaaacacactgattagcagtttgggaagcgtactcatggataacgagaaagttgcacgtcaaaaaatcaatttataaagactaagaacatctctgaaagagttgttatttgactcttaagccaaaaaatgacaattttagtgaaaatatggtttacaacaaacttaccgatcgaatggccaagctatctggctaaccaaactcatccagtagcccaatttggatagccaaattagcttgccaaacgtgtaccctacaccggtacccctatctctctctctcatttctgcgcttcctctcctatccctagactcctcacgagcatatgtgccgacaaatgcacttcccaccatccgcaaagccgctgagagggtctgtcatccattgttgttgccccccctctccccgaggtaacctgttgccgtccaaaaacaaatcaccgcaccctttcttccattgccacgacgccctttccctgtcgcgcctagcagcagtcgctaaccatgccgaggcctgccactcaacccacagcctcctctttccctgtcactgtcgctcaagcaagtgagatccatgagacggtggggtgatatcatcatagcagagggagtcaaggccgacgaccactctcgtatctcaaggttggcgattgcttcctgcctagctctagcgtcgctgtcgtcggccaaaaggcaagagaaaatctctatcgttgctctcttctatgctgcctacctcgctctctccggtgctgaccacctcaggccaccccgctggcgtcggtggcaatgtcggcctcttagcggtggtgggtggggactagggaggggagaggaggggttgcacatagaaggagagtaaggaagagatacaggctgacatatgagatctgttgttagattggagagggtattttagagtttgttggagcgaaagataaatgtaactctttattttttttatcgattttgctatatatttgtcgataaattttctcccaaaaatttgacagatgtaattacaatacaatcgtagtataattacactgtaacttacatgtaattatactgtaactataatgtaacttgtatgtaactttcaaaaatctctccgtgatattttatttcggtaaaatagaggttgtgggaacaaatccttatacatatgtgtgtgctgtgattttatttttcttcctcaccaaaacaaatcttgtaatagatctaaagattcaaaattacatgaaacttatatacaagtcacactgtagttacatgcaagttacagtataattacatataagttacagtgtaattacactataattgtactataattacatctatcaaatttttagaagaaaatttatcgacaaatatatagaggtggtcttttttttataagctagccaaatgaagtagatatttctagagccaaatttgacaagattgttggagatgcgcgcaaacggccggcacacgtacggacggacttgcatagcagagcagcatgtagagagaaagcaggaggagaaagtgcgcgtgtggcgctgggatttatccctttctttttcagtcgccggactttttatcattccaatccagtcatctcctcttcttctttctatctcaatttttttttcttctctttctttctttctttctttcagctggctgtacaggggggatcacattgggatgggaccttttttttttttggagagaaagagctttcctctacccctccctgtactccactccgtaaagtatcagactatcagagagagtatcagtcaaaagtaatcatgaagtagaagtactcgcgtatatactcctacttgagtaggagaagaggcaagagcagtttactcctagattagattatagtgtcatggaaggaatccttcatcaagatactggagtacccaatcgatcgactgctttatttgccgtgcggaatggaagaatgtagttactccgatcgaggatgtgttatttacatgatgcatcatcaagcaatcaatcaaaccgcaatctcagaattttctgtccatacaatattcacattaggccggttttaatataatttatttattatgtaaaaaatatatatacatattgtatcgtgagtattaattacagtattttactagtggtatgaataataataatcatgcatgatgatgatttgtacaaggagaaaccggagtattagatggtacaacaagcagcaggggccccttgttggcgtttctgtaggcgtaggagcgcgcgaagcagaggaacattgccagctccgcggcactgacgccggcgagcagccagtagaagtagtcgaggtggcctcggttgagatcgtcggcgaaccacccgtcgccgccgtctctcctggtgatgccatccagcgccgatatgagcgcgctgctgatgaagccgccgatgcccatgacgctgtagtagagcgccagccccaggctgcgcatcccctccggcatctcgccgtggaagaactcctgcatccccaccaccgccagcacgtccgccacccccatcgccacgtactgcggcaccagccacgcccagctcatcgccggccgttgctcccgcaccgtctccagccgacgcccctccaccgccgccgccaccgccaccgccgccagcgacagcgccatgcccgtccccgtgcgctgcagcgtggtcagccccctcgggttgcccgtcatgcgccgcagcattggcaccaccgcgcggtcgtagatgggcacggacaccatgatggtgaccggccccaacgtctggagcgcggcgggcgggagctccagtccggcgtggccgatgtggcggtccagcgtgcggccctgcttgttgaacaacgtcatgatctgcgcgtacgccacgccgtacgccaggcacgtcgcccatatggggagcaggcgcagcatgcggcgcgcctcctccgacgactgcttgtagtgtcgtagcgagagcaaggggctggcggcggcggaggagaggcggtaggtgggggtggcgaggaggaagaggaggaaggcgcaggagacgacggcgaaggggatggcgaagccgacgccccagctgacgttctcctggatgtagctgacggtggcgatggagacggtgatgccggtggccatggagaagtaccaccagttgaagagtgagctgcgggaggcgctctccctggggtgctccgggtcgaactgctccgcgcccaacgccagcccgcatggcttgtcgaacccctgtgccaaggccaccaggtacagcgacacgtacaagatgcccacctgtgacttggacgccaccaccgacgacgccaccgtcagcatgccgtacccctgcactcatgtcgatccaactttcaatttgctttcaggtgtaacgacactagtaccacataacgtaatttcacagttgaatttgaactgtaagtatatctttcaccaatcaaatcatttttgccgtttattttaagcatgtatgtatattgaaatagtagtaggataaggacgagcatggtgatggtgccagtggcagtgtttaatttgattgctgtcagtgtcaaatcatcggattgaccaaacgagggagcagatcagatactctagctaggttaagggcataataatagtagaaaaaaccgaaccggtacttgaaccgtcgtggctgctgggtcaccgggtcagtggtccaaccgccggttcatccgggtcaattgcagaaccggactactagttactatcatatatatcatttcactcggtcatctaaacaagtagcagtgtagtccaatggtaacgcgtgagtgtttgtaaccaagccaaccaggtttgatcccccacagagcatattttttcacatattcttctaatataaataggtattaggccttaccagctaatgactttgggcctacgcatgccttatctctttggcccactaatcgaaccgccggttcaaaaatcagccggttcaccggttttcgacaaaaagccgtccggttctcaccgggttgactgcatgaacggtctttgaagcaaaccgaaccggcgaggtccctggttcaggttttttccggtcgaaccaccgggccggtccagtttttttttactatggttaagggtaataatggacgagtagcgtgcagtgctggttagtaattaattactttttcggtccgaaaatatatttgaccggatagataagttgtctctaatctacttctaatttgctatactaatcttctactttactcctcggtccataataaatcaacttaatatgtttaatatgtttagattcgtagtattaaaatatgtcatataataaatcaacttaatatagaatgtccccgtaaaaaaacttaatatagaatgtgatatgaatctggacattcatatgtctagattctatattcgttttttatgggatagattgagtaggtttctatataattttaaattttattgatgaatattgcataggttttgcctctgcacgtctctactagtatatgcgtatgtatgtatgtatgtatgtatgttctatattactatactggtggttgagtaatgagtaggagtatactcctagtagtggttggaggagtattagtagcacaagtatcacatggcagacaacaggctgttacgttccattgattagagtagtccattggagtattattcatcaagaatactaataactaaggtagcgaaatgtaaaagaaacgagtaataacaacaaggcaaatgataagtgaaaaagaagaaaaggggtaaaattggaaccaggaggtaaagggtgcaggcgaggaggatggatgggtagcggccgaggaaggagtcggcgaggaaggcgccgaggagagaagcatgcaggccgcccccgaccaggcgttcaccgccgccgccgccgacgcgttggattgccccatcggccccgtcagatacgtgatcaggttcgccgacacgccgaagtaggcgaagctgccggccaactccaacactgtccatggaatgaattagctagcctgatcgatctatagactatagctatcctgcctcgccggactaaaatgatgaacagcatacatatacataccggcgacgaagagggcggagcgccagccgcctgaggtggcgcggtaaacggggcgcccgcggaagtcggacacgccggggagcgcctcctcctcctcctcattcggaagcaagggacgaccgtccatcgtattcggattcctcctcgatcgatcgctttgcttttctcttcctttcctttcctcgctgaatcggtgcgctctgctctgctcgtaggtaggatgatggtggcaactacaaatcggccaattgaattgacaaggctcagaggattaattaattaatgcggcttgcttctgctcctgctcctgctcctgctccagttgcacatggccaaatcaaaccatccaggatccttcccttttccaatcctcttctgatggtgatgattcggatggagatatttcagaccaacgaacgagtccacgatccaccacaaattaggcataccagacgacaagacctgctattaattgggcccgcgcccatcccatatcatatggtaactttaggccttcagcccaataataatcccatcggacgatggaaaggcccacagactagatacctcggactacacagtctgtcactaactctctataccttccttccgtttcacgaagaatcaattgcttcatccatcccattttaactatgattttccgtgtttaactttaatcgtccatcttatttaaaacttttttttaaaagaatggtctatttctgtcatctcctttaccgaaagcagaatatatggacaggctccgaaagattaattaatttcagtataaatgtcaatgtcgtcagctcccaacaaagattaattccagtataaatacccataccatgcataggtagctaactagcaagctggtatcatcttcttctacttcctacttcttcttattgtgggttgtggcatatatataatatcccagtgaacagtgaaggatggaggaggagtggtgttgtgtggcgccgggattcaggttccacccgacggaggaggaactggttggttactacctggcacggaaggtggtcgggcagcaggacgacgggatcatccaggaggtggatcttaacagcatcgagccatgggacctgctgcaagctcagcagcatgatcaggagtactactgctacttcttcagctacaaggaccgcaagtaccccagcgcgcgagggacggggacgcggaccaaccgcgccacggcggcgggcttctggaaggccacgggccgtgacaagccggtgctctcctcctctcgatcatcatcgtcgccggcggtgatcggcatgaggaagacgctcgtcttctaccgcggccgcgcgcccaacggctgcaagaccgactggatcatccacgagtaccgcctcgtcgcccaccatcagcagccggacggcagctgctgggtggtgtgccgcgcgtttcacaagcccaccaccaccaccctgcagcatcagcttcacctgcacaggccgcctcctctacttcatcatcccggctactacgacgaccaatatttatatcctcctcctgctgctgctgctggtggcggcggcttgctctgctcccctgccttggacatggagttggaggacgaggaggatgaatccaagatgatgatcttaagcaatgataatattccgctggtggtgagtccgactgccgtacacacacaaggcaccggcggcgacattattaacgacgctactaccgcgcctgctgctgctgctgctgctgatcatcgtcgacaccttgctccaccaccaccacttcacttgttagctaattcagtcgattaattatattaatgagaaatttactagtaatcggatcatcatgcatccatcatgcgtgaatgactaccacgtattaattcgaatccatactctgtatcatcgtatatagtagtatttatagacaccgtacgttaattaattactgctggccgtcgacctgctacctatactatatattagcacaaaatgttatcagtgcaaatatgtgcatgtagtcctcctccatatacatatcagtacaaatacaaacatgttatctcttacagtatttgggtctttcgttcgtcactacccggccggtctgaatattaatttatgcgatcgttcaccttcacatatacggatgtagttcaccactacacgtacgtatatacatgtatctttgatcgcgcgcgcctttcaaaaagaataagaagaagaagaagaagaagaagaaggggagtatatatgtatctaagtatgttcgatcgatttccaggttaattaatttcatctcgacaaatgcagcagggctctctaccagtacatcgaagtatatttatctgaaccatcggtttataagggcataacaatatttactaactcagtgattagagttaatgctggtattcatgattttatcaattattttttaaaaagaaagagaagaggtttttatccttcatcaaatgatatgcttaatttatattggtctattctacaaccgtgttcaggaaaaaacaacgcatatggcaaattgcaaactgatcgatccaatgcccaagatctaattaactcaatggttttgatatgaatattttaccggagaatggcaattgattaagcggaacgtacgtatgttgttggctgcagcagaggcggggctccgattggggaggagacgaaacacggcgtcgacgtcagctgcgcgcggctacgatttgggaaaggattagcatcacgtacgtgtcgtcgtttgatcgttctggatggagcagtacgtcggtccttcttaattaattaattcatcctgtcgatcaattacatacagcacagcagtacacatcctctactagctaattgtgttgaactgaacgagacagaaacagcaccgacgacgtacggcttgccgggcgggcggttggaaatcatgattattagtcacctctgatctgattccaatggagatagcgaccctgaaaactctgcacgaatagccatcctcaatggacgcatatgcatatatacatgcatgatacacatatatgcatatgctcatgcacgatggcagaagacatggttgatcatctggtacagcggcggctggggcggcggccggccgtatagcagcggatcggatcgattggatggatctctctctctctctctctctacgtacggtggaggccggcgcccttgccgggaggcaatccatcccatctcccccctatatggtcacgtacgtcgtcttttaattaagtgccatccatgcataagtccatatctgactttggcaaatgcaagtgcagatgcaatcatggctaagctctccatctttgtatttagtagtagtagttgttacctttgagttcattgtcatatatctttggaaaatatgtcttctttgcatacatatgtgtgtacaaaagtcaactagtgggctttttctctctcttttttcggagctagactttaaaaataggatttggtgcgatataccactcccaacttcttgttcctgaaatacaattgtttttttatttaaaagtacaactaggtttgatatacaactcttaggaatccttcggaacacatgattttcaaaacacaggaatacgaataatataatatcggaatgtcatgccttgtaaatcctacaagaaatagaaatacaacatttttcaaaaacaaccgtttggatgtcgcatagaaaaaaaacataggaattgaagacaccagaagagggaaaaaaacacattccataagattttcaaaggaattttgaaggttctatccttaggattcaaattttctaaaaatcctccacttttcctgtgttccaaatgagtccttaacttctatccatagatacaaatgcattttgtattcaactaaattgattaatgcacatcaactcactacgattttgcagtgtaaatattatttgttttcttcaatcaatatggaaatttgtaggctcggaggaaatattgtaaattccttttgaccttagtatttaatgtccttcttagctcaacattttcttaaaggtattttgaaatttcgattttttataattaattgtaggtgtttttttaacttgtcttcttagaaaatgaaacacctaaaactataaaagtaataatcaaactagataattaaaaatcagctacaactctcccaaggatatatggggcttaatttagagagagatggaataagtccactttgaatcacttaactagtggtctaatcactacattctagatatctccaacgaagaatatactacgatgaaggatgtgaagcagattcggcaactaggttagtgagtcaaagtggacttattccgagagagaaacaaggttagggagtcacagtggacttattccgagagagaaacagaggtagcgtatgggccggtgacatatggtccgaaagcggtgggtagtaggtgggcctggcctggaagggttacgcgtccagtccagacgtaaggaacccttgctgatcgatcgtctccaacccaacaacaacaagaaacaggaatttcgatttctttttcttcccttctggaggcgtcctgccctgcgttcaccccccgaaatccctctcgattcgccgccgccaccgcctcctccgctccgccgccgctagggtgttctccggcaaccctaaccctaaccctaacctatcttcgccgccgcccgccaatacaccacaccctatacccgccacacacacacacacacacacactctctctctctctctctctaatggcggcggcggcggcggcggctgcggctgcgccggcgccggcgacggaggaggacgaggaggcgctgctcacccgcgtgcagactatcatcttgcgggtcgtcgagctcgaggacaaccccaacccccgcctcctccacaccctcgccaccatctgcgaggcccacgaagccaggtacccacccccacccccaccccctgcgctcttcttttcttcctctcttacctatagatgttctaccttccttcctcttactattgttgctccacacgaacccatgtttgattcgctcatgccctcttgctgctccttttccttgtgcagctagggcaccctcctccactccctttatttttttttatttattaggcaccctgctgcattgcatatttttcctacgaaacccatactgttgttcttgccaacctaaatcagttcagttagtgagtcctcttctccgtaggtcaaattctcgtttgcttaccgctgttaccatcattcataaaacaacttcgtatcagccatgtatgatcgggccccttcttcattagtacctttcatttctacattttggaaaaaaagaacaatgtattccaaacttgccccacttttgggaagagtaggtggaacaagttgaatttcccatttttatctcacaagagtcactgtccaatagcggaggaaactaaactgccactaggaaggtcattcattcttcaatgggaaattgttcaccatatttcttgatgaatagcattgcttctaagattgcttccttaacagtgttatttccctgcagatatgcacaagaatgtgcgaatagtccatcgtacaataacacaaacgcaaggaactcccatacaattggcaagctggcaaacttgcttcgggtgagcactctagagttatatacactacatcatcataatcttagttttatcagcctattgcttaaattaatcattcttctctttaaccccattggcaggagaatgacgacttttatgagttagtgttctgtaagttcttatcagacaactcatactcggctgcagtacgctctgctgctgctaggctgctcctaagctgctattctgcctggacggttagcttttccctctctgtcaacacactaagctctctacatttcttctcatctccaactcggacaataccaacctttcatttttcattttggtctctgcagcctcagtatcctcatgcatttgaagatgctattgtagaaaatataaagaaatgggtgacagaagatggtggagcgtcaaatgagtgtgaatcgaagcatctaggaaagaataacaaaccaacagatgctgacatgctgcggacatatgccattgggttgcttgctatggcgctgtgtgggtaatgccatgagttttgtttcacatgtgattgcgtgccatcctttttgctttcaactatctctgccgttcacctaactgttgcttctttttttgtccttcccagtggtgggcagttggtagaagatgtcttaaccatgggggtatcagctaagctcatgcactttttgcgtgtgcgagtgcatggggatgttgcgtgtgcccagaaagattctaatattccactagataccaaacatcctcggagcagagatgagaacaggagcaaatcacgcctggttcaagacagttctcgattggatggaatgaggtctggagatggaatttcaattgacccaacttcagaaaactgtgacaatgttatgggaatgcggcatgcacatggagaacggtggatagatgatgctgcctctctgcaacctgagcgtgctgattcatcgttggatctttttgatgcgatggaggctggtgcaaccaatgatagaacttatagtgcaagcatttgtgatacaaagtcaagagttgggaaaggctttctgcattgagacttggaagagatgaagagatgaacgaaaatacgagagatgatctgttaaagcggaagttgagtcgaacaggatcacgacttagggggaagagcaaagcaggtgaaagcttgcctgaaagtgaaagaacacctttatcaccaacctcaggattgaaaataggaactcggactagcagagagaagaatatggtgaggattgaggatgcaaataaggccattgatgtgaacaacagctctccaggcattgagccatttaatgcaatttccaaagaagagtatgaggatcggttcaaggattgtattattggcttaaaggatatatccgacattgttttaaaggctgtgagagctgctgaagctgaagccagatctgcaaatgcacctgatgaggctgtaaaagcagcaggtgatgcggctgccgagcttgtgaaatctgctgcatcagaggtatggaaaagacggtttgcattcttatacactgacaatttttctttatcatactatagtaacaatttcttgtttgtcaacatttctgaaggtttggaaaactggaaataatggtgatgcggttgtattagctgctgagaaagcagcagctactgtagtggatgctgctatgtcaactagtgtctcacggtaatggattaaatgctctctctctctctctctctctcacacacacacacacacacacactcactcactcatttggtctcatcatattctgagagtttgatttggtattgctgaagctctaaccaagtcggtgaagagcatgttgtggaagagcctgtgcaaatcagcgaggatcatgaattggaagattttgttatcactgaccatgggcagctcctacaacttagagaaaaatatagcattcagtgtctacagattttgggagagtatgttgaagcattgggtcctgttctccatgaaaagggagttgatgtttgccttgcattattgcaacgtagcattaaagaccaggggggacatggccactttacacttctgcctgatgtccttcgattaatttgtgccctggccgcccaccgaaaatttgctgcgctctttgttgaccgtggtggtattcagaagattctctctgttcctaggattgctcagacatataccgctctttctggctgcttatttacttttggctccctccaggtaaacactaacaacctaaattgcctgtctatgcagagttgatatgttatttcctctttgagttgctgaaatatgattcatgcttgcagtcaaccatggaacgtatttgtgcactctcatctgacacacttaataatgtggttgaactggcgcttcaacttcttgaatgtccacaagattcagcgaggaaaaatgcagccatattcttcgctgctgcctttgtgttcaaagctattctggattcatttgatgcaaaggatgggatgcaaaaagttctaggtattttacatggtgctgcttctgttaggtctggtggcaactctggggcattagggtcctctaatgtaaaccaggggaatgatcggtcacctgctgaagttctgactgcatcagaaaagcaggttgcataccattcatgtgttgcactaaggcagtactttagggctcatctgcttcagcttgttgattctattcgaccaagcaaaagtatccgtagtattgctcggaacacttctagcgcaagagctggctacaaaccatttgacattggcaatgaggctatggatgctgtttttcgtcagatccagcgggacagaaagttaggtcctgctcttgtaagagctcgttggcctgtgctggataaatttttggcatctaatggccatataacaatgctagaactctgccaggtgaagcttgtacattttcttttggtcagcaaagtttgttgtttacctattttgacccataacaatttgtttcaggctccacctactgatcgctatctgcatgacttaacacaatatgcatttggagttcttcacattacaacgcttgtgccatactgccgcaaactgatagtacatgctacattaagtaacaatcgtgttggcatgtctgtcctattagatgcagccaacagttttggctatgttgatcctgaggtaagatttttgttatcaaatagattaataagctcaataaattataaattataaatctgtaaaatgtggctgctgaaatcatctctaattaccatttgtggatcaggtgatctgtccagcactgaacgttcttgtcaatcttgtgtgtccccctccttctatcagtaacaagtcatcctcaactggtaaccagcaacctgcagctacccaagcagttggtggggcattttcagagaacagagacaggaatgctgaaaaatgtactacagatagaaatctaactgcaaatcagggtgaatctcgggaacgttgtggtgatggtaacacatctcaacagggcaatactgtgcaaattagcacacctgttgtgccatctggggtggttggtgatcggagaatatctttaggagtaggagctggtggtcctggtcttgctgctcaattggaacaagggtatcgtcaagctcgagaagtggtcagagctaataatggtataaagattcttttacagcttctcagttctcgaatggttacacctcctgtggctattgatcctattcgggcacttgcgtgtcgtgtcctgcttgggttggctagagatgatgcaattgcacatatactcactaaactccaggtactgttggtacaatgtccatctacctttttttcccctacacctctagctatgatttgagcattttttttagcaattggtcaactacattttcactgcataatcactagtaagcattaatactgatggtgtactccccccactttgacatacttcttgggtcctttctttacatactgttcaaaacaaattagttaaatcttgaataaaattagtcactgctccttcatcagcaattttcttcttattgtttcaggtaggaaagaaactatcagaactgatccgtgataccagtggacagtcaattggaggagataatagtagatggcaaaatgaactgacccaagtggcaattgaactaattgcggtaagggacttgtattatttattgtgatgcaaatataaattgctcaagagcttacattcgtagagttcctttcctgatttaactgttcatgatgtggaacaaggtggttgcaccgtgtagttatttggtattatttcctcaattaccatgaatgcagtgtatgtaagcagcttatacaacttaaattagtggttgtgtgttagaattaacttgtgtttccgcaatattctcctttttacacatggacaatatatatgctcttttaccctaattatgtattgcatgtgtcttgtgtcctgtaattatgactgctgttttattttggtaggtcctgacaaattctggaaaagaaacaaccttagcagcgactgatgctgctgctccagcactgaggcgcattgaacgagctggaatagctgctgcgactcctgtctcgtaccattccaggtttgactgctttatgattttgcttccattacttcatcagcttttgtgtctgggcatttacatttgtttttatttttggtggtgtctagggaactgatgcaactgatacatgaacatctccttggatctggttttactgctactgctgctatgctgcaaaaggaggctgaccttgcacctttgccatcgacagctgcagtgactcctgtccaccaggttgctgccctggagacatcatctgctcagcaacagtggccttctggtcgtgttcagggatttgtgccagatacaacaaaggtgactacagaccaaactggccagagatctgattctgtcttgccttcatcaaagaagaaatcactgtccttctcatccagtttctcgaagcgaactcaaccttcgcatctattttctggtaatagagcaagcaatagcctgaaaagtcctgttcctattgggaatgttgacaatatgatttgcgctgcttctactgtcaatactggagatgcggagacatctcataaaacaccattatcgttgccacagaagaggaagctagtggacatgaaggatcttagttcagcgtcagcagcaaagcgctctgcaatggttgatcaagcatgccagtctcctgtattccaaactcctgctcctactcgcagaggactgtcagtggcagtggattctcctactgcttcatttcattctggacggccaaatttcaacaacatttacacagagaacctggatgattttcaaggcacacctggagcaacaattaccacaccacatcacggtgcaagtgatcaacagccagtaaatttggagtgcatgacgctcgattcactggttgtacaatacttgaacaccaacaccgccaatgtcctgctccaataacaactttgccaccactctctctgttgcatcctcatgtttgccctgagcccagtcgcagccttagcgcgccagcaaacatagctgctcgcatgggaagccgtgagataaggaggcaatttagtgggatccaaatacctcgcagggatcgccaatttatatacagcaggttcaagctatgccgtgtttgccgtgatgaatcctcacttttgacttgcatgacatttcttggtgatgcatcacgagttgcagctggaaaccacactggggaattaagagtatttgactgcaacactgcaaatatcctagagacccagacatgccaccaacagcttgttacaatagtagagtcggcatcttctggtggaaatgagctgattctcacgtccagccttacgaggttaaagtctgggatgccttctcagtattggggggcctttacacacatttgagggttgcaaagctgctcggtttagccattctggaacttcatttgccgccctttccactgatacgactcgtcgggaggttctattgtatgatgtccagacatataatcttgatctgcggcttcctgataactctggctattcaggaggccggggttatgtacaacctattatacatttcagtccatcggatacaatgttgttgtggaatggggtcctgtgggatagacgaagtccaaaccctgtccatcagtttgaccagttcactgactacggcggtggtggcttccatccagctggcaatgaggttgattttcttttcctgaacctttttgttattttgttagtttataattctgttcatttcagagcatgggcatcaagagatttactccctctattgcaaagtcataattttctcaacttatgaaccttccgctctaattccgtccttaaatattgttaaatgccaagcccttataattcataatggagagcaacttttgtacagaaagaatccatatttgtgaatttgtgttgtcacttgcccatgcaccatgtgctatgtgatcctgtacttaacacagctggctcagggccaagctatgatgttaaaccattgggtaatatcggggtaatggtttgcttgctcttgttcattttgtttaaacaatcatgaaccagctgccgattctcacatttcaacaacttatgcagccaagggccattgctacccagccagtcccatttttcgtccagccacctgatttttggggtgtcgcgttccacataaatgacctccataattaatctgcaagtctgtttgggtagaataggagcccatggaagtaacataaatgaatttattttcctgattttgccactaaactgtaaattataattatctatatttttttagagtaatttgtttctggtgtgcttgtcttctcatctctgccgtccatactttgcaggtaataataaattcagaagtgtgggatctaaggaaatttaagcttctgaggagtgttccttccctggaccagacagtaataaaatttaatggcagaggggatgttatctatgccattctcaggcgtaatcttgacgatgtaacatcatccattcatactcgtagggtcagacatcccctgttccctgcattccgcacgattgatgccgtgacttactcagacattgcaacagtccaaattgatcgtggtgtccttgatcttgcaactgaacccaatgattctcttcttggggttgttgctatggatgatcctgatgagatgttctcttctgctcgcctatttgaagttggcaggaagcgtccaactgatgatgattcagatccggaggacgcaggtgacacagatgacgaa

SEQ ID NO: 29077 - DNA, 748 bp, Oryza sativa
tcaggctccacctactgatcgctatctgcatgacttaacacaatatgcatttggagttcttcacattacaacgcttgtgccatactgccgcaaactgatagtacatgctacattaagtaacaatcgtgttggcatgtctgtcctattagatgcagccaacagttttggctatgttgatcctgaggtaagatttttgttatcaaatagattaataagctcaataaattataaattataaatctgtaaaatgtggctgctgaaatcatctctaattaccatttgtggatcaggtgatctgtccagcactgaacgttcttgtcaatcttgtgtgtccccctccttctatcagtaacaagtcatcctcaactggtaaccagcaacctgcagctacccaagcagttggtggggcattttcagagaacagagacaggaatgctgaaaaatgtactacagatagaaatctaactgcaaatcagggtgaatctcgggaacgttgtggtgatggtaacacatctcaacagggcaatactgtgcaaattagcacacctgttgtgccatctggggtggttggtgatcggagaatatctttaggagtaggagctggtggtcctggtcttgctgctcaattgggaaggaaaaaaaagattggaagtgcccagctgacaaggtgtgttcaagatcaaactctacaatttgcaacttcagatcagagcaatgccaaatataccaagaatttgatgaactactg

SEQ ID NO: 29078 - DNA, 459 bp, Oryza sativa
ctcagtagaaagactttcatcacacaaaaagttcagaacactgagcttacaagaagggctcagatttttatatcccgataccccctgacttagggagtcaaggggaagtccctctgggacaaagattgactcgcttatgcattttccagtatcaacaatccatgcatcattatctcttgaatatgtgataggcctgagaagaaaacaacataattataattttatcaactgcatttagaaaaaaaaaaggctcggtttgggatctacttacttgattcctcggccttcttggatgatggataacaaagttatgtggaagtcagcgatgactgaggacaccactcgaagtccacgacctccagctatgtcccgaaggattctttctggttgacccttgcgtacttggaaaatctgtggggaaaaatcagtatgttattccatttgcaatacaaaatataa

SEQ ID NO: 29079 - DNA, 787 bp, Oryza sativa
gcccttacgttgtgcacatgtaccctaaagcttaaattaaaaaaaaaaagttcaaaaaaaaacaaacaaactcctgagtacagtttttgtgctgagctcacaaagagattacagaatgaacaaatcaagattcttctataagactgaagtgctggttaccaactttcctggttaacattcagcaaagcattttctctctaagtcctcgaactaggatcaggatattttcttttgtaaaattcacttgttactttcagaccaaagttgtgttttacataaatcatgcgatcttggcactcctgattgcttggttgaaaaaatatttctgaataaaaaatattttaaatttgccattttaaaataattgtcttctttgtacccaaatgttgttttctactatttgtgattctggaaatatttgatccaggtccatcacggtggcacatatgcaactgtttgtcagtggcttctgccctcgggtctacaagaaacatccccccatgttgaacagtttttccaaaacggtttccttaaaactaacttagaagtcattcttacaaaacacatatgacacatatgaaatgtgaccacttctcactacctctgtcaatactgcctgaagtcaagccaccaacatctcataacctcctgatttccctgtctttcttcctcgtcagggctgctgggacaatttatcttatttatttatttatgagaaggagtcttgctctgttgcccaggctggaatgcggtggcgtgatctcggctcactgcaagcggccaaggg

SEQ ID NO: 29080 - DNA, 379 bp, Oryza sativa
cccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaacc

SEQ ID NO: 29081 - DNA, 5340 bp, Oryza sativa
  unsure (1)..(5340): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctacttcaccaaccacgacgactacaagagtttcgacatcttggcatgcgtcaccaaatatgatgccttattattttactacaacaagtggtgttccaatcttcaatatttctactcggacatcctcaacacatatcttcactcaagcaatgactactcgacgacaagaagctacagttctcgactctatgttcagttgtttaccaactaaccaaagagtcaggggctacacaaatacaagactctcaaaatttgacagatgttatctcaacatgaaacaatcaattaaccagccaatgagtcattttcttcgtctttgcttcggagcagacgttctacttcagcaacttcaattatttcaccaaaattttggcttcttcatgccgccacaatttacttcaaatttctcaagtatcaagtttgagatttaatctacatattcgggaggttggagttatcaaccaattaactcagattcaacgagttggacaacagtttctactttccttcaagtgaagcatctgcaacatctacaactctaagttctactgccatctttataaatcaaagggtgttgcatcagtcttcattatgcacacgctcgcatcaaggaaactactcgagtttcaatatcttctcaacaatttgatggattattgtcactgacataatcaccagcacctctgcttcatcggccctgacttattatttcgccttcacggctgacctactacacaaacgctgatgagcatcatttttattatcattggctgctacactgctattgactggatcaatgacattgtcatcttcatcaacatcttgccaagcctcttcaacatagcctactcttctgctattgattggcaacttcatcttcacagcttatcatctctgttgctgctaatcgtcattatctcggcttgcctccaccgccgcccatggagtcttcactttcacggctggcttattatgcctctactgataggcgtcttcgtcttcttcaccaggtgcctcgtctgttatcgactgattattttgctgtcatggctgcgcaactctgtcgccattgctgggtgcttcgtcttcactgctggttgaattgtttgctgccgactggtttcttcgccttcatggctatgcgacttcatcacctttgaattgtgtcattgtctttaccactaccaacatcttcgtcagctttgatgggtgatatcatcttcatgttggtcatttcgtctccatgccgaccacgtcagccactatcaatggacaattgtgactacaacagaaggataagctacatgcttaggggctcatcaatacaagcgcgaggattatatcttcaatttggacttgttccgaatacattcaacatgaatttatggtcgtgagtcgatttcttatgctcaacgtctggactattcgttattccccgtaagggctatcaaccgaatacttgcaccagtcgggattcaacttttatatctattttgaagtatcccataagggataatcactcagatcagaagctattcatatgagctatacttggtctatatcactcggaagatttattactcgggagcatattacatgcgtcatcctttaaagggtgtcgaaggcatattttttggctaggcctaatatgtctacagcccatattttcaggtgtggcctgtcacgttcttttagggacttaggcactttttgcttaggccaaagtgcgcgtgatcaagtgcccaataccttaaaatccttttataccacagttactcaactttttaggagttggtacaatgtattttaaaaggtgcccaatagtgaagttttttatagctgccctgctgacttttttatatatagtcaaggcgctgtttgggtttatacagcaattgattggatacaatatcattgctttttgccacgtaagtgtgctttttattgaccaatattatggcttaggctgattatatatttggtcattttccaggcggttggtaaatcctttatgagtttatttacttggattttacaccacgtatgccatatatttccgggtgtggtgaaacggtgtgtcttttagagacttaagcacatttgttaaaccagtgtgcgcatggtgtatgcccaatactttagaaatttctttattcaccgcatataagcttcttctatagctgttttgctatgtgaatttttcatgatgtacacaactttaggttgctcgcatcgtattttacaaagcagttggtatatcactcggatcatgttattcggagactcacaccgcatatgctgtatattgatatcaagtcactcggttgactataattatcaaaaccactcagttggttggattatttactccttgactatatgcttagtttgttcaactaaccacatagtcgggggctacacctattaggtgcatctagtcgatgcacctaagtttacatttaattatttttcagccctccacagtcttcagatttggtaaaagtactcaggagaccatggcaaagatgattgaagcactcggctttggagtaatctggtttgagagaagattatctttcgactgtgaaggtcttaggggctactgtagagattatgggtaccccatacccacacggcatggttatccgactggttataggggatagcttatacctatcaaatatgtaacggatcatgacttgggtattatgtttccttgtatattatgaaacagcctaaagtcctggtttgataatattgtaaattagatttaggaaaccgatgccatattggttaaggtttctatcttgtaatcctgcccccatcgtatataaggtgggcaggaggccctctagggggcctgacacaacctgatcgtcagatctatactacacccggcggattcaaatccctaaacaggagtagggtattacctctcattgagaggggctgaacctgtctaaatccttgtctccgcatccatccacttttagatctcgtgtggttccccttttattattggtgaattcatgtttcgatatttttgtttttctttttcctgtaacaaggctctgtgtgtttcttttttggctttcttctaaaagccgggtaatataatgtttgcctaatgtcaaaaataattatgttacataacatatgtacaaggtcccaagtttaaaacatgaaacgttttcgtatattaatatagtaaatgtgtgcactttatcatcttatcgcttgatgtattttcatcggtacgactaagtgagcaatacgcttgattgtcaagaccgcgctaagaatactaacatcccaacataactacatgcaagaatattttaaaagcatcaagaggccccacatgttatggaggccaataccaatcatgattcttatgttcttttatcaaacctatgctttaaaccatatgttagttttaagaaccatttgaattaccatagtccattttaaatatataaaaatgagtttaatattgaatatattcatacctttaaaactacccctcatcctcttgcatctacgcgtttgcaccgcatgtcacgccacctgcacgagcccagcctagatagggagagaactcaacttgagccttttttagggcctagctatagaggccatttctcacatgaggttctaggccccaatggttgtgcaggcaaccaaacancctcttaggtatccgcacatgcgagcaatcttccaactaaccaaacacgccctatgccctatgcctcccaagccaatttatattatattgaaagatgattcaatataattatgctattgtttccttatatctctcttgcaatattttcgtaccggaatagatccagttgatcggtattcggtcctactagttcttcctgctatgtacttatgttttttttaataatttgtctcttcccagttacaactaacaccaattattgttatacattgcatttttgcactaaaggcaaatactttactgcagtacgtacaaacctccgacttcttttacggtacaatatatatgctggtagtataatgtcaatttagaaatttatcacaaaattttaaaaatggtactttagtactttcgtgcgcttagtccttccattgtaatggttggtggcggcgtacgtgaactcatgatggctagcagcgccttgccgtggtgaaggataacaagaataaggaatgggattgagaggagaaaatatacagaattgccatcaccaaatactagcatggaaagataattttacctgtacatttacatcaggagacaaattaattaatcctaataccgattacactactacgagaaagatttttgcgtgcggtcaaaatcagttttcgcgtgcgagtgggtggcccgcacgcacccaggggtatgaaaaatcacgatttttggcacctgcacacgaaagtcggattttcgcgtgcgggtgcttatatcgcccacacggaaaaacaaaaatctgaaaaaattcaaaaaagttgaaagtcctagaatcggcagcgccaacgccgctcccagccgctgcctcctcctcgtcggccgacgacgtcgctcccgccctcgttgtcatcgtcagccgaggatgctgctcccaccctcgtcgtcatcagcggctgcctccgcgacacccaccacccgatccgtgctcccgccggcctccatgccggccaccgcccgatccgcgctcccctccggccgcaccgccgccaacgcccctcccctccgccggatctaggagggaaggaaggggaggggaggggagctagatcccgcgtggggggagggcggctgcccgccggatccgtgcgggggttggccgccgcccgctggatcccgcgcctcggccgccgccgcgtggaggaggccgccgcgcgccatcgcctacacccaccgccgccgcgttgccactgtcgtcgtgcgcaaccatcgcctatgcccgccgccgctgtcgggaggagaggagaggagggaggagtgaggagatgagagacaccgtgcgggggaaggggagtgaggagaaaaagagatagagaggagaggaaagaaataggagaagatttaaagtgggaaa

SEQ ID NO: 29082 - DNA, 47289 bp, Oryza sativa
cttatgcaagaaagtgaaacagaccgcctacacacatacaacaggtcgtcggataaaatacatgtcagagtaaacgacaagcataagacagtatttgtaaatattctgcaacacactcctactagaattacgcaatgaccttattgaaaatatacacgtattctaaagttctgtcacgcatggagcgtattaaaagaaaaacatgctttgttattccaaatttctaagcctttttgggtgaagaacatgaggacggcgatatgcatggaaatcacgacagctttctttattttcctgtcttgacaacgaattctcaatcatttggccagactacttataggttcatactaattactccctccgtcaaaaaaaactcaacctacgagaggatttgatctctcctagtataatgaatctggactacctttatctagaggggtcacatctcctgctaggttgagttattttgagatggagggagtaagtactaacattacatttttttcttgcaacataaaatgaaataagtaattaataacaaaaatacagaatctaattttagctattcattgttcaatacgtacgtacttgccaccaagttaagtagcgccatcaagttaattttctcttgttgcaaatattagtacacaaatcaaataaacatggctgcatcactaaacgaagaaatagcacgaactggtacaagatttgttagctacgagtcacccgatcgaacaccgtgtgcgcacactgcatacgtcgggcacggcaacagacgagaaaactgaagaacgcagaaaaggaattcagaacagagaaagcaaagttttactgagtttcagaacttcgcgagagagagagaatttgtggggcaattttctggtttctttcattcaaactgaattgtaaaacttacaaatggaaacttagctactgctacttatactccaataacagaaaaaaaggaatccaagcttacaatcgcgtcaacccacgattcggaactcctggatccaatgccgtgcaaaactcacgccaacttcgcacttctgatgcagtcaccatctctgcagctcaccgcatctcccatgcatgcataacaaactttgatttatttgttccagccgttgcaaccgccatcgcctagatcaccttggggccatagctgaaataacagtcaacaaactcccccttaattctgctatggcccaaaatcacgaacacctagcaggtgccgagctgtctctaatcttgctgctggcaaacctttcgttaacgcatccgcccgctgctccttagtccggacgaactcaatttgaatcttcccactttcaacacactcccgaatgaaatggtagcgggtatctatgtacttacttctcccataaaacacagggttcttcatgagtgcaatcgctaattggttacagtatacaacttcaccggcctaggttctgcgccaataatctcaatcaacaatcccctgagccacagagcgtgacaagctgccgcagtggctgccatgaacttagcctcacaggacgagagagccaccgttttatgcttttgtgaactccaggaaatcaaactattgttgagataaaatgccatcccgctagtactctgacaatcatcagtgttaccagcctgatcactatctgtgaatctggtgatctccactgcaccgttgccatcagcaaacgtgaacccacagttgatagtacccttgagatacttgaggatttgctttactaccttgaaatgcatcacagtcggtcgctccatgagtctgctcactacacccacagcataggacagatccggccgtgtatgcaacaagtaacgcagacaacctatcactcgcctgaattgtgtggcatcaactggactccctttagcatctttatgcagctgtgaacggtgctcaataggaattgaggtggaattgcaatgtaacatcccaaactgggtcagaatcttccttgcataagcagcctgcttgatggcgatcccatttgcaccttgcattgtatcacttcaatccccaaataataagtgagaagtccaagatcactcatatcaaactcccccaccatctgttgtttaaatgttgtgatctcgcttgagttttctcctgtcacgatcaaatcatcaacataaaccccgacaattagtccggcattccctgtacctctggtgtagacagcttgcttttgtgcacaccggctgaacccaagctccttcatactccagtcaagacaagtgttccagccccgaagtgcctgtctcaggccgtagagagccttgctcagtttgtaaacaagatgctccttcccctgcttcacaaatccttccgactgatcaacaaatacctcttcctctagatcgccattaaggaatgccgacttgacatcgagatgatgcacctcccatctccgattggcagcaactgcgagaatggcttgcaccgtgtccagccacgcaaccggcgcgaacacttcatcaaagtccacaccttgcctctgaacatagcccttcgccaccaaacgcgccttgtgtttgatcacctcgccggtagtgtttttcttcagcttgaacacccgcttgtggcggtgagtacggtgctgtcaggtggcactcgatgccggcctcggtgcagacgctcgtgaactcgctggacaagaactcgccgccgcggtctgttcggagtgtcttgatggttcggcctgccatgttctctggcaacggtttgaatttctcgaatgccgtgagcgcttggtccttagacttgatcacaaacacccacatccaacgagaaaaatcatcaacgatcaacataaagtatcgattaccggccagtgttgatggggtgatcggcccacataagtccatgtggagcagctcgagcggtgtctctgctcgataattggcaatcgctgggaacggctgccggatcggcttagccacaaaacatgcttggcacaattgatttggatggtggactgcgggcacccctgtcgccatctccttgtccaccaaatgcttcaacgcctagaagttcacgtgcccgagccgggcatgccagagccacaccaggtcgtcgagagtcgagactggccagcaaacacacaggggacgccaacttcagctcgatgcgatacaacctgttcacggttcttctcaccctgatcaccaatcgacagtgattttgtcgaacacctcgaggtcatccccatccatcatgactcggtggctagtttcggtgagttgccccagactcaccatgttgcagcagaggctggcaatgtagtagacatcgtcgagtagccactggtcgccatttttgaatgagaaaaggattgaacccttctctattatctgcaccgatgaggcatcgccgaacctgacttgccccgtcacggttttgtccagctcccggaattttcgacgatctccattcatgtgattactagcaccattgtataggtaccagacatcaccggcggcggcgccattgcctgccagcatcaggcgcggccatacatggtcctcgtgcacgaccagcccacagtgcacgccttgacgcggcgtgttctgcaccgcctctgtcatggcgagcaacaaagctgggccggcatccttcgtctacgcaagatgagtttcggtattcttcttcttagggtgtgggcactacgtggagtagtggccaaattcgtcacaattgaagcactttatgtggctcttgtcatggccaccgccaccagagccgccgctaccaccatcagagccaccactgttggaaaagagtccaaacaacgtattcaatgtgtattctttattcaatctgcctccaacttgggcaatgcttacatatttatatacaggatacaagagggaattacatctttgccctacctaaatcagatgtaacttggctggctgatgggccagcccttgggcaatcggtaaaatcccaggtgacaaaagcagtgacgcttcccgagggtgatggctattatccgggtaaaggcgtgcccccggataatagcggatgctgcctgcccttgttaggatgtcagaggtggttggcagacgcatagtgcgtatttatggtgccccactacgctcgtgatccatttctccatgcttgagtattttgggcccctggtcgctccggagcccttgatctgcttcggagccattggtcagctctggagccagtgacctgctccggagtcgttgatctgctccggagcttatgacaggctccggggtgactggtcagctccggagatggtgatgtgctccagagctctcggttggctccgaagcctttggtcagctttgacttccggggtatcgactgcctttggtcattctcccttggtggactgctcctagctgagtttccctactgacggaggccagctccatcatccggagccattcccccaacaaccacctcctgagttgttgttttgtgccccgccgcgtctgccagctctgcgacccctgccacgtccgcacccgtcctggccgcggttcgccccctcgccatagggcttattcttctgtggcgcgaagtttctctgccatttttcttgaagcacgcttccactcgacctgagtgtgcaacacctagccgtaggcgatcactccgccaacagcagctttcttcttgcacacgcgctcgtcatacgcctttagatagcccacagcctcttcgaacggtatttcgtcgatgtcgtagaattgctcgatgacggcaacaagactgatgaatttctccgggacgatgtcgaacaactttttcaccatatcgacgttgttgcacccagagcagaattccggacccccatcgtggtgatcctgccggcgtactggttcagcgtctcctcggcttccaccaccatactagtgatctcccttgagagtttgaaggcgcgcattgcgcacccagtccgccccgacgaaccttgtcttcaggcagtcccacacctccttcgccgtccacttctttgccacctgcatcaagagatcctccggcagcgactgaagaagatgcgtcttggccttcttgtccttcttcgggtcgactgccgccccagccgccggctcgatcgtctcctatacgccttgatcctccatcattgcttgaacccgtatcatccaactagtgtagtttgttgatgtgagttatcggtaaaggaaagcacttcatcgggtccgccgttgccggaaccaacgccatagtgccaaatccgccctcaacctgagaagctctcataccacttgttagttacgagtcaaccgatcgaacatcttgtgcacacactgcacatgtctggcatagcaacagacgagaaaactgaagaacacagaaaaggtattcagaacagagaaagcagagttttgctgagtttcagaacttcgcgcgagagaaagaatttgtggggaaattttctggtttctttcattcaaactgaattgtaaaacttacaaatggaaacttagctactgctacttatactccaataacaaaaaaaggaatccaatgccacgatccggaactcatggttccaacgccatgcaaaactcacgcccacttcgcacttctgacacagtcaccatgtctgcagctcgccgcatctcccgtgcatgcataacaaactttgatttattcgttccagccgttgcaaccggcatcgccgggatcaccttggggccatagctgaaataacagtcaacaaaattgcagcctggtgatgatagtcaagccaaatccataaatgagggattcaattgagccatagctcagactacaatgatcccaatgccttttatgcccaaagaacattcgcactagtaaacagaatatcatccatgactgcatattgtgggagtgggaccatatatggcttgacatagggttgatggattttctattttctcccaacaagattcggttgagttgtatttgaattcatatgcatatataaagccagatgcctagctaacattgtacgttagttaatttccaactaataattgattgtataccattaaagcatgtggccaataaaaaggcacaaaataagagcttggcacagcttgtctggatgcatgagctctgtcccaattttattatttttacaaataaatcgactgaatttctagttattttgaagaaaggttgcatagtgaaagaaagaaatgggactaaaccaaggccatgaagtttattgcactgtacgtattattgctttagctactaggggtttctctagacatgaagctcctaccgtcactccagaacgatacttcgggccacttaggacatcaaattccttaaactggtatttaagcttattccagtgagcaaccaacagatgtatgtgctgggtgcaagctgaacagcaatgtcatggggggacaaggacaacagtacacagatgtcatcaatcctatcccggcagccgacttgctgtggcgacacagaagtgtcgcaagcaaatacttgaattcaaattatcaggttcctttgtgcaaaacatcaaaaaagttcagttttaacaagattctaatccaaaggagtgaaattttaaacgggaaatggatgtttgaagctgggagtactggaaacgaaccggtttgcagggaaaaccgaccgaaataaatgagaaaccaatgatagttaagagtttattattcttccatgcaaatggggaaatgcatggagggaaaacggcaggggcgaagccaggatttatggttagaggtgtgtgggcagggcgaacaagttataagtcagagtaagcaataccgacgataaaacaaaacatcaagtgttctgccataaaaaagcttgaatttagctctttagttgtatcattggatatttgacagtttgagatttgagacatcatgctcaacagcgagatgcaatgggaggacggagagacatgtgaagccgaagcaatgaatacgagttgatttgcattgtctctttcttattgattaattttctatattatgtttattgataatggactaattaacatgctaatacactaattagtacaacagggaggggtcagatatggggggtgttggccccctccagcaccccctgtagctgcacctctgaaaacggtcgaatgttgtgaaattaaacttatggagtggtgaggaaaagccttaaaaaattacgcctattattatattcatgtatggaggataatcttatcctatgttactacaaagttacagtactctagtaaatcctaaaactgaacatgcaaatatactaccggcctgttcactttgatgtcattttcaaccttaccaagttttaataaagttgccaaaaaaagtggctacatttagtttgctgctaaattttagtaactatataagaaatcctgccaaaattttagcaagttaccaaaatttggtagtttttttttcatcaaagtgaacaggccctacattatcgggcctgttcactttgatgccattttcaaccttaccaaattttgataaagttaccaaaaaaatggctatattgccaaattttggtaaggtttttttttggcatcaaagtaaacaggcccatcatctataatgaattttctcttatataattgtacagttgatgtgccatgatttttggcagctctcgtatgatgttttataattaattgaaagatttctttaaaggagtatctactaacttggaagacaaacattccatgggataaataacttttcaaaatctttttgctaagttcagtaaaatttagaaagtttgccctacatactgtcctaccgagacccaacaataaaggctgagtttggcactccatgttcccaactcacctctttcttttttcgcatgcacgctttttaaactactaaacggtctattagttcttcacacacaatgtcccttggatcagagatgttgaactatccaggcagtgtatgggccccacaggcacccacggtctattaggtattcacacactatgtcactcaggtcaaagatattgaactatccagattctgataccaattataagatcgtaaaggacatttcccaccccaaaaggtagctaatgaggtgagaggctccctcacttatatattagatcccttaaccttctacaaccaacatgagagtattctacaaccatcatagcgggtgttgtaatgactcattagaaaactctggcattcaggtcttttcatattttctagctcaccagtcaccagcacgatcatcgagcagaggtggttcttcagtagccctagtactgaactactgattggcacgttgccaacttgtttttccttttgaaaggaacgttgtctccttgtcgccgtgagcctgatatgaaatcttccgaaggcagtgctaccgacaatccatatatacttcaattgagaaatgtcaattgtcagttgccatgccacgaagcgcatagtagagaaatgtagttggtgtggttgagcacaaaacttgacttactgatcatccaatatgtactaaatcaatatatatatgcgttagttcctgagatttcaactattacaaatcagaaagggttcaatataaactcttggcaccaagctgttaagcagccgaggaaccactttgtttgtggcataatttggcttatagttatttcatctgtgcaagccaaattattttaggatagatggtgcaattgtcagatgatttgcttgaaaatgaactcactttacatgtgcacgaattgctgtgcagagtttcaaggttgattaattatatcatgcaacatgctaggaggtgattatggaaatcaatgctttgtctcgagctgcatgcttggggagtcgccaaaatatattgacgccttttcgtgaccaacacaagatcacctaacgatttgcggtataatcaacagagtcgccaaaatcgatagatcaaaatcggctagcggaaccgatttcgagattaattcactttcgcggaatcacacgactaatttacaagcaaattagcaaagaggataaatatcgtacttacgtgacgacgaacgactagtttccgagcaaactagtaaatgataacctcctcgctttcgtggagaagcacggccgtttttcaacgcaaaacggcaaagatcaaccaaatcctagggttgctagaactcagccataaaaatgaaatagaaaagaactaaaaagaaaagaagatgaatagtagattgataaaattgttcgggctcctgtcaattggttgtcaccggcgcttatatataccggcaatcacaccaatttttggcatcctaactgatcccatgtagaaaacagaaagtcctatcgaaaaggaaacaaactaaataaaatccatctccgatacggcgccgctgcatgcgcgaaccatatccagctcttgcttgcaaccagtaaactactccattgtctagttacatcccgccctggttcagagagaatcttcaccaagcagcagctcgagacaaagcattgatttccataatcaccacctagcatgttgcatgatataattaatcaaccttgaaactctgcacagcaattcgtacacatgtaaagtgagttcattttcaagcaaatcatctgacaattgcaccatctatcctaaaataatttggtttgcacagatgaaataactataagccaaattatgccacaaacacacttctctctcttgttgtgaacattggtgtgtggcactgtgagatcatcgacagtcagactgtcagaggcatcagcagcatcaccaaggtgtgtttagttcacggtaaaattagaagtttggttgaaattgaaatgatgtgacgaaaaagttagaagtttgtctgtatgaaagttttgatatgatggaaaatttgaaagtttgaagattggaactaaactcggcccaaactacataatttctctactgtcacagggagatcgtcgacagtcagactgtcagacggtcattgagtacaaatttgtttatgaaactgatactgcaaactagcttgtacgtactattgcactaggtacagcatcgtgtgcaatccctgaaaacagcactcagctcgctggttaggtttgtctgcaatctagaccacactatcacgggacatgatgaacctcgtggaaaccgagcgatgctgtcgagatagagaccggacagtagttacagactgcaagaatcctgatgccttccatgcctcaagcacaatccgggaggaactgtcaaatgcatgcctgaactcattgtgttgacatgttgtttcataaaggaccggtcgatagtgtatttcatttttcaccaccaattcccttgtagtttatatagctagctagatggccaactaacatgatacatatttagttatttttgttattttacagtccttaattagaaattatcagaaggtggcatattttttaatatttacactaaattctttcttgcctatcactatctttgaaggatcgtaaaatttctcagttcatgccaactaatttttattgcgtaaagtccagttactttcctgttacagctaagttaccatattccacttcttgcactactggagaatgcctcttctctcctggttcacacccccctgtagtcccgggttacaaaccgggagaaggaatccaggactaaagatagcgatctttagtcccggtttaaatacctgggagtagagatgttatcaaccgggactaaaaatcatctacaaattaagagggaaaaaggaaaaaaaaagaaaaacatcggccggccggccctaatcgtgcgcctggccactggccgcaccctctgcgccgctgcctgtcgtcgagcgctgccgcccgccatgcccctccgcgccagccgccgcgcggccctccgtgctaccgccagccgcgcctccccacatccaccgctcgctccactgctgctcgagaggataggatagagagaggaatgggagagatagagagaggaaagggagatgataagaaaagagaggaggaggataacggaaaaggtggttgctagaggataagtccgagggaatatatattatgcgccgatttttagtcccggttggtggttccaatcgggaataaaaagagtagggggacggacaatttttcaaccggggctaaaaatgatttttagtaacagttggtgttcccaaccgagactaaagatcatagaatggctgtggggttttcaaccggggctaaagatgatttttagtcctggttctttctgaaaccgtaattattgtggttttcagccgatccagcaaagatcagttctccagtagtgttagtaataatggaaacaaaatgttaccgtaacattatattgtagtgagttacaagcacattgtcagcattttatttttgatgttatagttagcatatcatgtataaatgtttcgtgatattgggagcatttgtttaactcaagtatatactctaaagaaagtgtcataagaaagctttatgtgtgctgtctgttatgtgttcaaaatgcaaggcacttagtgctgccaacgatagtaaacctgaatattataagaatggttctgttagcatatctaattaaatgtgcaatgaacctttcgaattcatattttcaattgttttgaaaacatcaggtagcattctctttcagaaacaaaatattcagactgtattttgtgaatattattgatttaatgagcatgaacagttttttgatggtgtcaaaattaaattcagaaaaagggtgaaattgacatttttctagataatggaatgaaacatcccggcctttgctcatgagagatacagccaattattacaagaagtagcacactaaaaaggcacagtccaaaattaaacaagcacaccaaccaaaaataaaagaaatcctaacatgacaagaaaaacattattccagtctattggtgaatctccgtatccatggttggtaaaagttgcataaccgttgactcaaggttacgatatgcagcagacatgaattcttcatcttcctcacacttttggagttgggcccaccgtcgaagccaatatgttgccctgaaaattacatatgatgttatcataaactgtttctggtacatatgatgtcctccaagtccaattatgattaacagatgggttaagatgcagttagactaaaaataaaatctattaacataattgaacagaacatttttttccaacctcttgttgcaaaagactacagtgctaaagtgagatagcagagttgtactttttgcgcgtaggtttgtaaaatttaaaaatttatcaaattgcagaaaattaaagaaaatgttgaaatttgaatagctattgtttgctgaatctgaacaaaattttccaatctaaataaaaaactcaattttataacgcgcacacatccaacctagacctaccgttggacatgaaatttgagcctaaaattgcaaattaaccctgtactccgggcctccctgcaatggtacatagagcttggaccaagcagctttaaatataggcaaaatttatcacaggacactcaaaaaatatgtaattagctgtgaaacaccgtaaatacgtgaatttgttcaaggatactacaaaagggtgataatttgctgtaggaccacaggacacgttaaaatatattatcacacaattgaggagagataagccatacaaaatagcaattttgcctccccctctgcgtcacggctctgctctcttcaccgaagcttgccatctcctcccccaagcttgtttgtctcttcgtcagcaaggtaaaccgtaaacccctctgtaccccaacaacggaaacagagaaggacagcaaaaaaaaaaaaaaaaaaactaaaagaacacacgggaggaagctcaaagacccaattgtttatctgtgtcgacgaccacgaccgaacaagacgagcaagacatagccagaggagatgaggtaagtggtgggagcgagcagggcctgtttagtttgagaaaagaaaatttttggatgtcacatcggatgtttgaccggatatcgaaagggttttttggacacgaataaaaaaactaatttcataactcgtctggaaaccgcgagacgaatcttttgagactaattaagccgtcattagcacatgtgggttaccgtagcacttatggctaattatggactaattatgcttaaaagattcgtctcgcgattttctccctaactgtacaattagttttttcatttatctatatttaatacttaatgcatgtgtctaaagatttgatgtgatgtttttgggaaaaaattttgaggaagtaaatggggccaaaaactgagaagcgcatgcagatgaaaagagataagggaggagagacgcgacgtgaacggttagcgaaggaaagggggcaaggcaaagaaagacggcgagatatggccccaagcctgactccttccatgcctagaggcaacattgtcacaacttccataccgcccggcagccgtagctaaaggtcacagatgcatgctaagtttggggttgctaattaaataatctgtggttctgaataaatagggagaaattaaagtatctagctagctacttatagtgaacatgatggggtatatctgcactcgtatgaatgtacaattaatcatcgttcgacctgggaaaattttgcacaaaatggcaatatttttcgctgctttgatccagcatttcagaattgcaagatttaatataagggtttttttttactgtgattatctgtagacgaacacgtgagaagagaatgtgttgcatccttacatatgacaatttcgttttccacacaagcctttccttttgtgtttcgatgaagaaattaaggcaaagtaatctacattcataaggcaatatatgtataggtgtatgaggctgtatgttcagattaatgtcattacaaaccataccaatttttcggtaaagttagcaaaattgtgcacacatttaattttttgcaaaacattaaatatacatttagctttttgcaaaactttaaatacatagaaatcctgctaaaattttgataatattgctaacttatcaaaattttgacattgccaaaatttactaaggtttattttggctacaatctgaacagctcctatatttacaatctaattggcaccttgtctagtattatattcctagctatatatctcaatctgatttgaagagctgcatacaaacgccttgcctatatttgtaaaattatgcaaactctgcatagtttgtgatgacgacaataggtttggaaagtttaatttaacggatggttgtgtgctgcggctaaagtacatgctctccgatgcatgcagcgctactgtaatttttttacttgaattgagaaatgtaacgtacgtagctagcacattaattttcattccttcaaataatgtcaagaaaaaaaataagaaaggtttgtagccgtccagaaaactgatttactaatacatagagttgactattataaatctcgagtactccctacatttcataattttcatattataagtcgttttgacgttttccttattttaagtttaactaagtttataaaaagatacatcaacatttctaacctaaacaaaatatattatcaaaccatattaaatttctaattcggtgttgtagatatgcattaaatttttctataaacttgactaaacttaaaaaaaaattcactagaaaacagtcaaaaacaacttataatatactacctccatatgacgccgttgattttttatctaacatttgaccattcgtcttattaaaaaaattatgtaattattatttattttattgtgacttgattcgtcattaaatattctttaagcatgacataaatatttttatatttgtacaaaaaattttgaataaaacgaatggtcaaacgttgatcgaaaaatcaacggcgtcatacattaaaatacgggggagtaaaatgtaatagagggagaagatgtctcgtaatgagaatcaaaatggccctcaacacgtaaaaaacaagaaccgcatgttcgctgggcggcgtcactaaactagtgaattaacactggacattgccagatggcaccgggtagtggatgtcggccccagcctgtagataacatcgtgactactcgatggaaaatgttgatatgcgtgtgattttctagggctgccacacctaacagaaaacaagcgatgccaccgagctacatctgtcacggacagcagtgatcccgatctgccttccatggctgaagcacatggctaattctttgcgtggctagctagctgcattgtgtaattgtgtccaagtatggctcaacattgcgttgatggtttttcggttctcttttcaaaaagatatcgaacaaggctagatggcagaggagagtggtatatatatatatagcaggatcgctagctaattagcatgacacgcagttaatttcttatcggatgattaatgtttgtgtgctccctccgtttcatattataaaacgttctagcattgtccacatatatgtgtctagattcattaatatatatatatatatatatatatatatgaatgtggacaatgctagaacgaaatagagggagtataagttacagctactactctccgttcaaaaacaaacaacttatagagttttgcatttgtaaaagaaaaaaaatcaacttttgccacatccaaactactactgcatggtaaacaataaacacaaatattatagtagtacttccgaaaaaaaaatcaacaattaattacaatagtattgtacaagggcattttggtctgttgttattatattaccactaaatttgtattgagcttttttgagaaaaagagagtacaaaatatataattcttagttactatctctatcccatcttgtaactacttctgcacttttaagagacattaagtaataaggtgaaattaaacaagagacggttgtgatggttgaaatgagaatgtatatatgtaaataaaataaataagacatggttataattggttgagaaaagagaatcagtggagaaatagtatattatgggataaattttaaatactagaagtagctataatagaacagaggtaataccacacttttcttcttagtactagttgtaatgaagaaaacattattacactactatattatatatatactgagctgtatgaaccaatcaaccgttcttttcttaattagttcgatattcattgttatggaagcaatgccagaaatttgctctcctagtaatagctagcatatcatgtataaatatttcgtgataccagtagaatttgattgaaccaactattggccggaaagatatcttaagtaagctgtacgcgtgtgctgcatgtcttagtaattaaaatttgcagaatgcaagatcggcatagtaagttctgccaacgatcacacaactgaatatatcatatataaggctggttgtgatataagttatctaatgaaatatttaatgaagatttcaaatgcagcgctactgtcaacaagaatatttttactcgattttgagaatcaccaggtagcagttttgttctagaaacatgatattcagatattgtacattttttttgtatgcataatgagattttctgatcattcattgttatactaattcagcaaactgcattcttcccatgcttagtatctaataagttgtccctgaagtatgagcaacaactcttttcgattttgtagactgcatctgaataactaactacatgcttaacaaaattaagcataatttggatttgtacgatctcaagttataacaaaatcatcatcaactacttgcaccaagtagcagccaaatgaacttaccaaaagaaagtgagccgggcgaaattgtcatgtttatgaagttatgtttcgtggtacatgatgtttcccaaatacaattcaggtcaatcaaggattctgttttctccaggcgttgctaaagaaaaacaaattgccgcgtgccttgcacgatcactccaatggtagtagaaacgaaacaaattatgtttctgctggttgcaatgtagctcgaggagccaatttgaaatgctggaattgcaagtccagtggtagaagctaaacatatagatcccaatgtttcccatgtccatgaaagcagtgcctatattatgttgaatggtgatgctatttttctcttgcaatctttttccctacaagaatcggactactagaccgtgtttgcattttgtagtttgtacaaatatatttataaacaagttcttgctatatatatatagccatacatcaattgacacccttaaagtaaaattgttttctttctagtctcaactaacatggatatattgttgctatatataatatatggtatctctgcacggaggcaaataatttgctgcagcaaaagcctcataacttctctctgcttgtaattttaaagcatacatctacccaaaggagaaaatagtggatactcaattttaaaggttaacacaacaaaagggtaaatctttcggtactattgttcacagtacagatgattaccttgtcctagaaaatgaaatgcatcatcaattccgtacaatatatacaacaggttggtagataaattacaagtcgcgtaagctgtatgcaacacatccgcttattgcaaatatacacatatccacaaagttctatcacgcaaaacattaaaacaaagttatttttgttcatatagcagctctagacttcttcctcgtgaagaacatggtgatgcgggggaagaacgacagcttctttcttttcttcttattcgagagcaacgctgaatcattaggggtactcctcgcagacatatccagcagtggatgaaccgaggcgtaactatcatccttgcttgtgctcttggtgtcgctgctgcgttcaacgatgatcacaggggtgcttgatggattaagttgcgatttcaaagcttcgccagccttacgacgctgctcattctcttctctccattttctcaattcttgctccatggcaagcttgccttcagtggctctatcagctctctctgtggcagcaaccaatgcctgctttcgttgttccaaaaccttgtgtgtttcactcagtgttgataaggtacgagactcggactccttggctatcttggcctgtgcaattgcagaagccgtcctttcatggacaagttcttctgccttgctggatttcgcaatgagagattggtattcatccaggtcaactgtgactatctgagagccttgttcctcgatatccactggaagctcactgtcaaacggtctgagggcatcaattgccagcctcatggactctttcgtggcctccatctcctttagaactgcctggatcctgaattccatagtatcaagacaagattttgcatggtccatatcctccttggcctttcttagcttctcctgtgcctctcttgcgatggacttagactcatcagcttctttggctgtatcttccataatcttctgcaaaccaagcattccatttcgggattctttctccttggcctgaactgcttccagttcccggagtgctagctgaatctccacccttagagatgcagcagcgatggatgacgtcgcttccatctgcttcatggtagcaagtgccgttttctctttgatcaactctgtttttagcgatgccgcagcaacattcagagcacaaacttcatctctcaccttatctacgctcatcagacactcctccaactctcgtgtagatagaataacttcattgtgtaaagatctttgagtaatatttccttgtgcttctttatcaattggcttagcttccacatatccagctagctcatttttcagcttgagcaacaagccggttgatgtgtcaagtgttgatttcaattcttcaatagaagaaattttcttggcgagctgattgagctcctcttctgcttgcctcagatcactcttccatttaagggaatcctcatcacatgccaaggacgtgtctttactatgtttttcagcatcatggcatgtggaatgagccaattccaactccaccttcagtctgttaagttctacggtgagctcctcaaccttccttacagcaccttcagacattgaaacggctaactgagctttcccgatagaaatatcccgttcaatcaacaaggtctcgtaattctcctgcacttttccggactcatccttcactaacattaagttggccagcactgcgttgtactgttctttgattatattcaatttctccctgccaatgacaccaccatcactggtatctccttcccgcatctcatgtactattaactgaaataactccaaacccaaccttgcaattatctcctcctcttgtgccttttccaggtcatgttccaatccttcaattagcctctttgttttctcatactcattggacagaggcacctttgctgcctctacagcctccgcttgtcgtttactttctgaaatttccttcttcagcctatcaagttcaagtacgatttcattctcctgcatgtactaagattgttaatcttacatggagatcacatatgaaaagaagtaaattaagtggtaaagcaaggttttacaaaattaaagaaaaaaatacaaatgacagcataatttatagagctgtagctgagatgtttcatatgcaaataagggaagggaacaactctgagttacctgctctggctctgttatacgagttttccagttgacgctgccaccaaatcttgaggccgccaccttaactgattcaatgtgggttgttgtatcgacaaaggtgttatctgttctgaagttcttcccgctgtttgatctgttcaaaggtgcaggggccttctgccgcatgtctcttaagctcatttggcgctcattaaaatgatgcatcagatgtggcttcttttctttcacctttgctggtgtcgcagctgaagtctcatatgaagccttcacagaataggaacaaaaggcatcatccccagtgttatgcaggggtgtatcttgtagttggaccactgctttcagcctgtcggaggtctgtgaagttgagtgggtgttcttctctgaaggtggaattgtggtagaatcactgctgggttctgttgattcatcatcattctgagaggtcactgaaaaagcatgaggatcactggcagatacaagtccactgttgtctacttcagatggagttgcgcagacgctaataggagccttttgttctgttgatatttcttgcatattgcttttgttgccaactaagatttctggaagttcttcctgcattgctgcctcaaagttggctgtttctctgttctgaagattactgttctcacaatcagtacctgcagttagctcaggctctgcagaattttgcatgaatttcggtgccgacaaagatgcaattagaggggagtcgggctcttcaagattcttctctgccattcttcaaactcagttaaatattatctatggaagagaacattgaagaggaaagtagactgataagttgatcacagagcattataaaccaatattggagaaagagctgctttctcaaatggaataaaatcaaataatacatgatcgtacaaacacatgctaataacaaacttgtataaccatgaagggagatttttttttggttatttcatcaaaggatttatcttctgtgattttactatttgaagaacatttatggatggcatcaaataattcatggtaattacagcaaactaaacataaactatcagtgcataaacaacttgataattcaaaaaccaatggccatactgtttatttggccagagatacttccgggctcttattattactattttccgtgaacaattagaattcatttagagaaagttacaaatatattagtacactatggacttttaccagacaattttttttactgaattttaccagacaaaattaaaaacaccaatctttttaagaacataaaaacaccaatctgaaacatataaagaataaaagatcaggagagtgaggagagttttcaattttgacttttgagtaaattctgttgtaaaacaaagaaccatattcatgctgaaacagcagaaaacatcagaatgatcagtcgaggactcatgaaacgaaatatcaatatcagtctaaaactgaaatatgaccaatacaacagaatagtacagatatcatggcaatggataagaatgtaatcccaaatgtaaagacaaaaagcataagctgaagcttacccgagacacttgcacttctgattttggaggaagaagtggatttggcagtttttgcaggtattggatggacaagactggaggggttcaatgaattgaagcaggagagagccaggtgggagaggagaaaggaccaattgaataatcatagcagtagacttggacctgttctcccaattataaaattacttctttattttgagactataggcacaaaagctggatgcttaaggaaattgtgtgccaccatgagttacgaacaggctgggctgaataacattttagaaaaaaaaacactcaaataaatcaacatgatagttcaaaataatatatacatgtctctttctacctatatatataaaagaatggtgcttcatgtttctctggcgacaatttgttatggtctggcatttcattagtttaatttgcacagaacatcttttaaaatactacctgaatcagtttatcctttttcttcaagtctacaagaaggcaaatacaaaaacaattattacagatacatctatattctatactatcctgtacattttgaaatggagcagaagaatccaatggtgtgtcttgatttccatggtaacaatttacagtgtaagaaagtaaataggtaagttaccatatgtaaagttattgttgagcgctggatatatacgtgcttctatcctgcttcagttttataattaccagaaaatagaaaaacaatgtacagttggcctgtagagcatcatttaacaacaaatttatatcttgcctccaagttaaacaaaattccacaattgcagggatctttgtttcagctcaatggaagacctgactgacagctgaattctccacaggacttgttgcattttttttaattgataatcaaatttgacaggatttcattagctgtctgttgacctaggctgtcatttatcttcatccaaatcagaccgaaaaaatgtttaattttgtactgccagaaacagcaatcatcacagcaatgaaacaactgtagacatctcaccatttacataatcagaatctgaataaatttgaagcggttgcaccaagatggaaatggttccttcagttttaatgtttgcctgctagttcaaaagatttcgctgcagaaacatgaatgcattttgttttttgctttgacaacctaattcatctgttgatcctctgtagcaaagcatcgaccagacctgaaattgtactgcctaatgtatgagtatcggaccactaacaataacttctttcatcagggtcagtatgttcccccaattaagctaactcccacatcttttatcaatccttttgcttccatatctgaccgcagtcgctcgtaatcactccatttgcccgctgaagcatagatgttagagagcatgacataagatcttggatttccatggtcagattcagtgagtattttcccaacagattcaccaagtttagaatttccatgaaacctacaggctccaagcaatgactcaagcaaacttttggatggtctgaatggcatcgttgtaacaatatcatatgcttcatccaagtgtccagttcggcccaatagatctaccatgcatgcataatgctccattcttggtgtgatgccatgatctgcaagcattgatctgaataatgttcttccttgctcgagaaatccacttcgactgcaggctgataaaacactaacaaaagttatgtcatcaggcttgattcctgaagataccatcatcaagaaaaggtcaagggcagacccaccatccccatgcatactgtaggcattaatcattgtactccaagagacagaatctttttccatcgagatatcaaagatcttccttgcaaaagatatgcttccgcaccttgaatgcatatctataagagcattgagaacaataatggttccatcaaagcccttctgcagtgcaattgctgtgacacattctgccaaatctgcctttccaagctgtgaacatgctgagataagtgccaacatggttactgcatcagttttaacatttaggaactgtatttgcctgaagtaatcaaatgcaactccagcctgcttacattgcacacaagcagataggatggcattccacactatgttgtttctttcacctaccaaacaaaaaaggttgtggcaatattctaaattgttgaacctactatacatacaaatggctgatgtaaagagagatgtttctagcttggagaaatttcgaattgcatagctgtgaacagtcttcccttgcaactggctatgacagataggcaataaattcagcagcgtaataatatttggcttctgatcattcttgatcatatgatagaataaaggtaggatctcctcaaataagttgtttttgcggtatcctgtcatcagagcattgtaagagattgtgttcactgaagacaagctatcaaagagtttctcaccagcctgaataataccacagttggtgtacatagtaatgagggcatttgcaacagaaacatccaagttgcatccacttctaattgctaaagaatgaacagattctccaactgtaatatcctcaatggcagaaaggctgctgataagcgcaatcagcgttactagatcaaactgcatgtctgccaggcgcatttggcagaaaaatcttaaacaagccactgaatctccattttcagcaaaaccagatattatagtgttccaagatattaatgtccgcacttccattgtatgaaataacttacaacaaattgagagctgcccgcagtcggcatacatagcaaggagtgcattcatcacactctcattcaattcaagtctgcttctgacagcatatgcatgtatagacttcccgacatgtaaatcttctgtgtgtctgcatttcgagatcacactaatgacagttaatgcatctggatcaactccttcaatttgcatccttcgtactgaacccataaccatgttccatttgttattcacaaggtacccagaaattaaggagttccacaagagttgactcttctcggtaacactagagaaaagaaacacagctgaatccaagtccccaagcttcgaatacatggaaaccagagcactgacaacagaaacctgttctgcaagaccaaacttgataaccataccatgcacagactcaccatggtttataccaaagaaattactgcaacatggaaggatagataccactgtaaccagattaggcactagccctttgcaacgcatcaatctgaataccccaaatgctttctcccaagctccatgctgcatgcacactgagatcatggaattgcaagataccaaattatccaccaaactctgatgaaagagtgacaaggatgatgaaagatgaccgaacgcggcatacattgagatgaaagcaggtgtaagggactcgtcaccaaggacaccagatttcagtgcgaatgcgtgcaacggatcaccggcatcccttactcctaaaccactgaccatactgacaatgccaacaagagagctagcattgggcctgaaaccatcctgctgcatctgcttcaaagcctcagcagcttccagtaaacagccattcagagaatagccagaaatcatcgcgttccaggagatcaggtctctactcttcatgccatcaaagactctcctcgacagatcaacctgaccagacttagcatacatgtcaagcagcgcagtctgcactccgacatttccaccatgccctgtccgcacaacccggcagtgcacctccttccccagccggaggcaagaaacggcggcgcaagccctgatgaccggcgggaacgtgaagttgtcggacccaaaggcgcacacctcccggtagaggccaagaagctcccggtggaacccatggtccgagaagcaccggacggcaatgttcaggtcatacacctcggcgcggccgcggtagaacccggcgaacaccgccgccgccgaagcgggcttaccgaagaagaggtacctctcgacggcgcccgcgacgacggaggcgtcctcccggagcgcgcccgtgacggcgagccgcgcgtggagcttgctgaggcatttcgccgaacgggtggcgcgcaagagcctggagacagcgtcgactcgtggtggaatcgcgcttgatggagtcgaggaggcgtccggggattctgcgtgggttcgcttggatttggatggggaacttgagtttttgatgaatcttgagaatctgtggtggcgcgtggtcatgctacgaaaccatggaggaggagcaacttctcctcggttttgttggctttggtagcgactagcaactgccgagtgccgatctggctctagcgtaagggggaatttaattatttatctcttttagtttgacaattatctaaattaggacaatggtagactaatgcgcgggcatgtatatcataggctatatttgagaaacttaccaggaatatcaaccatacatgccaaacttcagaaatatgttttcttcataaatttatttgccgactttgcctaaataacttttgttaggtatctgttacctttatactagtatgtaatatttaatgcatccgtattcgtaattattattttcttcttcaccatttaaaatagaggtgaaaacatgtgtaacaaattaagaattaagttcaaattaaaagtaatgtgtttttttagttgaatgttttggggctcttttaataaatcttgaaaaactattattgttaataatgtaccatcaagctagccctccttttaattggttcatattaaggcaatttgttatatatttttacatatggataataaagatagaatagatacctgatttttcttgcgggagcatgtatgtacaacataaggaggggaggagttttgtttcctttgagatagatccaatagttggggtctttaattataaattttgtagtaaataatctagtgatgtacgtaaaatattagctatatgatttagcttatcacaaaatatattttctatacagaggaggggagcttgcataaggggggaagatgtagcgtacgtacgtgcacaatatgtaaacgatatggacagcccctatgggccttagggacttttacttttttgttagcaaatctaatggtacaaagtgggtccactgagtttaaagtaaaattaatggtcagatatgtttctttttctaagaattattagaaattcctctaatttattaaagcgccacgtggccacttaggatcgtttgtaggagtcacacgtgatagtttgattgtgtttgtagaaagtttaatgagcttttaataatatataatagataatagatagatgtccgatccattgtctctattttcttaagaaacctcgcgaaacttttactactgacaaatatatattatttgtaccatcgtcattgctttaattggttcatatgcatataatttgttatatgcttgcatgtgaattagtaaatatggaaaaaaatatatttaccctacacattgtttctctatgatacgtgagacccgtacagtagttaaaagaaaaagtatagtcaatctaaataatattaatactcatacatagtaaattatatcagaaaatctaaatggatttttaagttggttatgcatgcataggaacaatgaacatgctcgaggcctattaatattcatatataggagtattcacatttttaatggtctacgcatataaaatagacaaatttatctttatatctaaaagatatagaagccatagtaatattcatttgtttcttttacctttaagtccattaaatgataatgtatactatattttagaattcttatatacaaatcagccgatttaatttatctcgtcagttgagcatatttcaaaagacataattaattagatattgttgcatccaactaaaggtacaatattttttttataatttatgttattgatagttaaatctgttcttttcacttacatattatatatctaatttttctatgcatgcttgcaaagtaatgtatgatgatgcagtatatgttgtatgacaatttggatgacatttaaagtgtaggagtatggacctagataaattaaatttatgcataaatttattttcatagtttcatttataatttttattttaacaccatcgatctaatatagctatgcagttttatggaataacttaagatcacataatacatgtttattttatttttaatgtttcattgtgaccactagataaattattcttttatatgaaaattattcacggtgtatgtttcttaaatggtttaagatgataaaatatatgtacatttttttatatatcttattgttgtttgattggtatgtaaaagatacattggcctttctacattcaccttcctgggtagattattcgattctagctatattcatgtcatattaatcaatatatatcaatcaacaattacataatttatatgtgtagtaccctgataattttttgctaggatcgcaattaaaagaaagggtatatatccaagtgatgccctgataattcttttcttgggtttgctatatccaggtgacgtattataatttttgtacagaaacatatgataacatctaaataaataatagtttaaacaaattaaaaattggatattggatatatactcgagagttatgaatatctatctaattattattatttttatatatttggttgatagctaaaaaatagaagagtcatttatacaattatggtaatttattatgtccattgtagcttaggagtatttgtagaggtgtactgcaggtaaaagttctactcatattgacgtgaacaaacttcaaatatctgtttttttacttacggtagtttttaatcttacattgtacttatatataatttacgatgcacatttttccttctaattaaaccttcgcggcaagcagggggtagaaacggagggagtaccgacggtttctcggaggaaggcggcggtttgtgcgcacaggaggcgggggaccggggataatgcagggtgcgcgggctcacgttcataggcgcgcggggcgaggttggctggtgattggtgaagtgcgatcagaagcgaggatcgatggagtgtagcgtcgcctgaacagaacacccacgatcgcgagcgctgcagggtagaacagtcactcacatcatcatctacaattctgctttctttattagtgtttcgattagtatatgtgattacattgcatcacttgttcacctgagcttctattgtatcgcgggcagacgagcagtgcattgtcacatctaatttcctttccttctttcttttccgtgtgtaggtgtgatgtgcacacatgatgacacacatattatttgatttgtactatggttactaaaaacatgttctaattaaatatcattgtccagcatcgtttttatgttttctcgatgataatgacatttcgatatcgagctgataaaatagaagatagcaccaataattccatacataagaaatatcgctaagtacagttcaatagttcagcacgatgattagtgtaagtaatacttatttggatggggcactagctgggatttgattttcagattaaaccggtctgttttgttgtggagtttttgagattaatccaaataccggactggaatcacctgccaattctaatcacattgtctgctcattcctctcacgtacctgacactatgtttttcttctgggttaacctgatctgtcatctgtttttgtccccttcttgcacatgcagagaactgcagcaataagagtaagagctgatgatgcaggcaagctagctagctagaaaagacaagggagcttgcggaaaaataagaaaaaaaaaatgtcagatgagagaacaagcaacatatttgagcagagttttcattcagcatggcctgcaacttcagccatttggtgtagcagtgcgacacataatgagatgatagacgtgcagcacacataaggaaactaaattgacaagccaaatgtcacaattacgtttacatagatggacccatctgtccatataccagattatccggacgaaagccacacaccacacacagtgatacaaatccaaatcgatacacttgaatgcacacaaagcaatcagcatgcataatgcaggtgcgtgcggcgcacacacgcacatggtttattcgaagaagcaaacacacacacacacacactcaggcgacgatgagtaatatatcatcaaaggatataatggagacattaatttcctcgatcagctactgctgatcctccttcttcgagaaatagctggcacagccacgccgaagccatgattcatcgccatgttcctcttttagtgcttgatcctgacgctgcggcttcttaggtgtaagaacaggtttatttttatgtgctctgatgtctttcttcacctgcttagggacattgtcacagtccagatcaagctccttcaatttctcaacattgccaatgccagggagaggctccaactcagcgaaggacggccgtgaccagatgatcttctcaaggttaggagcagatcccttgttgaagatgattttttctagagaggcgctccggtgcactatacttgcaatattctactccaaatagaattaatctcggccgtttatcttaaaggatagattagtaatctgttaatataaattaagggtaattttggaatgggatgatttatctgtcttatcaggtacggcggaatcggtggctcgacgcaaagcatctcgcccccccccctcccccccacgcatcaccacgatttctgcttctcctcccggcaggcggcggcgctgcccccgaccccccgacgcaggcaccgcatcaccgcatctctcccgagcccccgacggatcactgcatcaccgcggtttccgctagtcctcccggcaggcggcggcgctggtcgcgccacccccgagcccccggcgcggtatttgttttcccatatattttctgtaattagtttttgccaaactgattgaaaggttctttagcggttgacaaggtattccgaggccttcttgcaggtatatgaacctcaactctattgttttgtaacaaaaacaaatcattcaattgcgactgtagtttatgatagagtatctgcagagttttccactgatactgaacaatggcactgcataaattgtttctttatgttatttcgaaagtttgcaagttatttcctcgttaatttcagtattttgaaatttgaatggctgggttatcagatcagtatctgatccgatgtgttcaatttgcattgttgtatttaagccgaaagagaccccctcgctgctggagcaaacaactgccggcaggaaggtgtggcaatatctggcttgctagatggaactggagattatgaaggtgacagggtgcttgttggagatgtgccgtgggggtgtgttttccgttctaccttgcattttcagagagtagtaaacaaagttactacatttattggatactgattacgcaaacagcaatgcttaaaaatgatatgcagtctattgccttaatttttttttcagttttattgattatcaaatgattatcaaactgagaaaaaataattctaccatcaaactagaccatgcctcctatttgataggagcaattttacggttcttaaggagataccatgaggtatcattttttttattgtaaatttggtacctcttggtatcactaaattttttttatctcatagtaccttctcaaaaggattgtagaattgcttatctgatagtctgaaactccaaatcatgtaggatgtttgtttcttcagttaagagactgagagtactgaagacatctgacctatcttcatctgttagtacctctttccaccttccttctattacatcaaactcacggtaatctccgcattattctgaaatttcttcatgccatataatccatgcagcttataacttctggacggaaaagaacagcagctgagtgttgaccttcttttttcgatctgctttaacactttcagtgacctgctgttcagaagaatatgatcctctgagcttgtatcatcgtctctttctctcaatgtcttgctgtgctgagcttgtaaccagccattagagaagacagtccgagattagggcaaaaggatagctccatccaagagacgaaggccattcagtgagacattgcacacaaataaccaataaggttattgtggctcacaaactttgtatcttttgtattaatggcattgtttttttattggattaatggcagcaatagctattatatatagtgtgcaaacaggaggatttttaaccttccccaatacttttttttttcggatcagctctgaaaatacatataggccacttgagcactgtattctcttatcaagccatgctataatttacagaagtttgtgagaagaactcaggagattttgcattttatgatcttgcaggactagttgtcatggacacccttttttaccttatccatcaataatattctcagtcgtgcaaatgccttcttttactttcctaaccttctgtatacatgcatagcagggtcaggttcttagtgagagatggtgaaacagaagggagctccagtagcatgttttggttcttgaagccttgcacatttctagtggagtaacagcaaaataaccagaagctttgaagaactgcactttatgtagtcaggatacattatttcattctattcgattccaatttggccaattcatatgatcgacatttttgtcaggaaataaacagcaagcaatgtatagttacttaccaaagtgatacatgtttgagagattctttccatatgttgggttcaagatatagaaaaatattgttcttatgtggcttaattattttgtatgagatactgccattttctttgaaaaaaccatggttttccggtcgatcgctcctaaaatatagcggaacggtttattttgtacaaataaaaaattaaatccgtgactaggtcaattttaaaaaaaccattgtttttttgtcgatcgcttctagaatatagcggaacggtttattttggacaaataaaaaattaagtccgcgactaggtcgattttaaaaaaccatagttttccggtcgatcgctcctacataatagcggaacggtttattttggacaaataaaaaactaagtcctcgaccgagacgattctaaaaaaccattgtttctggtcaattactcctagaatatagaggaacggtttattttggataaataaaaaattaagtccatgactgggttggtttttaaaaaacaattgtttccggtcgatcgctcttagaatatagcggaatggtttattttggacaaataaaaaattaagtctgtgaccgtctgaaccgggtcgatcttaaaaatccatggatttccggtcgatcgctcctagaatatggcggaatggtttattttggataaataaataattaagtccgcgacctggtcgattttaaaaaaccattgttttacagtcgatcgctcatagaatatagcggaacggtttattttgtacaaataaaaaattaagtccgcgaccatccggaccaggtcgattttaaaaaaccaaggttttccgatcgatcgctcctagaatatagcggaacaatttattttggacaaataaaatattaagtcagcgaccgggtcgattttaaaaaaccatggttttccggttgattactcctagaatatatcataacggtttcttttggacaaataaaaatttaagtacgcgaccgggttgattttagaaaaccatagttttctggtaaatcgctcatagaatatagcggaacactttattttggaaaaataaaaaattaagtccgaaaagggtagattttaaaaaaccatggttttgcggtcgatatctcctagaatatagctgaacggtttcttttggacaaataaaaaattaagtacgcgacccggtcgattttaaaaaccatggttttccggtcgatcgctcatagaatatagcggaacggtttattttagacaaataaaaaattaagtccgcgaccgggtcaatttttaaaaaccatggttttccggttgatcgctcatagaatatagcggaatggtttattttgaacaaataaaaaattaagtccgtgaccggaacaattttaaaaaaccatggttttctggtcgattgctcataaattatagcggaacggtttatttctcacaaataaaaaaataagtccgcgaccgtccggactgggtcgattttaaaaaaccattgttttccgatcgatcgctcctagaatatggcaaaacggtttattttgtacaaatacaaatcaagtccacgaccgtccggacgggtcgatttttaaaaagacacgcatggttgtccgacgtcggttgtaaattcttgtcggaatctatccccattttttatcccgtacttggagataatatatcccatattattctgctctattattctgttttgatcccctgttacttggagacaaggtttcttttttttttattactaccgatctcggcagattttttaatctattttctatttttcccgtatcgatccccaattttgccgctgttaatccgttctgatcccctgttatctctgttatcacgtacttggacggttagagagtgaacagttagataattacaaattacaataatacccctacgtgaattattatctttggacaaatatacccctctacatttctactcccataaaatttggtgggagtagaattagatctcaaacctacgattaaatacgatcaatggctcggattaatttctactacaagtagaaagcatcggagcgagactcttttttctatcttggagcaccggacagtaagaaggttgagctttggaaactcatctttcttgaaggtaagctcgctttcttcataagaattttcctagagcaccaggcagcaaatgttttgtttcttggctaggcgtccagcttcatctctgttcagtgaggtaacacagagaatcaccttttcaattttattagcattcttaagtagcgaaaggaggattgacttgtcacccttcacctcgatctccttcaattttgctcggctgccagacacagtaagctgggactcctttctagtcaacaacaagatgatcctctcaagctcaggaaccgctccattttcaatgatgatgtcgacaattttggagtcctcgaaaagaaaatacttgagttgctggaattctcccttcttgaatgtaatctttacctcagtatttatctgtggagctggtccttctgcagaaggtggaacttgtccatcagtacttgtgtgaggagctgctccatcttcagaaggtgaaacatgtacgtcattgtttttctgaggagcagccccatctttagaatgtgaaactggctcgttgctttcctgatgagctcctccatctccagacaacggaacacctccatggaaagaaaataatgatttgttgcctttcaactcgagctccttcaacattggaaggcgaccgaccccacgaagggacctaacattggtagaggacaagacgatcttctcaagctcaacagccgctccctcttcaaagatgatgtccgtcatgcacttcaggttatctccgtcgacaagtaagcatttgagatgttcaaacatttccttcttgaacgttaggctagggtcattgtatgcatcattgtcggagcctgacactgcgtaacttgggatggtcggcaagcatgtccagatttttctgtctcaacttggtgccactcaaagctaccttggtaagctcattgctaccttttgccaataatgagagaatccgtagatttgtggatccgttgatgcttacactctccagaagcttcggtggatgtatcaagcggttgtaaagttcatctgatagtatttttgaatcttttgaggtggtctcacttctggtgtcagttatagtgatcgaaatagattgaaggcactcattcaagtcaccaaccgcttgaaacaaattctggaggtgtctgtctttatctttgataaccacaccaagcttccttagctgccatagctttcttatgtctttcaattcatagccataccatgaagccgtgacattagacaacacctccatattttccattttctcaatcttggaaggaatccggacacaggaaaatgtcctattgtttgtgcccttgtcattaaagcttggacttggatcagtgtaaccagcgagcaagcgccttagctttaggagcaggacaagctttgtttccttctcaggaaccttagtttgccggatatccaatatctctaggtcatggaggttgttgatttcactgggtagatgggtgatatttgtcctcctcaggctcaaatacttgagaagtgctatgttgttgcagatggccttaaggtagctgcttttgtcaaaacattgacaaccttgcagatctagcaacttgagtagtgatagttgagatgaataattatgaagcttcttcacaaacatgtctatgctgtcagaggcacggagtcggagaccgctgaagacagagaagtggtgtgcccagtatgtgataagcgtgcatccaaaatgtgttgtttcttagcaatcttggtgataaacccatggataagatcaccaaccatgcagctcttgaactctcctttagcactaatatcacctggagaaacaagacaccggtcgatgagagcatcaaaacatcgctcggcatggcgaactgcggtaggccagtcttcctttgttattagtccttctgtaagccatcgtgctattaaggttgatcgcctaatgttggtgccttgagggaagattgctaagtatagcaagcaggtcttgtgttctctatgcagatctctgtaggagaacttgaatatcttcttggctttagtatccaacgagttttctgaaatctgtagtgtgtcacgtagcctgcctagttctttattgctcctgttgggattagcatacaaagcacgagcgaacatcttcatgcaaaattcatgtggatggcacttgtccaagatgtcgcggagaatctgggaattgttgttgtcatcttcattattcaccagttgttgtgtgagcttgagcacaatatcatggtagagtccaacaagagaatatgttataggctcacttggtgggtagcaaaactcactggccttctgggtgttctttgtggtcactatcacggcactgcccttggcgcacttcaacagttccaaagcattcatgatatcctcccacttaagttcatgtcttctgttttcatcctccacgataatgaataatgtgtctccatcttttaagtataaatttattctatctatcattcctttaattatcatctgctccttaattttgaggccaatttgtgtaatcttgttcttggcatcttggatggcactgacgacttgatcatggcctagtttttgttctctagggccatgggatttaatagcctgtatctcctcaaggatgtcttgtttgaccaggtggatgattcctttgatctgttccatgatttctttggtttgatcgtcgcccaatgtagcaggtgcagcacgtctgttagtactactactagtagcactagcagcagtagtagcttcctcgggattgctggtcaggaacacctcccacagaatagcttggtattgggtatcaagcagcttaattgttggggtcttcatatctccttccatgtgctgcttaaactctttggcagtgttgttgataagagtttgctcctccaatgctaacacatccttggcttgcttccatttttcctcacttagcaacgcaagatagagtacacataagggtttgtcagtttgaagaaccagggagcactcggtatctactgcttcttcagtcgtctttccaccgcctgttttttcttgggtctcggtgctcccacctctttgttcaactgtcttgcttccccctcccttttcctcactctttgtgaccccccctttttctccagctgtgtttcttcctcctcctgcgtttccttcaattgtcttgcttccaccatctgttccttcattcatgctgtcctcttcatatgtttgtcttgttttttcgctacctactgtttttacattgatcttactctccatatcttcaatcttgctaatgagatcttgaatccttctcggaacatgctcttcaaacttgttactgactattcttatcatctgttctctttgcctccaagctttgaaccgaacaatcccattatccacatagtttggatctttgttatccttctggattgtgcatacacgcaagatgtagcagaggacctcgttgggtcctagataatctgatgggtagtgtactgatgggaggttgatccgaaccgtgtgcttgaattgtacacccgctttggtcaaaccttcacttacaatgtcactagcggtgttgtccgatgccacaacagcgatggatcgtattgattccctcgactttctcacctccactcagctggctatcttgtccaggaagtagttatccagagtaggaggctccagatcttgttgctggtagtaagaagaagaagattccgccgccgctgccgccttttgctcaccagctctgtcctcatcatcgtcttgtgtggccggaagtgcggcaacagcttgagacgaggaggaagacgatgggcaccaccttccacgggatctccacgccatacctcatccgccgcttgtcgacgtcgctcgcccgctccttgagctcacacagtcgagcggccgctttgtgctgggcgaccttctccagcacgaaccagtaagcccaccagaagtagccacggaggccacccctggcgcggtggatcgccgggtcaccacgctggaggtagtggtcgatgcagttgctgtagtcgtgggcgaggtaccggacctgcttcatccacgtctgcacctgctcgtcgtgcgacccgtcgggaggcgccgtcctcgccaggtgctccagaaagctgttcatgctctccatctcctccttgatgaattccacgtcatgaccgacgcactgtagcagctaggcctcgttccggaggatgcccagcagcgagctcacggcgccagccgcgagctcagccattgcaacagcacagggcttgctgctgtgctgccgacgacgcgacctcgccgaacggtgtccacctagctaagcctcttagctttagttttagattagcaccttagcaagttgtactgggaccgagaatgaacgagctaggtgtctctccaatagtgcattggattattggtgtgtggttgattggataggtctcttctcttcaacaggcaaagcagctctagttcttcaagaaatacatgggaagagataatgcccggttttacgaactttctattcttctcttttcttctaggcaaggcaagcatatggttctattcattggaggattcttgaagtcattcataaggtcaggtgtcaggacgtactacatccaatgactttatcctttgctttgctttgcttgtctgttcttgcatcttttcaagcattggacaaaccacaaaatgaaggaaggtagtatgagatattagtccgactacagtgctctttaccggtagtattctacaactagtagaaacaatcttaaccgtctgtttataaggacgtattagtacttgggtaattcttccttaggggtaattttggttattgcttttttcctgtgtttcagtcttgtattcacgcatccttctagcgtcctctcgcattgccgttgccagctgatttcagtggcaacaccctgtcccgcgaccgccttgatcagtgggtgtttatccacacaagtcgctttcttttgttccctgccccatccgtggctcccttcattgccgtcatcactgtcgatgttcgattttcccatcggcaacctgattgttgtaccactcgccgccatcactttagttttacacaacctcctcatgtgcgaggtcgtgggagagtgctacgctcgggcacaggagcacagccgcgctggtgccggctccctagctctcttgcctgggcctggagtggaggtagaccacgagcacgccgccttcggatctcacccttcgtcatccagccgatccgctgtcgctgagaacgccacaccaaccacgtgactgatggcacgagcgcgccgcgttccactccttgattattgtgcatctgaggcgcaaatctaaaattttatccctccaagttttgtttttttctttactattatttcattagatgagggtattttttaccaggtctctacatccaactagatatatacaacatttttaaattgaaaggttagccactcaaataatccaatcatctatatattatatgtgatattcatattgtatagtatataaatgataattaattaaggtgttattatacggaaatatcacgcattgggaactcaggacccaatctgtgacaagtatatcctttcatgtttctattttcattaattaaggtggtagtataaataaatcttacccctggataaaaagtcataaatgatttagattaactagcattggtggcccgtgtagattgcgtggctagtatcgttaattttttttcttattaatagcttaaatattttcacatttgattattaaaatattttaaaatggcaacataattctaaagtatgtactaacttgaccaaaccaactaatgcaagatattcatattttatagtatatagatgatagttattaattatttttcagtttcaaattttagttatttctaaattatattggctcagtgaactggtgggtgttccgaggttgaagcgggtctgcattctctctgcaattctagagacttcgtgttttggtggagtcggagttgctgcatcggattcaaccgatgagctgggcaatgataacacccaacatcgggttcaacgcctgtgggtgccgtttccccttggaggtgttgctttcttgtctctctccttgggtgaaatcccagcccagttatgggcaggcattggcatcggccttgtcgttacttcccttcctggaggcctcgccttgatgttcttgctccttccttggtcgccatcgggttttcatagttgttttgccacaggtttttgttttttcttctgtgtagggtttcgccggcttccccttagtaaaccgtacagttgtatggtttttgggtctggttttatttataaatagggcaaactctcttcttcttaatatattggtagatctcctaccgttgttcagttaaaaaaaaattatgtatgcaatactctagactcctcttttaatattccttttttaaaaaaaaattgtattcccattatttatgaactttattcctatacgaactatagacttcgcttccaatatttctttttcttaatttcaagttttagttattcgtaaattgtatttctgcaaatctgtgaccacctggactcatgtacgtggtcatagtataacccaagtcccaacatgtctcgaattaattcacgttgttgatgtacggtaggatggttgtccgcatacgcatagctacattggcatactttttacatatgtaggttatgatttatctttatttcattagtagcagcagcagtagtagtagtttgagtgtttgaccgatgcatgcaatgtggtggtcagtcagcatatatattgatgtgggcgatggtatcacgatccttcgataagaggataagtcgattggatggagagacgttggtgatctgactacaactatccatggatgttgcgccttagcaatcgttacaccaactccagaggcggtcgttcgacggatgcatgatcagcctaaccacgaggatatttgttcctgcaagcaatcgagaactagcaagaacaagataaacaagcaactcattttgcgaatcaagatgatgtattgaatcaatagaagtatcacaagtggggttccataacaagcaaaccggcgatctaaccaatcacgggattatttggcaaagtagcgatgctagactttgatctaagctaaacccaattgtttttgcggcggctaaaggtataagaagagggggagaacgaccacatgggtgttggggtcatactctaaccctagagcgcgcccctaatgggcccaacttgatacacaatccattggacccaaatgaggtgacgcaacaccgtggatagaaaagtactcggtagtaaaacgataattgcgggcgctccaaaacatatatggacatgatgctggatccatttaaaagtagacttgataagcttttcatgaaatacttgtacgtccaaatcggagtttgcatgaagtcatggcggccatcaaaatttggtgcagtcttgtagtccaccccgcacgaatcctctccccattggattctctccagcattcctgagtaaaacaagagtgcacgcgtctccaggatataaacaagcggaatatgaactcaagaattcactcacctgatagttgagttaacgtgcacgagcgcaggaaataggatcatgaaattgtacttgtggagacgtggatgtatcgatggtgttgatgtcctcatcatatatatcgctggctgtcagttgaacaatcgaagcagcaacggcatgtcgaaaatgctcatactcggatgcccgatccacgcccaaaatattagacgcattttcccaaccacccgtgactccctctctccctctctctttctcgcaccttcccctctcccttcctccgcctcctcggcttcccacctgtccagcgcccacctccctttctcctcctacacctccgccaccaccaccaccaccgtcctcgccttctccgaggagtgggagaggaggtgcgggcactggcccgcgggttctcgccgtacgtggaggcgacggcgagattctcgcctcgtccgtccatcccgtcgttctggtgttctctaccgctgcggtgtgcgtgttgagggagatttgaggaggtggcgtgttggtttggcacgaatcggccgagtggagcgcctgccacgatgctgctattggtggctgcttcattgagtgtttcctgcttagcctgaaaccgttccagttcaagcctgaaccctgctcgcgcggcagctgcacaggtcgatcggcggccacgcgcacagcgtctcgaggaacattgacgccatttctctgggctgctgccatctactcctgcactgccgccatcggaggagagggaagaaggcagatctgactggtattttcgtgattttttttatgtttcagccaatgtaactcgatgtttctttgtgttgcatcaaattgttgtagtgggatttcttatggtctttaaattttttttttgatccttgtggatttgttgatgtttcaatatttgaaatttgatgtttcctgtttcagaacaaagtgttttagttcatgattcaaccgtgtttcatcatttaaatagtctgaaacatgtgttaagctagtggtgaaacaatttacttacaagtactgaaacaacgcccgatttgtaggtgcttctgcaccctgtacatggacatcaaaacccttcattttatgtattcgtatcggactcataatgcccccttctgtgcggatgtgtatgaatgaagaaacaaaaataacaaattttatctacactgtatggttactattcactatctgattttgttatttttctttctctagttatagatcaaatttagttctgtatgtttgtgtatagatcataacaaccaatgttacttaattttttcaataactatttgagtcgcatgtaaatgatgggtgccatggtacctaggtgtagaaaatccttatgcatatgggcacgcacgataagattgcgcacgcacgtgcaatggtagtgattttaaattcagaagaacggcacctaagcttacgttaatttactagctatatccaatggctgggaggacttggaggcagaactcaatcttcttcacagccgcgtctagaatctgcgcagctggctgcaacggaggacgacagccgccggcgccggaggacgtcgacgaggcttgcggcgacgacggggatggcatcctgctcaggtgataccactggctgtaccagacgacccagcgggcgtcccggagagcgtccctgaggtcatccctcagcagcggccacgacgtctccgcgtcccgcatcagccgcgacgccgcgtgcgggcgctccatgaggtcggccacctgctgcgcgagctgcgccacgcggagcacctcctccacgttgtgcgtcgcgtgccacgccccctgcacggtcacccgcgcgtcttccacaatccccctcacgacatggccccagtcgccaccactgtcagtgcttgcaccttgctgccatggcgccaccatggttggaggaggagcatgagcatctcggtaatctcggtggatgttgttgctggcgacgtggttgtagtggtggtattgctgtaggatcgaggagatccgatggtcgagggcgtggagctcgccgggcttcttgtccggcgatctcgatatgtcgtcgagggcacctcttaggcctgacagcaccccggccatcgccgggtccggcggtgtcgacggcgtcttcttatcctccaatagcttgagtatttttttggtattttcggcctgttccctcagcaggcgaaccttctccctctcgcgcttacctgtccccgccatccccttgatttgagctccaagcgcgacaacggccacccacagagccatcgtctccaccgctggcatcttgatcaatcttgcgggttcttggtgcacccgaactcgtatgcagcgtatagtccagtgttgatgtgggtcttcctgtaaatcagtggattaattaggtcatttgcaacaacaaattaattaacacatgcccggtgccccccactccatgtacgcacagtagccccctcacatgttctttcaacagcgaaatggattctactcccccaagagagaagatctccccacgtacacctttgttttctctctatttcaagataatttattgtgaaaaaaatcaatgtattgcatagcatgatatatatcactataccaaaaacataatcgacaaatataaatcaacagaaaaaagttcggctgtactgtttatatattagatttgtattattttcttatgtcctaatgtgtaagttgcgtttaaattttgattttgtggaaacgtatatttatattgttcaaagatattttaataaccatttaggtgacattttcttataaatatttgaatggtgtttaaataaatgaagaatattaccatatagtacgtcaggagactcgtccaactgtggggatgtggggcagctgccctagcagcgatagttcagccaggggagcaaatggaggtgaggagtggggcccacgaggttggttggtaggacacacgtgggcttctgtatattttatttgagatagtagtatggatatttatatatatgtatttttatccttcgagaatatccgcttgttgcttacataccattaaatagttattaaaaatttgacaactaaattcatatgaaatatatcactccacaaaaatacaaaaaccaaattcgacttctataagttacaacaaaaagaataaattaaactgaaaattgttatcctgaattcgtagttatatttgttacaacttgtaaaagttagaattttaacttgcatgtttattgagtaatatatttcatattaatctagctcgctaatttctttaggtttttattattatttaggtcacagatacgaaacgaggggatgccccatcgaaggatataaacactttcccatagtagtaggatatggaatttattttatccctcaaggtgatatatatcttctcgctgcttgcaactgcatgccatcgatctaaatagctagttatcaacaaattttaaaaaaattgacagctagataagaggctgaacgatggggccacttaaggtgtgcgaaatctgcactatatatatttgactcagggtggttattcatctggttcatcaaattcaaaagattttgataccatggcagtgtatataccggaccaaaggaaaaatttagggaggagtcggaagaggttaaagtggaaaatgcgagaataaaagctttttctggtagtgggacttacgaaaataaaagccctacagcgccgaaaatattttttctagtagtgggaccttttcctctagagtgcagattgagaaatgaaaacaagcctgcgatttgagatcattatatttttttccgatcctcaggatgtatatataaagaagtatatgtatcttataattaatatttgtcagaatatatataagctctaccctataagtgtatatacctcctaagacaatacctacaactctaaaaaccattacaaagggtcaagaacatatttaaaaagataaattttcagttctattccaacctgtaaaattaattttgatatttccctccatgaaaaagtatatatcaagtacgggacctcttcatgctccattcatgcatcttgcttgatttctccctatagctataagctagtttgtgtttaccggctctccaagaataatgacttaacgtttattactccattaccatccggctgatcaccactaccaaattatagtttgcacaggcggacaaattcttaatgatatataaaaagaataattcgcgagataaattagtgcatactagctagtaacagtaaataattaagacatttaccgatggatccaatgttcgctgaactcgtagctaagctagctgctccttcccaagctagggtatcagtatcttcagtagtgagtagctagtgagagctctattgccttttgccttcttgcaagcatatacaggcactgaaggcgcttagctatttataatcaggcaaatttagtctcctaacgcgctagctcctacgcttaattaagtggccagctcgtaatataatcacagtgacgacgcgtctgcaagagacgacccaaaactgagtaaagaccaatgattaggacaaaggaacgagtctccaactcttctctcccctcttctccaatgaatccaaaataaccagacgtggtcacagtactggtcccggggctcggggccggtctggtttggttgaccggctgggtcttagcttcgagtcaacctaaaaaaacaagagtaaagttcatcaccgatctctaaacttgtaccgctgtgttatcccggttcctaaactcgcaaatcgaccgttctgattctcaaacttattcaactgtgtcatcccgatccctaaacttgcagatcactcatttaggtcctccaacttattctgttatgccaccccggcccctaaacagaacggtctaaaaactttatatattaaaaaataattcataactttttcatgtaaactctaataagacaaactttatatcaaaattgtagccctcggcgtgacctacaactttattatgtttttaatgcctatgaaaaaatgcatatagtgtgctattggtaaaacaggagcaaaggcaaaacaaaaaaaaaagatacgatgaatcatgatatggtattgcgagctaattatgtttttaatgcctatgaaaaaaaacaatatttacatatgatgttttcttgcaggtgttcctaccaattatggcaaatcacactggtacgttatcgttattaatgcaagatattagaaaatttaaatcctggactccatgcaatgggggcaaattggtacaatgcaaaggaggatactccctccgttttaaaat

SEQ ID NO: 29083 - DNA, 2084 bp, Oryza sativa
gtaaaaatatatgtgtacatgaaagtatatttaacaatgaatcaaatgatatgaaaagaataactaattacttaaattttttgaaaataagacgaatggtcaaacacgtactaaaaagtcaacggtgtcaaacattttaaaacggagggagtataaattaaaatccattgtaagttcatttttactttcattcctataataactgaatctgccctaacatgatagttttcagattaatggtgtggccaagtatattgtgtacaaggtgaaagaaaatggtacttccacatcttggactaacacaaatgttgctaattggccacggttcccaaagaatgtacctcaacaaagagacaggtgcaacatcatcaaccatatttcacacaataacttaattgttaactgattatatgctttgaagttcatagaaacttggaatggaaaatagttatccaacgaatacttcactatggtatattctgaaactactgacctatattaacactttcattttactgcatataacattaatttccttttgcttataggaatccaacgaagttttcagatttaaacatagttatttcagtccatgaagacataagacgtctagagtccgaacattctgaacttcatgcatcatttagtacatctgaagttaccaacgatatttaataaagaaataaatgcaacaacatatctgcatctaaatgtattgaaaactttcttttgagacatgtcattgaagctattcaattccgattgccccaactgtgtgaataatgtttcgctaatttcaatccatcctcagccatatattggggcataaaaatactaaccacccaatgaaggggagaactgtgcatgcatcgtacctattattcctcctaaaataatcgaattgtgtacttaattctatctgtagcaggagcaaaacattgaaaaaaaaacccacaaattgcaaggtaaaaaaccgaaaccttatgcatcagcaccgccctcgctctccatgctgcagcaacgccataaccttatgcggcaggtggcgttgaccaccaaacatcgactggccatggatttgtgtcaccgacctcccaacgaatcgccgacgtaaccatcgccaagctcccgacgttgaccaccaaacattgacttgccatagatttgggtcaccgagttcccgatgaggtaccgctgcaaccatcgccgagctcccggcgttgaccttcacccatcgaatggaatttgcgctgcaactaggatctaggcctaaccatgcgatggagatttacggttcgtttcgtattgccccttctctcactgcaatgccgcgtgcggtgagaaggaaaagaacgcaaaagagatgagagcgaaagagatgccgcgtgcgtaatgtggaagagaatgcgaaagtacaaaacaaccctcccacctaccgtaccgtctcaatcaggatctacggtcccacgtggtacagactattttcaactgttggatgttgccaaatcgacggtcccgatttagtactgcacaccctgaagtacagtaaaaaatctcttgatataaagtttgtctttatctatattaaaaatcatcggttcttttttttttttgaaaaaactacaggtattgggtacttaatggactggacggtccagtcgtttcggtataactgttttgttgtttattatcaacatgtgtctgtcagtaccggttcattaacatgaactagttttgagtatgactactgattcatgttaagaactggcagctgatacatatttcactctctgttctcaacaagaaccgatatggaacctaagtaatcttactgctggttcgtaatatgaattggcggtgatcggtgatgaattattgtgattcaaagtagtatcactgctctgatgaggcggtttctattatgctaattgtgtgtcctgcatggtgtttggttgtattctccttttcatatattaataggatttctatactcatacacacaaaaaaattgtaaaattgattaatatgctcctgagaaagcccggaaaaaggcttttatttgataagtatatatgtgactaaac

SEQ ID NO: 29084 - DNA, 1666 bp, Oryza sativa
ttcttctgatgatccaaatgcagaacaaccgttgactcgaatactgctcttatcgataatgctatcatctttggactgaccgtggcgtcgtccatgccgctgaatggatttcgcactagcatcttgttgatttcaaatgaaccctcatcctcaatgatttcgttcacctcgttctccaaaggtgcgtagagtggtatgtagaaggaatcgagcttttctttgtcaatgataccctacaaaagcgaattgattattcataaatatcctatcatgaggtaatatatatgtcaaaaacgaaaattcctttgtggttaaatagcaatatattgctactatagtaacccagcgcaaacaaatataagacaaagggcatgggaatctcagacgacttgatgtaacaaagtgaatgcaataaattaagcttccgttatcctaaaaaaaaaagagggcacggagaactaaacatgtgctcaccctggatgccatgtcattcaaagctactgctaccacctgccatgcctgattggatcttgagatagggttttccgagcaccggccatacaaggagataaccatccggcctcccgtcaccaattcttgagccctcaagctcaagaactgcgtgaaatccttcctgaactggcgagcataagcatccctaacagctgcacgcctcgacaccctaagatgttcaaccatgtcatacataggtattttaccctccttaagatcatctggagcctgttttttttttaattacaaaatgcacatcttaaggtccattatactcatcggtagaatgactttcatagaacaatttaatcaagaattatagttacctttgatagccagtgcaagctgttcgacgagcaaacaaaatgcagagagccacaggggaatagcctctcgtagaatgacccaggtatcattccgattccggtgatcacaaccggatcgtctagatcgccatggctgtgcttcagagtcgccaagcttttcgcgacggagttaaaatcgttgctgggcaaatcgttcaagaagacgcacacctctggcggtggctgttgctgctgtgcacagtgatggtggatagcatcgagagcagccgagacaagcgttagcgcgttcgggcctgaggagcagcccaagtctgcaatcgccatgctctttgggagaatggtgctcgtcggttcgcataagcctgtgatggcctcatttatcagcatcttcattctatcttgctctgttttctgcataaaatcaattgtttagataggtttgttgtgaagtttattactccctccgtcctaaaatataaacaattttatcatagtgacaagtcaaatatttataattttggctattgaaaaatataaaaaagatcaatcatgtaaaattgatgttactagtagatttataattaaacaaactatcacaatatgcaactctttttatttaaaacatcttatttttatagatatcgttggtcaaagtagaatctcgaataccgtgtcaaaatctaaaagtgcttatattttaggacgaatggaatatttaattatttgggaaaagtctgaattttatccttagagcaggtacaatagtaggctataagccagctataaccacatatcgagaaaaaaagataagagagagaagaaagcgg

SEQ ID NO: 29085 - DNA, 27333 bp, Oryza sativa
  unsure (1)..(27333): unsure at all n locations
cccttagacctgaaagcctgatatctttcacccttaactattaatatcggacgaattaccccccgtaactcaatccggggtggttttggtactacgtggcagtccgatcagtatttttttttgctaaaaaagggtgggaccatatgtcatattctctccctcaccccttacccctctctctttttgggaagtttattatttaattttgtacaatattaccaggttcatatactacttctgtcatgagatctattccaaactataattatattgtcttccaatttttgcagaaataaataataaagctagattaaaatttagtactatttccgtcataaaataagtgtagttatgggtttctgtgtccaatgtttgaccgcccgtcttatttaaaaaaaaatgattagtattttttgttgttattagatgataaaatatgaatagtactttatgtatgactatttttttaaaaaatattttataaaattttcaaataagacagttggtcaaatgttgcacagagaccgaccactaaagcactctccatggatacatatgatctatgaaaaagtccaaatacactctaaaatttggatgaagttatatttatcagacatatgagtcccaaaacatcctctaaaatttatgaactttataatacaagtgtgtcccaatataagtgcagttgtgggtttctacgtccaacgtttgaccgctcgtcttatttgaaaaaaaataaaaaaaaaggagtgttttgggactcttatgtgcctgataaattgtgtcaagatacacctctctctttcctctattttaatgtgggtgggtcctattatgattataaggggtgttttatattttgcgataattttctttagttgatatgattaatgtgtgccccacactttgtacccccatattaatgtgtgctcttacatataacgtacttatattgtcatgcttattattatgttgttattcctttgtaaatgagaacgagcaagtggataaaaataatgatttaaaaggatattttaaaacacacacacatatatgtacaatctatatgacacgtgatgatcagacttgttaacgtatatgtagctagattagataaaaaaacactttacaaaacaacctaggagattatatggatgaactattttaatattcaaggtgctagatgaacttccaatcaaaatttagagtgtatttggactgtttcatatgatttacatgaatccaagcttcaaactattgaaaatttgattagatgtgcttctacaaagagatgtttttgtgaccagaggaactgttgtacaatgggagtttacgacttgattcgtaatgttaagtaccaaagttaaggtatgttttttttagaaaaacatataatatcattgtggtatgaagttagttgaatataaacattataataaaattgtagagcccaactagcattttatagttcaccacttctttttatttaggatcgtaaatattatgatatattttagtggtaccaattttaaattttcttcgtaccttccaatagagatgagctttatgtgaatgttacagatctgaacgatgtttttgtttgaagttatctaacactactctagaaacaacgagtacccctatataagtttgtaggcagacataagtgatcgcggctaaaaaaaagtcgacctgcattttcgtatatgacttcttaacaggtcgaagtttcatattagaagagtcaaagtaaaagcatgtgtgttatgaagtaatcagtggggtaagctggctacacgtggacgaaaaagtcttcgggcctaattaatcatactggcatttcaactatgaaaataaatgtgcgatttgtgtctttcatatatatacactaatacataccctgcaggatcaagatacagatttttcttatttttctggagcgaaaaaaaaaatcaaacttcgggatagcaatagctgccagttttcgtgacttgaacggatggtccctgacagcgtcggctatacagccgcaataatacaattacagtatccctgcttgttatattaattagcgcaggttaaaaaccggccgttatagcaaagttttgaactggcacgttcggaacatatattctcggttgggctactccactagcacgatttccgaacagcacaaacggttgtgtttaatttttaaaaaataggaaaaactttttttaaaattcaaataaaatactttttttaacttttgttaagtttataaaagtgaaatataatactcaactaattatgtggtaatgatttttcacacgcagaaaagggtcaccaaccccacccatttcgaattgagacttagaggtagtatgaatttaaaaaaacgcatagaacttttgtgagatattacatgattacatcatgatagttcactagtgtaaatccatacaacatttgttgtgctttctcttcgaacatatatatatatacatatatatatatatatatgtatatatatatatgtgtatatatatatatatatatgtgtatatatatatatatatgtgtatatatatatatatgtatatatatatatgtatatatatatgtatatatatatatatgtatatatatatatgtatatatgtgtatatatatatgtagcaaacatgcacatcaatagttgagttaaatttaggtggacatattattttctataatttttattcatatatctatggctacaataagttatacaacagatagacattcatacacatatacactaaggcatgttcagattatagccaaaataaaccttaccaaattttggcaataccaaaattttagcaagttgataatattgctaaaattttgacaggatttcttctgtatttgtcaaaggttggcaacaaactaaacgtagacatatttttgataactataccaataaatgatatggttgaaaatggcatcaatctgaataacacctaatttggtacaagcagcatagattcctaattatattaaaataagaaaatgacaaactattcttgctactgttgttattataactattggtttccaaggacaatacaataaaataaacaaaccaaataagatcaatatttaagaaaaaaataacaggagaaatatgtgagaaaaagaacagaaatttagaatcacacgtagaaaaacgccagcagtttataaaaccactgtagctatcggttatacaatagcggagctaacgaggatatatcattagcaccaaaccagcacatataggggatcaggggtgcacctatttttcacacttcaattcctgcaacttatatgatttttcacacaatatacgcacatatatacagttgacaagaatcaaaactaggacctctctctcagaacaaagcctctttaatatcttactacctagcaaacacttgttttcttaattagtggcaaatactattatttagaaaatccggttgtatttcttggtgcacaggaaatttacaactgataaaaatacagaaacatccaagaagaccccaagtgtactcaccacatttggccagacttttgaagcaatttctgtcatatttcagttcttttagcataagaatcaactgtcgtcaacttaactatgtattaaataccggatttttcaaaactaaaaaagataagaacaggaaagcaggggcttcgattacttttcaattatccaattaataatcaaaacacgatcatttcatgcagatcagaaagaacttatacaattcaactaacatctcctcatcacagaaatatgtacaactgtacgtactgtgactcagaaatcagccaaagcctatcgccaacgaacatatatatatatatatatatatatatatatataacacacacacacatacctgaactgtggagttgcgagcatagctagtttcgccatgccctgcattcatatggagaatttctttggtggtcatggcgcagttgcactaatatctgaatgtgtttgctacgatatatgatgtctgagttacctatttatagccttacaagtcgcccattgtgtggtctttattgtcagctgacctttgatgtcagaaatataaaacaatgattttcttttactaccgacagatatatttgttgcttaaaattaatttgtacaataaactgtccaatcattcattaatatttctgacaaccatgcccatgtgcggctaagtttgtacaataatccgcttactaataatttgtacaaaataagcgtggacttgtgagcatattatgtaatcgctccgttttacaatataaattattccagtattttctacatttatattaatattaatgaatctggataggaaatgttagaatgacttgcattgtgaaatggatcctgttgtccgataaacttatttgtttttagccgtgtacatctacatgtgaataaatgtagaataaaagaggcgggattttgattctactaaaattctagctgagatggatatggatgctatcatatatatactcatattttatctagagagtctcttcatgcatggactggttggagtagcatgcatgctatttaactgaattgactctagctaagatggatcactgagagtgctcaactcagtaaatctatcgtatacaatttaactatgataggttagtgagtatatatgctgacatatgtcagttaatgttacttttgtggtgcagaaaaaatgccgaatatttgccctactgccgcgcgccccttaattgggtacgttctcaagtcgttgcccaccgtgtccgtacatgacagtagcacataaaactgtgctacagagaaataaatcagtaattaacacatgtttcgtcttcttatttaagtaaggtgaataaattaacgagtgcagacacaatcacatgcacatgttgtgttacaaaagcaactcataacacataatatatatatatatatatatatatatatatatatatatatatatatatatatatatatatatatatatatatatatatatatgagagttgaacaaatatgttacaggcaaattgcttaaccatgtgacaatcagactatatgtggtcttccgcattagtctttgatgtgaatttcgtgttcaattagctaaataccagtgtttttgctacggataaatgtaaattatatgcatgcacttgtctatataaataaacttgattttagagatgattagataatcacaaattaaaatgtagaatcactagctatcttctaataatatggaagtatacataaggagatgtcggtaagaaaaatataaaaatagagttcgtaggtggtagagtcagtttccaccaccactgccttattttagagggtaaattaggacccacatgagtcaatgacatatgggttaggatggcatatttcaaattttgcaaaattataatggcatggttccaattttccctattttgggtagaagagtatatatagatatagatattgatagattaatattatggctattttcgcaaagtgaaaatcatggggatagtgcgaaattatcaaaacatattattgatattgactaatgttttcctgtatattggagaatcgttgctgaaagtaaacaaaaatatatatttaaaaaaatagaaaagctgaaacagagaaaatatatgtggagcaccttttctatatttttatgtcaagatttatttcagatgatagaagttgcatgaaaaggttatgacctagagttatagcagattctttatataagcaattcagattggttcccattacacattcaaatcatccaacttttgcagtcattatattgatatatatcatcgaagttaggatgctcttgtaaccactcacattttacaacaagaaaaggtaacttcatgttggtttattaatattttgtttattatttagatatattggaacgtattaattataggtaaaacagctcttcgatccattgccacctagcaaccaacatatttattattttttaacctttttaatttttattttaaaaatctcatccagaactaattttcagattgcaatctttccgccatgccagtcagattggcatgacaaaacaatgttcacacatcgatttgattggcacaaaattatttgtcacgtcggcctagttagcatgatagcattggctgtgtttagattggcctaaagtttagaatttggttgaaattggagacgatgtgactgaaaagttatgtgtgtatgaaatgtttgatgtgatggaaagttgtaagtttggaaaaaaaactttagaactaaacacacctattgttttgttcactacgagtggtatgatagtgttgttttgtcacgtcatatgcgatggcagggctaaaattttcgaattttcgattaagtgtgggaggttaatttttaaaattaaaaaatagaaatgtttaaaaaatattaaagattccacactcttatatactacatcaattctctgtaaaaaaaaatgaattgattttttatgagatggagggagtagcgagtcagtagtcacaatatggacggtctatgtacaggccgagctggcgtgataagatcactcgtaattaattctacaaacccaactgtgcctacacacaacttaattctgaactacctcccgttccagaaagaaccgatttgtagaggggatcgtttgtagcagaaagaatcgatttctgcacgcaaaccttcactgagttgcaggtgagaaaatccacttgttcacgcaaaagcttctctcctctctcttttctctcgcctagtgtagtactctctatctcgttcaaaagatgctctctgccctgtcagaagagagtacttgtgcaaaaaagaaggtatttttattggagagatagaatgaatcgtgtacttgtatgagggtattatggtagtatttggtaatagctgctaaaaatgcatcgggcatcttgtcacttttggatagagggagtaatcatcacgacaattgtactagtccaaccaaaacggttgactcactcacagtaacgcagccatggtctaactgccgccgtccacaaatataaatactttttttcttttccaaataacggatgaagaaaaataaaatcattatatttttatagataatgataagaaaaataagataattatatctcttactaaagggaggattgagaagggagaaggttgttgggggtaagattgagtgaaaaaaatattatcaatacatattataaactaaaaattaattaaacatttttacgtaccactcctaagccatgtggcattgtaataaattttaaaaatataaaaatagtaaaaaactaaaacatctatctactgattttaattaaatggtgggttaaataaaaaaatcacctctccaaccaatatattagaactataataatcaagataaaatttactatagaacacctaaaaaagtgtaattagttgtgagacattgtaaaaaagtgaatttactcgagcacactttaaaagtatgttaatttgctataggatactggacgtattagaatataatatccaatcaattagtaagagagaatccgtataaaatgaccgttttgtccatacctttgtcttccttctagtcttcgcccgacactgcacgctgctattccaagatgagaacctcgtgtgcatgtatcacaacatggggcagggtgccttcagccgcccaacgtggttgacgatggacgcacggaagctcatcgatatgcccgtcgctggggtgagcctcggcgcgcgtgggtggcatgcggttcgtggcgtgcaagccggagagcggcgtggtcacgcgaatggaggcgctcgcgacggtcaacacaccatgcctatgtgcgtgacgacgagcggcgcgcggggtgtgcctcgattgcgcggagccgtgcgggtgcacggggcagctcgccgacgcatttgatttggtttggtgtttattcttcttttgagaagcatcggaagaacactataaaaagagagaagaagataatggcaaaattgtcatttgatgtggtttctctcttattaattgggtgaatattatactttaatgcgtccggtgtcttacagctaattacctcacttttagagtgttcttaggcaaattaacgtttctatgatgtcccacaataaattatatttttttctgtcatgtagtaaattttgctaataattagtgccgactaatcgctctcatctgaccttattacatacgtacctacctaaaaaaggcattaccgacctccctccttgttaggatctatttattttaaaccttttctagttttatctaaaaaaaataaactcccacaaaactatttccaaatatcaacctttcagccacactcagtacaatattgccacaacagtcttactagattatcatggtgtccgggctccaagctataaaacacacaaattctctcaaatttttaaaaattttcaaattatgagtatatatctaggtatatgaatttgattcatacaaatacctaacaacaaaacaactcaaactcaactttatttcacaattcattattacatatctaacgaattatatgtttggatgttatatacctagaatcaaaatctaacaaaaaaaaaagttcaaactcagttcaaacttgtttgaacttgttagtaaagaagttaatgttcatatctaaacatttaaaaaaatttcatactcattcaaattgggtatatactcaatttgaatcttggagcccatactccatgtagcactagttaatttacttttatatatatatatatatatatatatatatatatatatgtgtgtgtgtgtgtgtgtgtgtgtgtgtgaatgaatctagatgtatatgtgtgcttagattcatatatatatatataaatgtgagcaatgcaacaaactcttataacctgaaacggagggagtatatatatttggtcacgttctgactggcgtgacattgtggtttcgccatgccatcctgattggttagcgtggcagtattgttttatcacgtcggaagagatatcatggtcaaaaggttcggattttattattgaaaagattaaaaacaaataaaaacttctctcgacctgtgcttgtatataaatgtgcttacttaaaaaaacaaagccccataaaatatatcatgccaagtgctatcttatataataaaagtattcactaaatgtcaagaaaagaaaattaacaacatagattatataaaaatgcaaagttaattcattcatttttcaaggtaattccgctccaactctattgccatcttcctttagtgagaaaaataatcttaaatattaaaatctatcactattgaattttcacttaaaccgatatacccactatttatttacgtacatgcaacaacactaccaaccaccccaccccaccccaccccaccccccaaaaaaaagaaaagcctacttcctctcctctgtgttttatatggaagttgactagatgaaaataatagtatatatgtaaataaataatattatgaaaccatatatataatttctaatttgtttgaatagcaatatttgtcactgctaaaaagacaatttaagacgcatattaactttaactttatttagaaaatgtggcacacgggcatgatatattagaaaattacaatctagattactcttatcatatactcccgccgtgtgagaatgtaagaacctactcgatagaacatattctattactacgaatctagacagttcctatatctagattcgcaatgtactatgatgctttccatacaggttcttatatttatattctcagatggaaggagtattaatctacaaacacgcatagctaaattagattcataatacacgaaaaaaatatcaaatcaacgtaacatttaaattatatatccaatatatgcccactaattcatcaaatgaatcaagtaatagatacggatttttctttaccaattatttttggcgagacaatcaaaaaatctggtgacactttaacaataattctcaatgaggtgcaagctaccactaatggagaaaccatctttggtcggtcgacccaaatccacactagttccggttttccattaaaaaccgggacaaaaaacgatttttagtcccggtttataagaacaacaggactagatgatctttattcccggttggtgttgggactaaagatgaagatcatctttagtcccggttggttccatgtcagaccgtgtcaggcgcctaggatctttagtcccggtttgtaacaccaaccgggactaaagatctaactttagtcccgattggtgttactaaccggaaataaaaatcaacacgtagtatataatccctattacttatcctcttttctcttccacacaacaaactctctctctatctctttttttcctctctaactccctatctctttctcctgccttatctctttccttttcggattgagcgagagcgagagcgggccggccgggcggcagctggcacggcggcgcggagggccgcgcggcggcctacgcgagcggtgcggcggcgcgaagggccgcgcggcggagggccgtgcggcggtggccggccggcgcggagaggaggcggcagcgaccggccggcgcctctgtgggttttcttttttagaatttgtgatttattgcatgatcctgtgatgtatttgatttgtgtgtgatgtgaacttgtgatgtatttgcgatgaattttgtagaacttgtgatgtaatttgatttgtgtgtaattgcttttaggatttgtgatgtatttgatttgtgtgtataagtaactttaagatttgtgatgtggatttgggatgttactttgatttgggatttgggatttaattcggggacatacatacgacttgattcgggagaaaataaaaaagaaaaaaaagaagaaaaaagaaaaaaagaagaaaggggaccatctggactgttgttatcccctctttagtcccggttggtaacaccaacctggatagttggtgttaccaatcgggactaaatatcgatctttagtcccggttatatcacccaggactaaagataacgatcttttcccggattcgtagtcccggttggataaccgggactaaagggggttacgaaccggaaggaaagaaggtttctccaccagtgtaatgtaggtggcctttgggtgtgtctatatggatcctgagagcaaggataatggtagagctcagttactactattaccctatcttaaagccaacacatatatacatacgtacatacgtacgtacatacatacacacacataattaaatatatatataatagataagctataaggttagcttcaatttttttacataaaaaaagggtgggtttcaatttttcttctcctcacactttttctcacttatacatttgattaatgtatttgtcttgagctagctcttacatgagagagctaacactcttaattttttcttacctctcagctccacataaccttacagtaaactttatagctcattactatctttgcttgagtgagtgtggaaatgctgatctcgaggagcatggtgatggtgaagccggcaggcatgcgcttaatttgctggtcggtaggggcacatcaacgtccatatatgctggagcccgggcttcatggcatcggaaaaagtgaggcaagccaatgctgagaccttgtttggtgtatctatgaggagcttgagcaggtatacgagggcagggagtgtgtcttgcacaaaccaaggcttcatgacattgtagaaaagaaaaggcctgggcaattgctgtcggattttactgggtgcaggatcatacttaatctcaatatggtgttatcctattaggtgaaaatagtggtatttccataatatttttttatagatttacacagaagtgagagaacgaagctttccatgtatggagtggatatgattttttttatcgtatacttaattggtacctagttcacttttggtgatatagatgcaatttcaccacaacaataataagtaccacttccatcccatgatataaggtgccctgattctttaaaaaagtaaatattgtatatattttttactaactgttaaactgatgatgtatacattgatgacttattattagattcgttttcgaaactaattttagaacatgttacattcatatttgttgctaatatattataaaagaaatgcatggtcaaaaaagtaaagcgttggaaaaactttatattttaagacgagtggagtagtggtggtcagtggtggtttatgattgtatctcatagaattaaatttgtaaatatatattttttttcaatattttgcgtttatatacatatatgcaaaacatttgcacagatatatctccttcgtacgatgtgaacgcgggacggaggtggtgccgcgcttccattatgcgggaccggtggtcgcgcagcacggccgtgcggcaccgctcgctcccctagccggggagagcggcagcgtggtagaggcagctgcccacggtcgaggcgaccgcctccgcggcgggcgggactggatcggtcgcgtgggaccgtgccggtcgagcaacacgtcccgtcccgtcccgcgtgtgcgtgtgtcgcggttgacgtgccatgcaagcatcacctatcgagcacgcatgtaggcagttgatccagtcaaatcccacaatacataggcactagattaggggtgtgttcggcacctccattttccaacccaatctctctcattttccactcagcacacttttcaaacggctaaacggtgtgttttttaaaaaaagtttctgtgaaagttgcttaaaaaattcaaattaatctatttttttaaaaaattagctcatgcttaattaatcacgcgctaatggactgctccgtttccgcgcattcctagttgggaacctataccagcgaacacaccctaggcccccctnnntcccaccctaaaatttttcaccatgttacatcaaacgtttgaacaccttcataaagtattaaatataagctaaaaaaacaactaattgcacagattgtgactaatttgcgagacaaatcttttaaatctaattactccatgatttaataatgtggtactatagtaaatatttgctaatgacggattaattaggcttaataaatcccctaagctagtgcctatgtattgtggggtttgactggatcaactgcctgcatgcgaccatgcgtgcttgacaggtgatgcttgcatggcgcgcgtcgaccgcgacacgcgcacgcgggggacgggacgggacgggacagtgctgcgcgccatggtgccgcgcgaccggatcggtccagcgcatcggcgccgtgcgaccgcctcagcaccgcgtgcagccgtcctccaccacgctgccgctctcccgggctgcgggagcgagcagtgccgcgacagccggtcccgcagaatggaagcgcgacaacgcctcggtcccgcgttcccattatacggaggaggtatatttgtgcaaatgttttacatacatgtatataaacgcaaaatattgaaaaacaatgtatattttcaaatttaattcgtatctcatatgcattcttgttatttgatagataaatatatgtcgggagtagacactactacaaaacattaaatagataccaacactatatagatgtcggtcactataggtgttggatgtgataaaaccagcacctatagtgcctttcctacccatgcgcccgccagcccgccaaaatgcttaggaactagcatctttatctcttaataggtgccttcttttttttcaaaaaaggcagccttttgcccctgtcagagatagatgccggttttaatttaaatccgacatcttttagttggcgtgggacccacccaataaccagcatctctatgctaaaaggaatagctgccggtttttttaaaaacaacacctacaatatattatatattatagctaccggtttttttaaaaaactgacacctcgtaaaaccgagctgagccgcatgctctatctcgcacggttttttttaagccgttcttatcctcccataccaccgacgcgctctctctctcgcgcaccgatgctctctcttccttctctttcttctcctcttctcgtcctcctcatctcttgcatgcgtcggcggtggcccagcagtggaggcggcagcggcgcctcccctctgccagatccgctgtaatgccccgattttcgttcgggattaaaaatcaattaataatgcatttctagaaattaaattaaaagttaaatcaatttaatcaagtgaaattatagaggaagttaaaatttcctttaaaaaaatcattggccgggaatattttgcaatattctttgtgccctaaaatactctccggatttttccgcaaattttcggagctcaagaaataattttgaagtcacagagatcatttaaccaattaaataaaaaggaaacaaatttaattctccttccttccccttcctccctttcgggctcggcccaaattcctccccctccttcctctcccgcggcccgcgcgcctcctccctctcttgggccggctcccttctcccttggcccgctcgcaaaagtctgttttgcgtccctccttctctcccttcgccgacaggtgggaccggcggtcccacccgtcagctcctcctcctatctcttgccggccaaccccaaccgccattgctgcccatgtcgccgcaaaatccggcgccctcccacacccgagctcgcatccaacgacgtgggcacaaaaaccggcgccggccaagccgccaccaccccacatcggcccccacttccccggcggttgccgccccgactccgcctctcctgggctcggtccggcctcccctcccctataaaaacattccccgcacctccctctcccttttcccctctctcctgagccctcccgtgcacgaaaaccaccccgccaccgtcgcacctcccgccgccgctcgccgacgaccctccagccggtcgccacagccgctcccaccaccgccgttccgcgcgaccgccaccagcggcttcgccgcgtcgtgccgcaccccggcatccgctccatttcccctccccgcctccgaagcaccgtcgccacgcgcactacctccttccaccgccgccgccgactccagccaccgcttggcgccgctcctagccaccccaagtcgcgctgtcgccgccgctcgcttcgcagcgccgaggagcacctcggccgccgcttttcatggccgggattccaccggaacacggttcccctcgcgccggtgcgcatccgccgcctgttctcacctccgaccagcgattcatgccgctgggagccctctctccccctcctaacctctcccccatcctccccaggtccttctagccgccgtccgccggttcccgttcgcggaacgccgtcgggccgccgttccgccttcgtcccagggagcgccgacgccgagctcccccgcctttccccgcccctcgtcgccgccctcggtgagcactcctcctcccttccctctttctccccttggccggccgcctcccgtgctttcgcacgccgtgccgccgccaccggtggccgcccagcccgtgtgccgccgtcgctttggtcccggccgccgccgccgccagccttgtgtgcgcgctggctaggccgcgccgcccggccatccccaaccgtccgatcggccatggccgatctgggccgtccaacccgtggaccggcggtggaccgtccttgtggtcccggtccatgttggaccgccacctcgtctcgctgacgtgtggggcccgcctgtcggcgccggcgccccttgctgacgtcagcgaatgccttttcctttgagataataattgataattgcgcaataaatcattcataattatagaaatccatttaaatggctcaatacttctaaaattcatatctaattcattcgaactccgaattgggccattcaaattgcaaaattcatctaaaattgagttatacatgtttgtttactttttatgtactgtttctttggttttgttagggtttttcctcattttgcgtgccagcgtgtagaatccgtcgtttcggaagatcgcggtcgcgaggaaaagagtttagaaaatccaagtgaagaagcaaggcaagtcacacattccccttgagcatgttgttcccaatttacaaatgttttaccgtttgcaaataaatatgcatgttttggtaattacatgggatcagggtttacctatctgctcgcttgtgccatgtttacttgatatctgtcctttgtcaaccatgggtaataaatcgcctagcttgtgttactttgatgacctagctagaactatatgcttagccatgcttaattaccactagctcagtcgatgggataattgcagtattagacattctagtatcttgttgagctgcgtgcttgagacatctggccatatttcatggtcgtaattatctaactaaaatgcgactgaatggtgggctgtgggtgcatggttttgctggtcgcacccatggcaattaaggaccggttcacgggaaaccctggaagacttacagtgcttaccacaaacgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccatttgaggggtggggatgaaaccttagcgtggtgtagatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtcttacccctaataaatcgactcaatgtactgtagttcaggtgggttggttgggcctgttcaacgtggtgtagcgttgatcagtggagatttaatattaccttaattactcaactgttttactgttttgctcaataaaatgatttacaaccgcatttatgcaaatagccacaaaccgtccttgtatccccttacacgtctgcatcgttggtgtggcttgctgagtacggtggttgtacttagccttgctattattcctccttttcagaagtgtagtgcttctgagctgaagacgaagttggaagaccaaggctcagaccccagttgagttttgcctgtggagtggagctgaagccccgctaggatcgcctttttcgctgctgctgcttttgtttcggtgtgaggactaagtgcctcttctgtaagtattttacgctttatttacgtttggaactgtatattacttgtcgttttgtgtaccgtggctggtcctggacatggatttaatacacaaaatagtctgaaaatttgggctaaatttctgggcgtgacatccgctaggcaggggaggtggcagaggtggcggcgcgaggtacggcggtgccctccgctagatctggccggaggcagaggtgggcagtggcgggaggtgtggcggcgtctcccctctgccagatccgatcgggaggggaggtgccggcttggcgcatggtgcagcggcagcaggaggcaggtcgtggtgggagggaaggccgcggtggtggcttcggacggaggaggcggcgacaaaagaatcgggtaacatgttcttcttttttctcatgtgttcttgttcttgttcatgcaaaagaatcgagttgaaggaattgagattttgttcttgttcttgttcttgttcttgtttaggtgaattgggtgtgttcttgttcatgtgaattggtcggggtgaaagggagctgctcggctcgatgcattagctcggatgcattgagcctgctttttttttattcgtgaaaccttaaagatgctggttctaaaacataaaaaaccgacatctttacccatatagatgcttgttctaaaatcggcaccgatgaccaaagttatccgtatcgcctccatggtgctgtttggacaaataggcacctaagggggttcccaaacggcaccgattagctatcctagtgagagtgagtatttcatatatagatccaagggcatgacctattttatagcacaactcttttttttcaacgattatagtgaggtaattagtaatgaaaatttatgaactactttacagtctatatcattatactccctccgtttaatattataagtcgtttgttttttctcctcgtcaaacttcttttaagtttgaacaaatttttggaaaaatatagttgtattttcaacgcaaaacaaattattatcaaaatatattcaatgttagattaatgaaactaattcgatattttagatgttatttttttatatacttgttgaaacttaataaagtttgattatgacttataatatgaaatggagggtgtacaaaataaaaagatgaccgttcattcgtgtgaggtttcttcctactagttaattaaatgatggaagcaggttgggtgatataaatgtgcagttctctataattgaaacaaattgcaaatgcctcatatattaatggagcgaggaaattaatatatctttgtcgtcggaatgaaaagaatattggaaaattggtttgacatttaatggtctcatacaactagtgaagagaaccagtacaaacaaccaatctggaccagctgctgtgccatcgtatgcactgtctaaatgacttttcacacagcaaaagccatcaatatgtgtaccctcttccaaccggcgacgattagttggttcctattgttttctatgcacagtagacatattcatgttcgtcgcttgtgttgtgtgttccttcacggctgctccctttcatagacactattgctatgtagagatggggagaaatgaccatcacaatgaacacggtcaccgttaatcggtgatacgtcgctgtcaaggacgacggtcggaaggcacatggaatacctagctgttgttaactaatccctcgatctaaaaatatttgtcgccgttgacttttttttaaatgtttgaccgtttattttatttaaaaaatttaagtaattattaattcttttcctatcatttgattcattgttaaatatacttttatgtatatttaaaaatatatatgttttaaatatatattaaaaatatatatttttaatatatatttttaaaaatttttaaaaacggtcaaacatgcttaaaaatatcaacggcgtcaaacatctagagaaaaaggattacttattatatatgtggcgagaaactaaattgcaattcacactactacacaaatatatatgttttctgcatgaacacccctagtgacgctgatcctggctgtgcccgacgggtgttggtgtcgccgctgctggctccaccggcggcttggcctccagtgcagcgacctgagcctatggatgcaagcgcggcgggcaagtggatttttttagcaatagtgttttttatctcacttctaatttattttttcttctaaattatataatatcatgtgagaaataaactagtaagcgggtttttgtgcgggctgagccacgatacccccgacctcctcatggagcttctttatcccagcatccaagaatccaactttacatccccttgagcgaacccaggatgttgttgatgttgctggtgagatcaagcacccgttgattcgagctcaccgtctcttcctccaccgccaccattcttttttgagattcggcgccgatttaattattgcatgccattttctacaggatccgaactctctaatactaaattgtcacgaactcgcaacaatcacacggcgtcacaccaacgtgagcttgagatcacaagggattttggggatttggggaagaataacgttgtcacgagacacgcgcacacacagatcatgaaggaggtagttagttatgagttctcttcatttatgcctccctcactgataggtgggtccttcaatacaggcctgcacgccacatacgcaaatgcaaccgccagtccagcacgggactcttaccacatccacgtacacggcccacaacaggcccacacaaacacacaatgcagcccagcggcctagaacgctaatatcgctccatatctctacgactcatgatccgagctctttgttgttatcaactactcggccgccagtgcatggctgtcccccactcgagagagggatagatttggttggctctacgagggagtagtctgccgaggtttgcagaggtttttttttttttaagtaaagtatacgggcggtccttaaatttgtaggggtatatcatctaggtccataaactctcaaaatgtatatccaagtctcagaacttgtcatagtgtgtcatctaggtcccaaattgtcataaccccttcgggatcctacgtggcgttgatgtggcataccacatggacatgacgtggcatcattttgactgacaaatgggacccatttaaagtttttccattttctttttttcttctctttttttcctttcttctcctttatctgtaacccaagcagaagaatagaaaaaaagaatgagaagaaaaaaagaaacaaagaaaaaaaaaggacacgtcacatccatatggcatgccgtatcagcgccacctaggatcctagagggaatgtgtcgatttgggacctagatgatacactttgacaagttttaggacctggatatgcattttaagagtttagggacctatatgacacaaccctacaagtttaaggaccgccaatgcacctaactgttttttttttacctgatggtccacttattttgcttcgcggtagtggactggccattctgatgcttcagtggttcattttggtgccttcaattggaaaagaataaatgcttctaagttaggggtgtttagatctatgtgtgtaaagttttggcgtgtcacatcagatattatataggacgtctgttgaaattataagcacataatgatttaatttattcaataaataaatcatgacattgcagatgtaaactagactgaacgcatcattatatctacacatgtaaactaagcagtaaaacatgaatagatcaaatatgcgcaacacacgcgagcgaagaggaaggcgagccgtcgcggacgaacagggagcagtcgcgtgaagcgcttcccaaaaaccttattgccgctttctcccggtgcagtacgtagaaggcagaggttccggagacctgctttcccgatcgccggtgcacgccggcgagcgggatgaagtagtctacgagcgacggcgcagtatagtgtaggaggcaaaccctagattgatttcgtgcgtgttgcgtgaaggcggcggctcggtttatatagagataggtcgcctgatcagggcgcccgcgtaaaccgaaccggataagtcgcgcgtaaccaatctggactccacgccgttttcacgcaccggatttttcgaaatgtttccaaaacaaaacaaatccgaatttcccgtagcaaaaaaaaaactgcaaaaggaagctgcatctgcgcaagggtgaggagccaattttgcggaccattcgacgcgtacgtcgtgcacgcgcgctgcctgccctgcactgccaggccaggcgagcgagcgcgcgtgtttcccctcttctctccaccacgcatgtttcaaatggctaggagggcatcctcccttttaagaggtccccctctcctagaataagcaaggtggtactaaactccacatgcatgccatcccatgaggtgggcttttgtgattttccaaagaattaatcttcgaatgcaccttagcccatctattaattccaacaatcccccacaaaatcttaaaatcccactgagatttgccttttccaatgtactgtttatataccagcggttcgatggagtccgattaaggttgaacatccacctagaacgctaagctacacttactcacaacttgaacaatggactacgccttgaattgcaagtcttgcgcaagcaagtttcactcagagtcttatctggtactagaccctccgtagactacccctcgggtggagcgtataagtcatactcctaggtcttagtaagcttcttaaaagattcacccaaaatctccatagactgtgaccaacagtcaagcttacaaaggtgagttctttcaagaatactctgcaggacaacatcttcgctaattaaagccaacagaactcattaaggcatagccaacctgccttgcagctcacaagagtacatgcatcttcacttagagagggtatagattggtactctcctctagtttactaatagtgtgttcttcccaagttctaattcacgggatctccgatcacatagactgggttaccaccatagtataactcacatgggtctcaaacccatctccttcgatgcattgtctatcacatttcgtgatagtcccttcgtgaagggatctgccaggtttctagctgtttggatgtaatccaacgttataactccggagtttctcaatttcctgacagacttcaatcgtcttttcacatgtctagacgatttcatattatccttagaactattcactttgacaattaccgtttgattgtcacaattcataaggatagccggcaccggtttttctacaataggcagatccattaatagatcacgtagccattctgcctcaacagtagcagtatccagtgctgtcagttctgcttccatggttgacctcgtcaaaatggtctgtttgcaagacctccatgaaacagcaccaccacccagtgtgaagacatatccactagtggctttgatctcatccacgtcagagatctagttagaatcactataaccctccagtaccgcaggatacccagtatagtgaagccccgattccatagtacctttcagataacacattactcgctcaagcgcacgccagtgatcatcttccggattagtggtaaaccgactcaacttgctcacagcaaaggagatatcaggcctagttgcactagccaggtacatcagcgagccaatgatttgggagtattctagttgattcctagcaattttcttgttcttgcgaatcaacaagctaggatcataaggtgttggagaaggcttactatcaatgtagcaaaaacgattcaagatcttctccacataatgggactgcaagagcgtaatcccattctcacctctaattagcttaatgttttagataacatcagctactcccaaatccttcatatcaaaattttaagacaagaatgatttaacctcatttgtcacctaaggtttgtcccaaatatcagtatgtcaacaacatacaagcacagaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcatcatccagctctccattaagaaaagctgtcttaacgtccatttgatgaacgagaagaccatgtgaggctgctaggaaaagtagcacacgaattgtggtcaatctagcaacaggtgagtaagtttcaaagaaatcttcgccttctttctgaatatagcctttagcaacaagccgagccttgtacttttcaatagtaccgtcaggcctaagcttcttcttgaacacccacttgcaccccacaggtttacacccatatggtcgctcagtcacctcccaagtcccgttagcgataatggaatccatttcactacagacaacctccttctagttgtctgcatcaggagatgcatatgcttctgaaattgacttaggagtgtcatccacgaggtacacagtgaaatcatcaccaaaggacttagccgtcctttgtctcttactccttcgaggagcttcactgacatcctcctcagtgacatgttcatgtgtatgttcagtttgttctggtggtgtgattgaattgggaattacttcagagggttggctcgaactactatgtgtatccttcattgggaaaaagctctcaaagaaggtagcatcacgagactccataattgtaccaacatgcatgtcaggtacctcagatttaattattaaaaatctataggcaatgctatgatgagcatatcccagaaagacagtccacagtcttaggtcccagtttgcgcttcttcgttattggtacattgactttcgccaagcactcccatgtgcgcaaataagaaagtgatggttttctcccaatccatatctcatatggtgttctgtccttatttctattaggaactctgtttaacacatgattcgaggtcaacaatgcctccccccaccatgccttaggtagtcccgtggtgtccaacatggcattcaccaagtcagtcagtgtgcggttcttcctttcagcaatcccattagactcgagagaataggaaggcgtcctctcatgtatgatgccatgtttctcacagaataagtcaaactcgtttgagaaaaactctccaccacgatcagacctaagcctttttatctttctatcaagttgattttcaacttctgcattataaattttaaaatagtctagagcctcgtctttcgttttcaacaagtacacatagcaaaatctagtagcatcatcaatcagcgtcatgaaatatcattttccacccttcgtcaacaccccattcatttcacaaagatctgaatgtaggagttctagtggtgccaagtttctctcctcggcagccttgtgaggcttgcgagattgcttcgattgcatacaactatggcacttagaacctttgacaatggaaaacttaggaattaaatacatgctggaaaaccgagacatcaagccaaaattaatatgacataaacgtgagtgccaaacattagcctcatcatccacactgccacaaatatggttcacagacttattgcagaaatcagaaagggaaaagcggaacaggcctccgcactcataacctttaccaataaaatatccatgtttagacatgactactttattagactcaaaaaccaacttaaatctgtctctattcagacgggagccactaacaagattcctgtcgatagaagggacatgctgcacgttctttcccgaagtaaacttcagatctaccgtgccaacaccatggacagaagcatgtgacccattccccattaggacagtggaaccccgtgcgacctgataagaagaaaacaatgagatgtcagcacaaacatgtacattggccccagtatcaacccaccaattagtagactgattaactgaaaaaacagttggtaaattaccatacccgcttccatctccagtgttgccaatggtcgcattagcagacttagaagtctgccctacaggtgcctttatccccttacgctgtggacacttcctagccagatgaccaggttgcccacacaccaggttgagctttgtatttccccttgctcttgttctgggccttgtgcacaacattggcactggaccgcccaccatcgcccttagacgcggcgtctttttcccgagctttctcctcaacatcaagagacgctatcaacccctccacggagtattcctgtttcttgtgtttgagtgcagtaccgaaacttttccatgatggaggtactttcgcaataatgcaaccggccacaaatttgtcgggtaagacacatttaaggagttcgagttcattagccatggtttgtatctcatgagcctgttcgactacagaacggttgtcagccatcttgtagtcatgaaactgctccatgatatacagatcattgctagcaacggtagcaccgaatttagtattcagtgcatcccacaactccttagcgtcggtcatatgcatatacacctcgaccagacgatcgccaacaacgctaagaatgcatcccacaaagagagtagtggcttcctcgaattgcttctgctgatcaacagtaagaattccttcaggtttgccagtactcacccagaagcatttcatagccgtcaaccacagagtgaccctgatctgccatctcttaaagtgcacaccggtgaatttatccggcctcagtgcatcggcaaaaccagccatagtaaaatcacagcgccaacaataaggtttttggattgttgaaattataagcacataattatttaatttattccataaataaatcatgacattgcagatgtaaactagattgaacgcatcattagatccacacatgtaaactaagcagtaaaacatgaacagatcaaatatgcgcaacatgtcgaacatgtattgaggtggcggaaagaccggttgctcggcaggaactactcgcggttgctagcgtcgacgaaggcgcgaagcacgcgagcgaagaggaaggcgagccgtcgcggacgaacagggagcagtcgcgcgaagcgcttccctaaaaccttattgccgccttctcccggtgcaggacgtagaaggcagaggttccggagacctgctctcccgatcgccggtgcacgccggcgagcgggatgaagtagtctacgagcgaagacgcagtacagagtaggaggcaaatcctagattgatttcgcgtgtgttgcgtgaaggcgggggctcggtttatatagagataggtcgcctgatcagggcgcccgcgtaaaccgaactggataagtcgtgcgtaacctatccggactccacgccgttttcacgcaccggatttttcgaaatatttccaaaacaaaacaaatccgaacttcccgcagcaaaacaaaactgcaaaagaaggctgcatctacgcaagggtgaggagccaattttgcggaccattcgatgcgtacgtcgtgcacgtgcgccgcctgccctgccctgccaggccaggcgagcgagcgcgcatgtgtttcccctcttctctccaccacacatgcttcaagtggctaggtgggcatcctccctattaaggaggtccccctcttctagaataagcaaggtggtactaaaactccacatgcatgccatccca

SEQ ID NO: 29086 - DNA, 15163 bp, Oryza sativa
atcatagatcgattgtacatctcagatctatgcaatgaatcataaattgtaatagaagaaattatacatctctcaaatcacaaattaaaaaaaagggccggcagcatgtcacgggtgccgcgcgctgccccgccggccgccgccgacgtgcgccgccgcgtcgcgcgcagcccctgccgcctgccgccgcgcgggtcgcggccccgccgcccgccgacgccggccctcggatgtgaggagtagaggggaggaggagaaagggaaggagggggaagagaggagatgaagtagctagatctctgatctgggagataggaggagaatatgaggtgggagataggaggagaatatgaggaggaagctggtctgggacttaaccgattagacgtggaagagaaatatttactcccagttggagtttttaaccaggactaaagatagatctttagtcccggttgatggttggtgtaaagatcctcggccttagtgttaccaaccggcactaaagtggtaatctttagtaccaaccgggactaaagatcctcggcctcccgacatgcctctgacaggccacgaaccggggctaccaaccgggactaaagatcaaaatttttataaccgggacaaaaaacaatctttagtcccggttctttttggatccgggactattgtggaatttgtcagaccgatcaaagatggtttctccaccagttttaaggctcagaagattcgtctcgcaaattagtctcaatctgtgcaattagttattttttagactatatttaatacttcatacaagtgttaaaactttgatgtgacaaggctggtgtaaaatttttgtgtgggatctaaacatggcctttcttccaaagttggttgtttgctttaaaggtagacggcatgctctctgttggtcctttaattggccggtttgcatttgtgctggctgatgtgtactgctcaaggtaatagttatatcctagtttggcctccgcaagctaatggaataatttactacttttgaaaataataacttttgcatattctgttgaatttttgttaaccctttattttgacgacatggctgaccattcattctttcaatatcgaatggattcttctttgaacaccatgaatgctctctgtcaaggaatttagcatggatgcaatgacaaggctgccgcaatacatcccattcccagctggcaaatttctctagaggagattggttggttacacctggtcataattatgccttcaagcatacatcattagtgtcactagagtcagcttaggggcttagggaagtgttatggtagatgtgactaccacatccaaatttatctattttattcactcataaggtaagaggtaactcatacaatgtatcacctgtagttcacaaatatcaatatatctaatactctcacacctttcttcttgaaaattgtgtggaggttgcctcttgatttaagggtggctcatcatctctctcctcacttctctcctccacctcatcactcaatccaatgtggcatttttagaggcaatatatggggcattatagtacttgcccttaaatatgatggcccatgattaaaaattatggtgtgattccctagttgatacggaggcttatatattattatgtactagaaaaaagcccgtgcgttataacgggaagtgtaaatacagaaaattgaggaaaaaataagaaagatttacattatgtatttttaagtaggtaggtgtataattaaattagtttacaagtaaagtagtgtgagaaataaaatggtatggttggatttagttttattaaattctacatgattaattacgctctttggaattttattagaattttctgagcttaattgttaattttgataatacaaatattattttagcaattatttaaataaaaatcatcctttctctctgggccattttcagcccattttattcttcagcccgcaaccgagccagaccactttcctctcttctcctcccctccacctcagtccgcaagaaagagttcggcccaacaggaagtctaatatgctccccgtactcctcctctccctaccgtgcgtggcccagcaattgtgcggctcggcgaggaggatggcccgacgcggatcgatttgtgccattcgtttcgatggacggcaaacgaacggctcagatcggttccgaattgatcaaaaccgacggggcaaaaaaaatccctaaacctaaatcattttcccctccccctcctctcaccgtaggccgcctttctctcccccaccggcggcgtccctcctctcccccccaccagcaatgcccctcctcccaccgcgagctgcccctcccccaccgcggcgccccttccctctccccatcggcggcgccgctcccactcactctccacccccactatcggctccttccctcctcgtcggggtgccgccactgcctcgctccttgccagatccggcgagtccccctccctctccccccactgtcggctcattccctcctcgtcgggtgctgccgccgccttcctcctcgccagatatggcgagtcggcggctccacggcgcagcgtcgggctcgccgctcgccagatccggcgagtcggcggctccccgcacaacggtggttcgtggttccctggcttcatatatagcggcgcagcggcgggtcggcggaggaggaggttgagaagcggcggcctcccatttgccccttcatctcctctatctcttcatattttggatgattttgtgagaatttcgatttggatttgaattgcgattttgtttttggttggattgtgattgtgatgatgtaggatgtggagaggagataatattgaatcgggctttttttttcggccttctttacggtttttctacaaattgaattggattatctttctttttgttttgatgttttttcctttttttcgttattacagacgacggaaacgttttcaattttctaagtagtagagactagaacatatcgatccaaatgtgttatgataaactcaatacagtatcaacaatcaacgtgctctggtgagcgaaaaacataagcaagctaatgggaattcagcttcaacggcactcgtagtcgagagtcgctccactacactagcaaagtcatccataattcccgccgagaacccaaaatgctgcactattgctggctcgaacaccgctcttaccattgcagctattgtgtttggactcgccaacactccatctgtggcaaggaaagtatcgtgggccatcgccttgttgatttgaaatgagccctcatcttcaattatcccatttaattcattttccataggtgcatagataggtatgtggaatgtgtcgaacttctctttgctaatcacaccctacagcaagttaaaaccattttcagtaaacctggaaatgagccttgattacaattattaattaactgccatgttacgtaaacaaattgcgcccaagtaaacacaaaaataaaaactgtgatattgcaaaagaaatattaacgaagtttttgtacatatctacttattatatagacctgagcatgcatggacaggccaggccccaagaatataatgtgcagattgatttgcatcaaaatttactacggatcggacaagcttgctgtgttaaacttttttgctgggcgagacaggactcaatcttctgttgggttcgggcttggccctgagttaatcatgtgcataatggtgctgttcaagcttgccatgtacgtgcatgtgtctcatccagggaaattgtcgattttttttcatatatatgtgaatttggtcatactttattcaaattcagtaaacatgtattaaaattttaaaaaaaaactcgttcagaatatctgaaattttcgaaatttcaatgcccaccgaaattttctcgctttccgaaaagaaaaactctggtctcatctaaactggataaaactaaacaaagcataaaccatgtaggatacagagattaattaattgattgaaaagctaaagcttacgctgcttaccctcgatgccatgtcattcaaggctacagataccactttccatacttgagtagacacggaggccgggttgcttgaacatctaccgatcagcgagaaaatcaaccgacctccgagaaccagttctcgagccctcaaggacaagaatagcgtgaaatcctttctaaactgtcgagcataagcgtcggcaacaatttcatggttcaacagcctcaagcgctcgtcgctatcatacattgggatttttctcttggcaagttcttcaggtgcctgctttcacaaacgcacattgatagtaacagctgccccattattccatatggctgcatatatacaattaactcaacctaatgttgcatgcctacctttgataaccattgcaagctgatggaggagcagaagaaatgcactgagtcagaagtgaaaagcctctcatagaatgacccaggtaccatgttggcgacgacgacgtgatgagaggacacatcctggctgtgcttgaattcggccagactcttcgcaacggagttgaagtcattggatggaagatcgttgaggaaaaggcacatttctggtggtggctgcgcgcattccatacaataacggtggatggcatcgaccgtagatgaaatgagcgtgagtgcgttcgggccagatgagcagcccaagtccgcaattgccatgctcttgggaacagatactccgcagaaggctgtgacggcttcctctatgagaggcttcatcctatcttgggcagttttctacaagtattattcgttctgaggtcacttttgatttttgactgaagggtgcatgtaaatgccatagaaatataatcagctgtgatgataaccaagggttgaaatttcggttcaattttggaaattttggaccccctccccggcaagtaactatctcggctgaaattttcgttttttacaaaaattcttatgaatttggtcaaaatttattcaaatggagtaaaaatttgtaatgttgtcaaataatttcgaaattcaggatacttcggtgatttccattttccaaaagtgaaaaccgtgatcagaaccaaattaatcaattaaggtgcagacaattgccatttcacaatgttcgtagatactcaaaactgccacctgggaggggaattccctgggcatcgtgcggaaagttttggatatttgatttattgttatttctagcaaacaaaattgttttcaagaatagctttaggtatgctatgatcattgagctatggttcatagcggtttaaaaaccattggtgaaaaatagactacaaaattaattaagttctaaaatttaaattttggtgataagctaacaacgagtacacgataagaggttacagttattcctaagcaatcatcaaaagagggttggaaacaaaagcgcaaaatattagcaactgcttttaaaatactttctacttcctccgtttcacaatgtaagtcattctagcatttcccacatccatattgatgttaatgaatttggacatatatatctatctagattcattaacatcaatatgaatgtggaaaatgatagaatgatttatattgtgaaacggagggagtagcagatgtctttgttttttttagcatatttaatcaactgacatcaacttatttattaaatatgatatacttgaaacctacaaaaatgataagaacaggaatcaaggatttcaatcttttttcaattatatgataaccaaccttgatcatttcatgaagatcagaagtacaagtacaattcaattatgatgtcctcctcaaaggcatgtgtaactcagaaatcagtcaacactcatatgaccagcaaatcaaacgaagtatattgcaaagaagtacacatatacctgaattgtagagttgcgagcatagcttgtttcgccttgccctggattcatatggacaatttgtatggtggccatggcacactgtttcaatatctgattgtgcttgctatgatatgaaggctgagcatactggctatgtatttatagccttacaaatgccctctatggactatggtcattgtagttggactggaaatgttgaaatgctgacatttgtgatatctgaactataaaataataatttaattaatcaccattactacctacagatacgtttcttttaaatttgtaaaatatgcaataattaacactacaccatgacccacttttgccaacacgccattatgtaggggaaacgcagaattaacaatagagcatgtgttgggaaaggctttgccgacagataatggcatagtcggcgttgcagcagtcggcgaagcctttgccaacagataaaacctttgccaacacatgttgtgtaggcgctttgactagcttttgccaacacagacttttaccgacacacataatatcctgaaatggtagagcctttgccaacacattccattttcaccaactgatagttcgttggagaaagtgtaattagcctgtaaatataatccacagtttcacataaacctgccattccgtgtttcacataatttctacagtttgacaagcacattcagatgcaatcatgttcgcaagcatgaatactaacatatccaagtcctaagcattttactaactttttagcttcatggtaatttttaggaagtgatgtccttgccggaaaagcatacttaagtagatctagatgcaaatcaaaacttttatcactccatccaccaagaaatttgatatggagtaatctaacaatgaagcgaagctttgagaagtctttacaccctggacatagctcctgcccagcatcatctaccaacttgtaaaaatccccaatatcaacattacgctgcccctcattgttctcttctaaatctcccatctcatccaacccacatgctagatcttgaagaaaaccagaaatatcatcctcttcatttgacttctctagttctaccctgtgatccccatcgtcatgcataaaagtactttcttttccatgaaacaaccatgttctgtacaattgcatgaaaccatcacaaatcaagtgctcccgaacagtagtacgttctgtccaataactattaccacagtttttgcaagggcataatattgagttcccctttgatgaattagcaaaagcaaattctagaaacctggttactccttccacatatccatctgtatgcctacatgcaattagttactataattttagagacaatactaacacaaactattaactaatgattccaactgagagtttgtggtgtatctaggtagatccatccattgtttatccatgttgcacctttacaaaataaaaacatcacaaaactaattcatatctaaggacgcaaacatgaaacttatttttatttagaagggattatagttttcaattagggcaaccacacatcatatcacaagccattagtgaagcatgaatcaacaaattaaaaggtcaagcacaagaagatacataatagttaaatttggtttcatgcaaacaaagaaatcataccgataattgaagaagtagaccagcacaaggatcccgtccaccaaagcacagagttgttggatcaattcattgtcttctcaacctaaacaagacatagcagcatgcatgcctcagttatttcacctctgttgattatagatattgacatacgctgaaattttaaagcagctttattccagaaaacaataaaaagattcctataaggagcatgtgcagcttttcacccaaatgcaattatatggtgattctagaaattttgaaatatatcatgctgtttattaattgatggctgatttatctactattaaactaacctaattgacagaattgctatagttcttatgcttcgtgatacattaaatctgtgcttgagttccggtacaaattcctaagtccatgactaagtctagattttgattttaattatctatatgtcaagaatatcagtatttgtatggacaaggaactgcagttactaaatttggtaaagacataagactatacataccctactttttcttgctttataacttgagatcttgtttacttgtagtaacattttagtaacagatgcatatctatgctatccagatttctatgatcaaagctaggttcttgcaacagtaaccccatgcatgtacttaaccctgattttgtctactagtccttcaaaaaagagtgtgtttcatgggtcaaacttgcagtcagctagtatctcatagtaggacttaatcgatgaaatatttatttccccagtgttcttacagatctaggggggtccagggtgagggaggaggagcagaaactaccttcccagcagagtttggggaaaatgtggagatggtcgctgaggcgccgtttggggaggaaggagagtgttctcaaggggaggagaactggtgtggaggacgagccttggggactttgaggtcgatgtgtgcggcggcaacgagatcgagaggaggtggcgatggggccaaggatgcgacgagatacggtggtggcggcggatttgggagaagggaggaggagatatatagggtttaggagcagaaaaggttgggtggtacacttcaattttatttattttttttgttttggctccgcaccccctattcctcccgcgctcgtacttcaattttttttttccttcggaagtcctcccgcgtactctaattttttttcaattcctccgcgcgcaaaggaagatatatgcatctttgccgatactagcggctacatgtgttgccaatgaatcaccgacagattatttgtctacaaaaattggaatcgccgacacataatatgttggcattgctacatagctagatttgactacaaattatgtgttgtgtaatctaccttttgttcccaacacaagttagttggtaaaagtgggtcatggtgtagtgtaatctatcttattataactagtatttctactcaagatgtttttcgcatttattgttttcattatgagtaaatttcaaaacaaataccgatacttccatgaaaccataaacaaactacaaatttgatcgaactgcggatttagtgttgaacatatcacaaagctaaatatcaatctgaagtaccatctgatcaaaaattatatgtaatatatcctagtggaactttcagttccatataatttggtgataaaattgcttgtacatctgtaattttgcagttgatggcttgttgttttgcaagtattttcatgtacgaatctaaaggtatcactgtacatgcataatacaaaatatttatgttggcttaattattagttaaaatttaaaaataattttgaattttctattacatgcaagtcctatatttttgtaaggaagcagtgtgttattaaaacgtggcaggtcaactattgttattttttggacctgccacgtgagacaaaataagagtcaatggacaaaagcgccagaactgagaagcagcaacatagatacattgttggggcgacaaaagaatttgactagcattatcgatggttgacagtcacaaactttggattgtagaagcaaatgtgttcaaatgagtctcatgcatgccgcctagctagtcgtcgatcgctccatagccgccaggcgccggccagcccgccactttattgctccatagccgccccttgttttctcacattgttctttaagcttcttaacacgcataaccaccgtttaaaattactttaggggtaacatgactggcattataaaatttaaggaattggatcactgctggagaaaccatctttcgtcggtcggccgaattccacaatagtcccggatgcaataaaaaccggggctaaagatgatctttagtcccggttcaaaagggtaacgggcatatttgatctttagtcccggttggtaacagatgatctttagtcccagttcaaatgctgtcagggcatgtcaggccccccccgggatctttagtcccggtaactttagtcccggttggtaataccaaccgggactaaagatcccggggatctttagccccggttggttaccaaccaggactaaagtcccacccctatatatatatcttcttcctcctctagctgctcgagcaagcttcaaaatttcttcaaaaaagaggggaggtcatgccaaaatttatagtgaatttattttggtgattacatacaaatcggaggtgcctaaaaggtttgcaacttcatcctccaatattttttttgtcatattacatttgcagctatgttttgcacacttttttatctccaaaatttagttgtaagttgatgagagagaaaatttgtgtggggaagaaagaatatatagaaatttagttcatttgctaaagaaggttttataaaatagttgagaaggaaaactctagtgaaagttaatcttaaataatagaaaacaaactaaaatgaaaattaaaagaagtaaaacacattaaaattagtttaaaactttagaaatagtaaataagaattatttgatgtaatattttatgatttttgtatgaataaagatatgtcattattgtatgactgttgaaacagtttgtaattatgttataattattgtatgactgtcattattgtaagaataattatttgtgtacggtttttttcgactcatgtagatggatcggccttggatgtatgctgaccggcggtccaaagagtttattgacggcgtgcactattttttgagagtggccgaagctaataggcaaaggggttttatttgttgtccatgcaataagtgtaagaatcagaaggagtattctgcatccaggactattcatttacacttgtttgagtcggggttcatgccaagctataattgttggacatcccacggagagcaaggtgttgaaatggaagaagatgaattggaagatgacaatattccggactttactcagtatgttggatttgaaggaaatcaaacgggcgaggaggaaatagctgctgatggtaacgacgttgcggatgatcttggtcagatgctgcaggacgccaaggaggactgcgaaagtgaaaaggaggcccataaattggataagatgttggaggaccacagaacttcgttgtacccaggttgcgagcaggggcacaaaaagttggataccactctggagttcttgcaatggaaagcaaaaaatggggttagtgacaaggcatttggcgatttattgaaactcgtcaagaatattcttccggagggaaacaaattgcccgagacaacgtacgaggctaagaagatagtctgcccgctaggactggaagttcataagattcacgcatgtccgaatgattgtatcctatatcgcggtgaggagtatgagaacctagaagcatgccctgtttgcaaagcactacgatacaagattagatgagacgatccaggagaagttgacgggcagctaataaagaagagaattcctgctaaggtgatgtggtatttccctataataccacggctaaggcgtttgttcaggaacaaggggaatgctagaatgatgcgatggcacgctgaagagcgtcaacaggacgggatgttgagacaccccgccgatggttcgcagtggcgaaacatcgacagaaaatttaaagaatttggaaaggatgcacgaaacatacggtttggtttgagtacgaatggcatgaatcctttaggagagatgagcagcggccatagcacttggcccattacgatgtgtatctacaacctcccccctggctatacatgaagaggaagtacataatgatgccgattattattcaaggccccaagcaacctggtaacgacatcgatgtgtacctaagaccactggtcgaagatcttaaactgttgtggaagaaggaaggtgtccccgtgtgggacgaggacaaacaggaggagtttaacctacgagcgctgctgttcgtaaccatcaacgattggcctgcacttagcaacctatccggacagtccaacaaggggcacaaggtttgcactcactgtatggatgaaacagaaagtacgtatcttaagcactgtaggaaggttgtatacatgggtcatcgtcgattccttgcagcaaaccacccggtacggaagaaaggcaagcacttcgaacataaggggccgaccaccatacaaagcctaaacatcgcagcaggaaaacagtgtttgctatggttaaagatcttaaagtagtgttcggaaaggggcctggaagccagcctatagagagcaaagatggtcacgcggcgatgtggaaaaagaactttatattttgggagttaccatattgggaattcttggacgtacgccacgcaatcgacgtgatgcacctcactaagaacctttgcgtaaacattcttggcttcctaggtgtatacggaaagtcgaaagatacactggaagcacgtaatgatctgaagcatatggaacaacgcggcgaccttcacccagaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctactttgtcaccttgtgaaaaagatcagtattctcgggcctgtgtacctacacaacatgttttctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcagtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgataccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgacgagcctaagcgtcaagtggttctcccaggcaaaagaaaaatcgtcggagttgaggacaagactgacgaggattacgatcagttggatgggcaacccccttttacggtgacgattgaccctagcatcctcctatcaaatgaagacaccccttactcacgtagcgatcacaaggagggaacaatagtgatgagaaagtacgtgcggtcaaccgtcaccgccgatgtattaccgtaattattgtgtacacgatgtaaactattttggatgtattgattatccatataaatcaattgatgtatggcatatgttaattacgtacgattattagaggttttaacaagtttaaatcatgtatatgctagttaaatcatgcatgtggcatttacatatgttaattagagttttcacaatttaatttactatcattcatatgctaattatatatgactattcgaatttttaaaagttttaaatcatgcatgtggcatttacatatgttaattagagtttttaacatttaatttaatataattcctatgctaagtatatatgatgattacaatttttattaattttaaatcatgccgtatgtacatacatatgttaattagagtttttaccaatttaataatatcattcatatgctaagtatatatgattattgaaatttttattaatttaagtcatatatttgcttattacgatttatccacttaatttataacagacaaaaatattttttcgaaataattgtcattaatctttgtactttaaataattgtaatgcattatcttctattttagaaacacatatgtaagggaaaataatattcagtgctataatcagtagtcccggttcttaaccctaactgggtttaaaaagaatttggaaatagtgggaaaagatctttagtcccggttgatgagaacaatcgagagtaaagatatctttagtcccggttgttctcatcaaccgggactaaaaatccaggggtatatatattcccggtgcgccctcgtcttctccaccaacacttagatgttttcggccgatcgatctctctcgcctctctccttcgccgccactgcctagggcatccccgcgccgacgccgccatatctcgccgtcgtctcgagctcgtcgtcctcgccgccgcgtccgcctcctccgctgccgccgcatctctggggtgagagccgccgccgcctccctccatctctctctccgccgcctccctccatctcactctctccgactccctccatctctctctccgccgccgtcttcgccgacgcgcaacgctcgcggcgacccgccacgccgccaccttcgccgccgcgcaacgcc

SEQ ID NO: 29087 - DNA, 17157 bp, Oryza sativa
  unsure (1)..(17157): unsure at all n locations
acgaacacgtcaacgtgaccgagaacgtgaacgagggaacgaacgtgaccgagaacgtgaacgagggaacaaacgtgaacgtgaacgagaacgatcgaacgaatgtgaacgtgaatgagaacgagcgaacgaacgtgaacgagaacgaacgtgaacgagaacgtgaacgaacgtgaacgcgaacgagcgaacgagaacgagggaacgaacgtgaatgagggaacgtgatcaacgagcgaacgaacgagaacgagcgaacaaacgagaacgagcgaacgaacgtgaacgaacgtgaacgtgaaatgcaatatatatatatgtatgttacttcgcgtttatcctaatacatctttttgtatcttgcagaaaagacgtgttgtcggagtcgttcctcaagccggagtggaagagctagccctagaaggaattcgcgcaggcaagtgacgtaataatatatataattgttatatttgtaatgcaattaagattattagatttgtaattagacttagcatataagattgtgtagtgttctaataatagtcttaattgcatatacgacagttacacttagcatacatgactattttagtcatttattactattggtgcgactccggtctaactacggaattggtgcgactcctagcaattgactattttagtcttaattagacttagcatatacgacagttatacttagcatacatgactattttagtcttagcatgtaagattatttgagttttaatataagattattttatttgtaaatagacttagtatataattattgactagctagggtcgtataatatacgtcacctagacttagcttatatcacgatttgagttttagtatgagattattgactagctagggtcgtataatatacgtcacctagacttagcatatatcacgatttgaattttagtatgagattattagatttgtaattagacttagcacgtaaggttgtgtagggttctaatgtacgacagttacacttagcatacatgacttagattgttaaaacataaatgtctcatgacttagcttatatcacgatttgagttttagtatgagattattgactagctagggtcgtataatatacgtcacctagacttagcatatgtcacgatttgagttttagtatgagattattagatttgtaattagacttaacacgtaaggttgtgtagggttctaatgtacgacagttacacttagcatacatgacttagattgttaaaacataaatgtctcatgacttagcagatgtttcttgtatcaacagatggctgatcgcgatgaggaacagatattgtacgatacaatcgcggagggaagcagccagcactggaatgaagaagaggggaacgaggatccaaaccagtacttgaacgaggaagggaacatggagagggatgcggaggggaaccagcaggggcacgtggaaagggatgtggtggggaaccaggaggaggaggctagtggaagtcaaccctccattggacagaagagggcacgcgggcaacgaggtgcagcgaagaagcttgagggtcggcacatcataacggaagtggaagaagatggacgtcctagtgccccggccgaagccgccaaaaactatgtacgtcacagcggttgggttgtgcgggataacgtgcctgtcagtacggtgtactggcgaagaacaagggcacacggagatcatgagagctttgtcctagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatcctgaaggggcagacaccgaacttccacacattcctaaagttaagggatcactgggacaagttcgttgcatataagacaggtgaacaagggcaagtgatgatggaaagaaacaaagaaaatgccgccaagaagaagtaccatcaccacttggggtcaggaggctatagcgtcgcgatgccgaagtgggaggagatggaggctagcttgcttgagaggggtatcgaaccggcaaccgctaattggccggaacgatcgaagttctggtactatgctcacggtggaacgctcaacccagctgatggctcactggtcttcgccgatcagatacgagaggctgcgcgacgactaacagatgcagtggaagcctcctctcagggcacattccgaccggacagagatagggacgagctgacacttgccctgcagactccagagcatccaggacgaacacgagggaaaggggtgattccttggaagattggtttcaaggaggacatccacatgtacaggagtcggatgaggagcaagagagataccgagacgaagattgcagatctagagttccgggtatcgagctacgagctcggcatgcaagaggaggtggcaaggaaggttgatgaatgcatggccgcacatcggtcccatgatccccagccgaccattcctcctgcaatggtgagcccgtcaggaaaccgtagcagctgcgcctcaacggggcaggtaggatcacagagcatggacgccatgcaaacccaggacgaatcgacctgtcccgttgatgacatcactcagcggacaccatgtgagctgcatattcctttcaagaacttatcaataaaggtaagctcgtagtttatatattttagatttggccatttcgctagttgctgcttatatatgttgattactaataaataatctctcacaacatgaaggtagcgttgggcatggccatcccaacggacccttctggtacttaacactgcaggccgattccagcaagatactcgaaggtcgaagttgagttggtcgaaggcgcgtatgaggacctcgagctggattaccctgaaggagacggtgagacgcatctacgagacacaagccaagccattattctatggcgcaggcggtacatcatcttccctgggcgacaagcggcgtctcgtgcaccatctcctccggctccgccatctcctcctcaggatcctgcactgtctcctcctcatgctccgctagcaccgtctccacctcaggctccagcaccgactcctcctcaggctcctgcaccgactcctcctcgggctcctacacctactcctccgcaagctcctcttccggcaccttcaaagtcaagggcccccccagctccaccgcctgcccacacaagggcaacgaagaaggcgaaagttgatgccgccaagaacaaggacccggggtacgattgcacgcaagaggagcttgacgcttacgtggcatcagaagtcaagagacaattcaagccttgaagtccagaaaagaagattgctatagacccgagtgtcaggaacttcttcaggggtatgtctgcacctgtcaagaggccatcaagctatcggactatgagcgaacgctgaagaaagcatcttctgcaaagtccaaaccagtccctcagcttggagagcaaccaaaccaggagatcgagccgttggtgaacggtgaagacatgacgatagaagaatttattactgacaccggtctaactacggatcaattgctaggagtcgaaccaatagaaaaggcggaagtgaaatacatgtacgaactcggtaaaccgcttgtcaagcccgagctggtgcagtccctacccacacaaatgtacaagttccatcagctatacatagagatgagcaccaccggtagagagatgattggagcgaggatcagggacccagacttcttgcaaggagatgacattctctggatcaatttcaagggaatctacgaactatacgagctggacgccctcgacgtctctattatgagttgctggattttgtaaatatatcgttcagttagatttcttaattactacgtctcctttaattaattaggtccttgtatataagtagactatataaaataaaatactcccttttatcgttgtagaatggagattcaaagggcccgacggcggagggtttttgatactggattcatcgaccctcggaaagtaaacgtcgcaatgctcgaccaatatccgcaagccacagaggacaatctcgtccatctccttcaggcgcagcattacaagacgttcatactgttccgtacaacacagagttagtttaattttactgtcttcctataccaaatttcattcccgtacgaacttgctaagtgtttcatatgtaatgcatcccacgcacattgcagattccactgggtgcttttactcttcgacctgtcggcctgcaccatcaacgtatatgactcaatggataaaaaagagtctacgtttgacaaggttttcgaacttatagacaggtactgtcataagttcctctgttaattaagaaattcttgttatgttaattgctactacgaatcatatctttaaactccatgtagggcttggtattggttccgtcatttggtccacggcaactggagagaaagacttaggcggaagttcaaatttcctgtgagtacacatgctctacatttatatttctccgattcaaattaatacatacaagtgtatattaattagatctcacgccgttaatttgtcatttatttgtagtgcgcaaagcaaaagcagggaactaacttgtgcggctactacgtgtacgagtattgccactgccttgcagaccaaatcatcaccacaagagagctcgatgtacgtacaaataaattcaaattttcattacgtaacgatttcttgtttaattactaatcaatttcatacaatgatatagtttattcgcatgagggataacctgaccacacacaaggaatttatcgcggcggttcaagaacaactcatgggattcatcaacgaagaaatccttgatcccaagggtgaattctactacgacggaaacacaattcatagatccttagcttctgagctagcgactactactacgtcgaaatcgtagctagctaggacatataatggattgtaattaatatatgactacatatgtttctatatgcatgtgtacacattttctataatgtaaatatattttggtcatatatatatatatatatatatatatatatatatatatgcatttgcataacatatatatgtataaatacatatatattatgcatgtacatatgtactgaaacatatatacatataatataatatatatatatatatatatatgcatatattatatatgcatatatatgtattgaaacatatatatgcatggtttatatatatatatatatatatatatatatatataaaccatgcagcaacagggccatgcaaaaaaaaaaaaggtcagctcgatctttagtcccggttggtaacggctcagccggccacgtggctaagccatcttaagtcccggttatttcacccgggactaaagatagcgatctttagtcccgaattggtagtcctggtttgaaaactgggactaaaggggggttacaaaccgagactacaaagggtttctccaccagtggatacacggtttgaaactatatagacattcaaaatttggtgtcacgtggattttctttaataaatatgttgctcatattatatttccttttaagtaaatataggtatttagaaaaatatgttcgtgcgttgtaacatagtctagcttacataagaactaaggctctgtttagttctcaaacaaaaacttttcaccatgtcacttccaatatttggacacgtgcctagagtattaaatagaaaaaaaaactaattacacatattacgtgtaaattgtgagatgaatcttttaagcctaattgcttcatgatttgacaatgtgatgttacagtaaacaattgctaatgacggattaatccggcttaataaaagtctcgcagtttataggcggaatatgtaatttgttttgctattagtccacgtttaatgcttcaaatgtgtgttcgtatatccgatgtgacacgctaaaacttttcgtcttgcgaactaaacagagcctaacataagttccaaataaatcccaacccccgcccaaacacaaggaaggtgtctatcttaatcccacgacaacatctatctgacgacagagatccacgagacaaacccattggacagtcaagacaaccaagaagaccgcacacagtgccttggtgggaaactccttccttcctttgttttcgagtcatttcttggtcccccgtcgtcctctgtgtgttctctgctttttctttttcacttcaaactgctactgtagtacaatattaatgaccatgtgttatctctactagtacttaaaaaatttgcagtggtgatggtgaagccaacataaacaagcgacctattaaccatggggtcaggaaatcggacgctcctccggatcccatcgcaatccgcacttggcgagaaaaaaccgtcgctcccaaatcccccatcgttgcgccccctcctctctacaaccaacctcgccctgccccccatcgccgcgccccctcctctctgcaaccaacctcgccctgccccccatcgcgcgccccatcactagcgctgcagacgcctcactccctccctcctcgaccatcgcggatcgcggcagccggcccccgacgacgctctcgctccatcctccccaatcccggcggctcctcggcgggttcgtcaccacggtgactgagcccccgcctcgcccttgcgttctgtccgtcatgactcctcgcccccacgccgctagccaggtaagcatcattcatttttctcatggaagtgtgtttttgtttccatttcttctaccgtacgcatagaattgcatgcaaaacactgctgctgaatctcctctctcttgagacagtgttatctttaaatcaatgcaagtatgtactgtgttctcaacaagaattgaaaacccatagatggatttagttgggcatgatgtgtccattaacgtaagcgatcacccacataacccccacaaataatagcttcagaacaagtgcaatgttacatctgaagaaataacatatcaatcctgggctgggcatatattccatatggacaatatgatcgaatttgtgaagcatcagacatgcagaattaattattttcccccttattttcttggttttgctgcaattttaagtaagcattcttgatatgatcccatggcgtgtaatagcaattctaaacttatgatacatacctacatcctcaagaaaatgtttttctaccatcaggataaataggtcatggtcatgttgacctgatcttttagatattactccaactcataacattagaaaagcatcatcaattaataattctcgattgtaattttatctcaaacagtctcaatcaaaaaatttcagttcatcagtttgtcaaaaaagtctcacttgatggatcggttttagcattaatattgaagcaaataagtgcataggaatttcagttcatcagtttgtcaaaaattgtggctagatggatcggttttagcattaatattgaagcaaataagtgcataggtgaattagatttttttttcactctataaggatactttgtgccacttgcttttgttgtcaggtcatccaagaactcggcaagagtaacttggtagggaacttgtctaagcaaccaatggtcaattttctcatgaagcggtctttttttttcagaatcattcctgtgcgaccggagaccctgacattacctctcgctaccagcaccgctgtcttctccctttgtcgagatatccattttctctgtcttgtcctccgttgaatgtctccctgccgattctgtgggattgggtgatttggtgtggagctaatcattcggttgatggtctaatcgtgcaaagggacaaactatagtctaaagtcagacatgccagaaaactataaatatcgatttgttcttttcttatgtgtttgtttttaggctacaatggaagtattgactgccatatactcgtgaattaatctatatgaattgtttatgttggccatatgccaatatacttgcagagtactagctaggtgtgggcttggcaaaatacctagctgcaactttttcttggtcaacaaatgcatttctgattttttttccagtttataatttgttccagacataaaagtaaattgtgctctcatttattgctttcaaaacagaaatgcattgtgccgaaagttgtggctgggaaaaatggctactggctattcagcatccttacgctcatgcaacttatcttttttcagatcagtgcagtactttgaactgatcaatacaatatccttatttgtaagcatgttttttcagatcagtgcagtattttcatattagtatattacgaaaatataattcctttaattgagtcagatagtctagtgacctagaaatttatattcaaatgcaattttccccatctaattatcctttgagtgagtgatcatgtgattgcttcaacaatcaagagcatcttgattggtgaacaatgacaggtaataacacatgttttaatgttttgttgtaaaagatcatttcaaaattcatggtttagaaaaataaattacaaattcgaatcctgctgacaactgttatttgattttgtacagtacgccagaagaaacatgtgtggtaccacgtgattgtcacatacataactctttatgtaatttttttcgtgaaccttaatagcatccacaatcaccatctacgagaccaactgcgtctcctatgagagagagcccgagaaggtacaacacgtcctacagtgttagtgccatcttcccacatggaatgtggtatgtgtgcgtctcaggtctccaacggtctactagagtggccagaagggacttgtctgcatcccacagctttattgggtcggtgtcgtttgcggccacctcgactagcctagacaatggtaggaggcctgcctcatgcaacctgcagaatgtaaggtcgacacattaataatgactattaaagtagagttagccgttcgtaaaaaataatagaaaatggcataccacggaacttgtcgacacgcaacagttgtcgcggaggacgtgacggaaggtgctgagttgtacaccctagagtagggatggcaatggggacccgatccccgatcccccgcggggaaagcatctattagggcctagagtgcttttcaatgctatggttattaggtcaatacgtgcattaaagaaacaacaaactttcatatcacaagctataaagattacaacaacatagttcagaatattaggatgcaatactaaaattgctcatagtacaataccttctaattgaaggttatgaaattacaagcaatgacgattacagtagttgtaggatactatacacaatacaataccggactagttcatggttcactaacaatactacaccatcgcatcaccagctgcacagggacgcctaggacgtgctcacctggttattccttcctcctgtggttgacttccatccgttgtcgttccagatggaccaacatcagcgccgctaggacctagcgtatcctttggtcatttctagtaagtcatagactcctatctcctgtttcggacatatacatgttatttctgatgcatcttgtcttacgcctgcctttttaaacccttaactaagttggatcttgaatgcaaataacctggggacttagagttgtgtaagatcctaagatcccgaacccatatatctcttcactttatgtatgaaagattgtttctttccagaaataatgtgacacgtagacatcgggaagtataccacaatcaccggctgtagcaagtacatgagagcaaggcaggtgccaaagcttaggcttcgtacagttgcaactacatctgccatcctactttaggacacatttctgcacagcttgcctatggtagataccacgcctgctcctatcaacacaaattacttcatattgacaaatctatgcccttttgcccttaactattttatctaccatgtccttagtaactactgtcccataagatatattgttgtgtaccattgaggtatcaattttcttgtataggtccttgaggtaggcctgtgtgccatgaaggataaattcaataataccaaccaatggcattcctcgcactcctcgcattacccagttgtaaacctcagccagattagttgtcattatgtcatatcgagaaccatcgatgttgtacaagaggacccactactcctttggctcattctcaattcaatgcgagaaattccaaatcgatgatgccgacctccgtctcatactaggtgaattgtcatgcagtggacctagagctactggaggcttgtcaccttcaaccagtggccagcgagattgctcgtccatttgcttggttttcaaatcatccgaccttttccacaactcgttgaatttctaaagttgattttgtgcacaaagcctcttaaaatgattcatcaggtgcttgttcttgaattgcctgtagaaattagtacacatgtgacacatgcaccatctactctgaacatcaggccacctagctggaagtcccttcttatcccaatcattttgcaagtagtcaattaccggtagtatgcttgtatgacgatcatgtataatgcaaacatcaggcctcttatgcatgactttggtgcacactttcttgataaaccagtactagctttcaatgttctcactctcaacaaatgcaaaagtcataagtaaaacttgattgtttccaaaagctccaattgctgtcaatatctgacccctatatatactggtaaaaaatgtaccatcgatgcacaatatagaacatcaatccacaaaatacgttcatgcaagcactcaatgcgaaaaaagctctgtgcagcattctcttgttaggctcatcagatgatgggaatgtatgaatgtcaaagtaagtattactatcttcttagaattgctggctaactggcgaagcaaattatcataagatgcttcaaagatgccatacatcatctcgataatctttcgtttctccgtccatgctttggcatagcttatgatgcatatgaatttgtcttcattgtggctaataattaatcttggttcaaacccaatgttgcggacaatgctgctatacatcttaagtgcaataaaagctgaagtgatgttgcggtggtacttctccaccccttgtaagtggcatttatgctcggtcatagtgcttacttttcaatagtcattccatttacccttatatgcatgaacatgccactaacactcttcattcacacacctggctttgtacacagatttggttgacttggccaccctaaactctctctacaatgagactgcacaatgcttcaccgcctcttttagatcctccgaatgagcatacctagcaccctaaattaccttgttctccttttattctcaagttacatgatgcccctcaaagataacaaggcctaaaaagtcctcatttgtccaatcagcaggcattacatcatcttcctcgtcagatgatgcatcacccttcacttgctcgagttcatttgcttgaccaagttatcccgtttaatgttttctttgttttaccatgggcatattttaatgcccatgttactaccatacatatctcatgctatcagcacagattctaccttcttgatgagagaacagatgtgaagggaacatgacacgtgagacttagcttcatcaacaacaacagctactgcagttgccctttgtccctatcaatggcgatcctgactcagttcgatcgtgttgtttttctcttcatcccgtcactccagtcaccctttatcccgaggtcgactgattgggagcgattggatcgatcagctttccatcaacatgccatatcttgactgcaattcataggcacaactgggggcgacgtgcaaccaaaccatatgaaggtgttgggcaccacccaaatataaattccttgtatggatagtgatccaagattgggtttggatgacttgcagaccgtattgaattgaagaggatgaccaaaccaacaagtatgcccttgtgattcacctatctgcaaaatgcaggctcaccgccaaacagtttgcagcaatgtaaccatggaccaaccttgaccttcatatgcatgactcatgcaatgtatgggaacactgggaaaacatatgggaaaacaaagaaacccctgaagatgttgatcatcatagtcaattgggagacgtggtgctagcgcaacgcaagaatcttctgacaaaccacaataaccccaaccaccatagtagaaacactagcttaggtgaaagtaggagcagccaacacaaagagggatgccatatattctttctcttgcgggagtgctattcttttcccatatattaatagagaagcagcaatacaaaggcctaaataaatctttaggcctttgtattgctcttctctattaatatacaagtgcaaagctttaaaacttaatagatgcatatgggccaacttcttatagggatgagattgcccttcctaaaagatgtttaggacattaagtaacttttaatcatgacatttcatactctttaaaatgtgtgtatttttagggacatttaactccatgccacttttaagatgtggcaactaattatttgccactcgctgtctatgacatgtaggccctcatgtggctatgacatgtgggtccagtagcaaataatttagcaccactcgtaggagtgacaaatagttaattattctgtatttttaacttgggggatgatacatgcacatcccttaaaaaaaagaataacaacatgacaacaagtatcatgccaagagagctatactatagacacgaccttcatcctcattcaccaagttttcatgtttttatagtaaaactaattcaaattggtctagctcaacactagactgcaggcatgactatatttgaactgttttccttaagtagaggttgcacacttatccatagaccgctcaacaatatcagtaagggaatcgaacccatatgttccatgaacctcatgaatggtaagtcaaggtaatcagcatgggtacaatgacaaaggcttttacattacatgccattcccagctagctcactagaggatattggttggttccaccgtgatcgtaagcactccaagcatataaaatattagtgatacatcattggtgtcatactatagtcggcttaactatatgcctgcaactaaaaattatgatgtgattccctagttgatacaaaggcatactatagaatatatcgatgcaaatgtgttatgataaactcaatacaaatgcaaggatggccatcaacgtgctctagtgagcgacaaacacaagcagactaatgggaattcagcttccaaaaaactagaactcgagagacgctccactgcactagagaaatcagccatagtttcacctgaaaatccaaaatgctgcactattacaggctcgaacactgctcttgtcattgaagccattatgtttggactaggcaacattccatccgtggcaaggaaagcatcatagaccatcgtcttgttgattcgaaatgaaccctcatcttcaatgatcgaatctaattccttgtccaaaggtgcatagataggtatgtggaatgtgtcaaacttttctttgcttatcataccctataaataagttaaagtattctcagcaaacctggaaagaaaccttgattccaataattaattcatgaagttcctttttacaatagaatgccatgagctaaacttaaagatagaaattgtgatattgcacgaatattaaccatttttttcgtgtatagaacttggataggatccatggcaaaaaaatttgccagtttaattttctgtcccaaaacattcaaacttttaacctcggatcgcatcgagattcgtgtggtgaagggaaaagaatcttgcaagtttgcagggggcgtcaaactccagacctcgtatgtagatgcttaatgtggtagccaaccagccatgcacttgtttgctccagttacatacggtatatacataagttacattgtaattatagtgtagttacaatataatattaaacaccaattacactctagtgatatacgaaagtttttcataaaaaaacattaacttactctcgatgccatgtcgttcaaggctatggctagcagcttccatacttgagttgacttggacgcatggttgcttgagcatctgccaaccaatgagaaaatcagctgacctccaagaactagttcttgagccctcaaggacaagaacagcgtgaaatcctttctgaactgtcgagcataagcattggcaacaatttcacggttcaatagcctcaatttatcgtcactatcgtacattgggattttactcttcacaagctcttcaggtgcctgcttgtaaaaaggcacaagtggtgaatattgaccaattattccatggcaacatatataggggattcttatgctgttcacatacatatagtttactgaatctagttgcatgcctacctctgataaccaatgcaggctgatggaggagcagaagaaatgcactgaggtcgatgtgaaaagcctatcataaaatgacccaggtaccatgctggtgacaatgatgtgatgggaggaactgtcctggccatgcttgaattctcccaaactttttgcaacggtgttgaagtcattgcatggaagatcgttcaagaaaatgcacatttctggttgtggctgcttgtgttccatgcaataacggtggatggcgttgaccatagttgaaacgagagtgagtgcgttggggccggaggagcaacccaagtctgcgattaccatgctcttagggagagctgccccacaaaaggctttgatggcatcctctatgagaggtttcatcctatcttgcgctattttctgcaagtgtaattctttcttagatattatgcttgttttactgaagagtgtgttctatagaaaaataatcagctggaagcagaaccaaattatattgtacatagtggagatgctttccatttcacaatgctgctaatttacacattgtcacgtgcgaggggaacaccgtacccccgggcatactacggaaaattctagatagtgggcttcttcaatattcctcagaaaagccaattttggctttttaagaataatctcaggtaatcatgaaattaaaaatagctgacaggttcatagcaacagccttagaggaaaaaaaggtgccatgaagagcctaactgatagaatcctacaataatttatacatacataaaaattatatatgtatatttacaaacagttttttttaaagaaaaagaaaagtaaatttgctgcttgacattgggttcttgattgacattatagaattttaaccaccatcattattttctttgtattgaagttcttatgcttaagtactcataatggaacatagtctacaataaaaacatgatcatgagcatgtaacaaatgatttgtactgtagaataagaacttatacgaggtaactccgaaagccgcaacctcattccccgcttggccagagaccgcaagtggctatggtgacggtagcagcaaccacatccctagccccgatctggcagccccagccccgcggcggccgtggctgctgccctcacggtgtggcacagggcccccccgcaactgacactgtgtagtcgccaatgatctggctaaccatcggagagaaggaacaagtggatctagctggtattttcttgggtgattttttgatgtttcagtctatgtatatggatgttcattagtaagatcaaagtgtttcaatggggtgtttttatggtgtttctttttcatcttcgatttcactcagatcttgttgatgttgccatggctttaaatcatttgttttgtatgttaaagcaaattgtttcatctggtgatccaattgtgtttcactattttcaagaactgaagcattctttccctagttgtctcgtgacttttcttggaaaaaatagtgcgagaaacctatttggcacacagttgtgctttgctccattttctgtcgacttctatgggtctatagggccaaacaaatatgctttttttcttattctattgagtgaattaaaattgattgaaattttttatagttataactcaattttaaaaatcttcatatgtattttagaacatttcaaattcaaactttcaactaaaaatttaaaactttcaattcatattttcaaaattttcaactcaaaatttaaaactttcaactccaatttaaaatattcaactcatattttgaaactattgactcgatatatgaaactttgaactcaaaacttttcaaacctcaacccaaactttgaaaattttcatatcaaattcaaaactttcaattgaacttttaaaactttcaacttcaaatttgaaaatccatatccagatttaaaatattcaaatcaattaattttattattttattaagaaattattgtagcgcttagcactaatcacggtaattagacaggcgaaggagacgcataggccacactttatttttgttgaatgggcctaagatcaatctaaatttagtggttacatggcacatccaagcaatgtttctgaatttaagatggaaaaacttttaggctcatatttaatcgccattttgggccaagaacaagccttccaagcaagcctttagcattaattttactatagttgataccccgctctttgctgtgggatatgtggattaatgcatgttatacatcatggaaatggtagacatatatctttaaataatgtgaaaacaatgtagagataatgatttgacattgcttgcatattgagttctaaaaatacaataaaattgtaaatgatatgtcatgtttgcatgatatttaaaatactatagataataattgttagtgggtgatgatgtggtatacttgcatatgatttaaaatactctagataataattgctagtggatgatgatgtggtacacttgcatgttnnnnnnnnnnnnnnnnnnnnnnnnnnnnnnnnnnnnnnn

SEQ ID NO: 29088 - DNA, 307 bp, Oryza sativa
ttgaccatgatatctcttccgacgtgataaaacaatactgccacgctaaccaatcaggatggcatggcgaaaccacaatgtcacgccagtcagaacgtgaccaaatatatatactccctccgtttcaggttataagagtttgttgcattgctcacatttatatagatgttaatgaatctaagcacacatatatatctagattcattacacacacacacacacacacacacacacatatatatatatatatatatatatatatatatatatatatatatatatatatatatatatatatatatatata

SEQ ID NO: 29089 - DNA, 460 bp, Oryza sativa
aaaaaaagaaaaaaaaaaaaaaaaagagaaagaaaaaaaaaaaaaaaaaaaaacaaaaaaaagaaaaaaaaaaaaaaaaaaaaaaaaaaagaaaaaaaaaaaaaaaagaaaaaaaaaaaaacaaagaaaaaaaaaaaaaaaaaaaaaaaaaaaaaaaaaaaaaaaaacaaaaaaaaaacaaaaaaaaaacaaagaaaaaacaaaaaaaaaaaaaaaaaaaaaaaaaagaaaaaaaaaaaaaaaaaaaaagaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaagaaaaaaaaaaaaaaaaaaaaaaaaaaaaaaaaaaaaaaaaaaaaaaaaaaaaaaaaaaaaaaaaaaaaaaaaaaaaa

SEQ ID NO: 29090 - DNA, 226 bp, Oryza sativa
aacttgttgctttcatgacatttccccttacttttattcccctgcagcgctctactatggcatcgcctcatgggaaccaaagttctatctgcaacattcaatggcaccaacatgattcgcacttatgcgcattgcgcaaaagattctgtaagcaatccaaaaaacccaatgcattttcatcagaacaatgaaaaaaaaaactcatctactaactgaatctatgctc

SEQ ID NO: 29091 - DNA, 806 bp, Oryza sativa
catgggtgtactcggaagacccagccgagtcctctagctccggcgacctcatggttcagagccatggccggcgatgatgtcatcgtgacatcataaatcttttttttagtttttctgtattagatgaaatctgattaaacttcagaaattcataactaaatcatcataactcggattcaagtggttcaaattgctaaattcatgtaaaatcgatatccacatgttaaaaatatccacatgtactgtttatgcttgttttttactgttttgttgattttatttatttgctttagtttcggacgttccggaggagagcgtttacgttgaggaaggttcagaagcgtttgaggaagctcaaggcaagtcacacagatcccaaataaccctttaagcaggttgaaccagtttaaagctaatgttttatttcaacttatgcattattttcgaatgtcatcgagttgtgagcctttcccatttaattatggccaacaatgactctattttcctatgagtaataaactaaatagcttgaaccttatatattggtttggtttagctaaatgctatatatataattgcttaaccatgcttagaaacattagcttattaatgggctgaatcaccttacattattacttatggttatatttaatggtagctcacgatgggtaatccggttatgatacttaattgataactagaggctggttaaaggtgggttgcgagcacatggatttgatggccttgctcatgacaattaaggaccggttcacgagctactgatgtgaaacattaaccgtgccaat

SEQ ID NO: 29092 - DNA, 557 bp, Oryza sativa
ctttgttatgctgtcaagagtatggcagtgtcgcagacacgctgatcggcgggatgtatcatacgcgccagaagatgaatcaggcgtctacaagtggtgaagatcaagttgtgtcacagtttgtttggctaaagataaatcacgcttgagataatttggagtttgctagaggttagttattgtcagagtaatcttggtcgtgacaagttaactgcatgtttaaattagtctttgcactattttttgtaatagcatattagctttggattcctagttgcatgcgctggctgaatgtagtttttcagtcagagtttgttattcagtttctctgttttttcagagtagatgagatcgagctgggatcggatcgtgggatggcacggtcagttggcacggtcagtcgttgatccggcaaggttgcgcatgtaacagactccctcatggaggtgaataaaaggaaagaaaaaaacccagaaaagctgcagtcagttcgcaccaccaaaaactctgtttttcgtttcagttcttcagttactgttcacgtctggaaaatattc

SEQ ID NO: 29093 - DNA, 539 bp, Oryza sativa
ggaatgaggcgagagctcactgctccctattccccacagcagaatggagtcgtggaacgacggaaccagacggtcatggcggtggcgcgctgcatgctcaaatcagccggatgccggcgcgtttttgggggggaggctgttacggcggcggtatatgtcttgaaccggtcaccaacaaaggcgctagacggagtgaccccctatgaagcctggcatggacggtgtccatcggtcgaacacctgagggtgtttggttgtgttggtcatgtcaaatcagtgaggccaaacttgaggaagctcgacgaccgaggtacgagaatggtttttattggttatgaacagggttcaaaagcataccggatgtatgatccggtggcgcgacgtgtttgtgtgtcgcgtgatgttgtgttcgatgaggcggccacctgggcatggcatgatcctgaggcggagggaattggagaggaggaattcacgggggatttctttgtgttccatggaacccgttgttgctaatcaaggtggacaagctggaacga

SEQ ID NO: 29094 - DNA, 564 bp, Oryza sativa
acctccaatagctgagcagtggaaagctatcaacactgtggtctgcaaagtggaattcgaacccaaccaaatacagcctttgaagcgaagaatcccatctgtcagagtataatctagaaactgctctggagataatactatctgagaaatgagttgagaagtagccaggtcagcagcatacccattctctacttcttccaaccaagtcggaatgcaagatgacaaagcactcaactgtaacacttctccatgagagcaacgagataaagcatcagcagctcggttttctaatcccttttaatagaccaagcgatactgaagacccaaaaatttagtgagagcacgttgttgccagggagtaaccaacattgatcatccagatgtgtcaaactgcgctggtcagtacgaatgacaaattcaccaaattgcaaatatgatctccaatgatcaacagcgagtaaaatagcaaggcactctttttcataggtcgacaaacctctgttctggggaaccaaagaacgactgaggaaagccaaaggatatcctgactgcattaatactgct

SEQ ID NO: 29095 - DNA, 661 bp, Oryza sativa
caagtaactgagcaatttctgtaggcagagaagaagatgacgattcttccaccaacgaacaaaattccacagcatgcaacaccgcattacgatggactagtcccttaacttgattaccagtgatactagggaaaagagcaatattagctgaaacacctttaagacaaactgcacgctgcttatactgaaactgcaaggttttcgctcgccaattgatttgcattgggctatgttgctctaaccaatccatgcccaaaattacatcatagctgccgagtggtaaaaccttgaagttagattgaaaggatatcccttgtacacaccaaagacaatcctccaactcagtaacacactccaaaatacccccatcagcaactttgaccttgataggtgacaaaacatgtcgctgctgagtccatttatcggccaatccctctgaaataaagctgtgtgaactgccagagttgactaacattagaatttcattgtgttgaatcaacccttgaagtctgagagtaccacttgtctcagtgccttgcatagcttctttggaaatctgacacacttcaccttcatattcagagttaggaataacagcagaatccttctcctcatcaccccactctttagaagaagaatcccggaattccaatagctcttc

SEQ ID NO: 29096 - DNA, 630 bp, Oryza sativa
cttgtagtgtagctttcctctagccgacgcatctaggcaagggtgggcgtggtggagttcggatgggccctgcgacggcctatgcggcttccggattcacctaggcacgagaggggactgcccgctgccttgcgaggagtgggggtgaaacctgaggtgtggtgtgcttggttagaggggggttatgcgaagggtcctgtcacggcctctttctggtatgtcgtggtggcatgtcggcgcacgggaacgtgtcgtggggctgtgtcttgtgggtacagttgtacacctttgatcagagtaaaactattcgaattgccgtgcccgcggttatgggcggtcaaccagattcaccgtgattagtctcaccctagtgtaatcttttgaatttggatagtttaggtggatggttgggcctgtcgcaacgtgggatagcgttggacagtggatagttaatattaattaattacttctaccgtttaaatctttcacttactgtttataaatgctcattttatgcaaatgaaccactctagctctcctttgataattccctgcatcatacccctattccggtatgacttgctaagtacaatgggtagtactcagtcttgctctatttttcccaacccc

SEQ ID NO: 29097 - DNA, 775 bp, Oryza sativa
aaccatgcatgcagatcgatcacatgacctacatgttgggatacgggtaggctacgatagcataaatcaaaattttctatcgcgtaaaccaagaaccatgcaagtattagatcatagatcgttaccactcgatgcgctgcgcagcggaagaaaacgctgagaagtcgaaggaactctcgcgaagtagcgcgcgtcgatgcagaggaagtagtcgatcgcaccggctcgaccttctccttctcgtgcgttcacctcgtcgtactcccacgccgatcagcaccacaaaccagcggcgcctttaccggtatccacacgtaaaaggacggaacaccacgtgcagatgtactagcacccgcgcgcggctaggattttgctcggggagggaagtgacggctagggtttctcacgtgatgcaatgcctacgccggtcacacccctcatgaatatatagaattcatcactcgggcctccaaggcccgtaggacttctattccgatccctatccgaattaagctcatattggatctctatccaatccccttatttcgacccattaagcgtgcgaccctgtaggttcatatatactcggctgtaacccgaaaactccttttcggtccacgcatcaacagcggcccctagcagaacgtattgacccaccgaacatacataaagatcatatcggctgaacctctagtgtatacttgtatggacccatttgcctcacgatatggattaagctcaaggctagatatgtgccatcctctaatagctcaat

SEQ ID NO: 29098 - DNA, 605 bp, Oryza sativa
  unsure (1)..(605): unsure at all n locations
ttaaggtgtaggcccgactatcttttaatctatctccatccaaattcgctaggagaatctacagtcccgcctttggtgttggtattagaggttatgtctcgctgcaaaacgttaagaattatgaaactgaaaggagtaggattagacgtgttattacgtgactacgtgagtcgatcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29099 - DNA, 572 bp, Oryza sativa
  unsure (1)..(572): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgccgccgcggccatcgccggcttcttgtccgtcgccggcgcgggtcgcggccgttcttcctcctcttctccggcgcgtcggctgtcgaatggtctcgccgcggtgcgtgtggttttcgtgtacgccatggtggagagtacgttagtgtgatgagctttgtgcttgtcttttttttttcgtgtgtcatcaggagagggcccggatggcgatggcgagggcggcgtcgccgaccgtggagcgggagctcgacgcggcgcgagcagcgatacgccgggcggcgcggcggcgtcgacatggtgatctcgccggcgg

SEQ ID NO: 29100 - DNA, 102782 bp, Oryza sativa
  unsure (1)..(102782): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcaaagcgagaggctcccatcggatggcctattcagtcaaagaaaaggccaaaatttaaattttcaaatttaattttgacattgattttgagatattttcaacgtaatttctttttcagcattgacttttaagtcaccgagaacacatatattaaagttttacctacaaatttatttttattctctaataagccgttttgacttattacgaaaaaagccaaataatgaggcccaaagactgcacctccatcttttgttagcttagcctagctagtccagctaaaaaagacaatgtatactccatatatcacggtttgttttgaattcagcttgatttgatttgatttgatctcaatagaacatttgagattcgtgcttggatcggagggagaggggaggaggaggatgaggagcggaccacagagacacaaaaactgtgcgcggcgtgacagagagggagtagggagcgctcgtgacgacgcgtggggcatatcagtgtgcatctctctgtcgctcggtcggactccccactgccaacccggacccacctgctccctctcctccaaagcttatccgatctctctttacagaagcgctcccattggcccaatgcccatcgtataatcctaacaataatattatacttatacttcctttatattaagtttatttttagctcatttattttatctcataataattttattttagattaaccattgcattcgattttaaaaataggaatttgattgtattggctgtagataaagttatggatagttgcattggatttgatagattatggacattctagtctttttgttttttattggtatgtgcggaatgagtgaaaaatgaacttattctgagataggggagtactacttttttcttttgcgattagacgggaaacacatatgcacatacaccactgcacaagtaacatcatacacacatccatgcaaatgcattatttaatacatgctctaaaagagatggaaacccacctacatgtgcctaatattaattcgtgggaattataattttaattctggtgggtggaatcatgcactcatgactgctcccccataccactggtgttttcccaaaatctcacactattttattccctcgttaccaaaataagttcattcaaaatacattgatttttaagcagaatttaattttatcttaaaaataggttgaatttcatttctcagtgtatgcatcaagaaattttatttccgatgccccttacttatcaactgtcaatattgttaatgagagtccccctctctgttaacatcttttttagatactagcaggggtgatttcattttaaaacaagggaagcattttaaaattagataaataaattattccgaataaaaataaatttatgattatgaaaatacaaagaccaaacatatgtaatcttagagactatatcaatatccaaaaaactattttaaaaaataatgaagcgagaaattattcacaataaacttataaaaaaataagggtcttaaaaatggataggggtttgttccatatcgacggatttaaattgcctttctagtgcaatttattgatttttttttgttgaaaacatagtgattcaaattcataattgccttattttttttcccaaaggaatgagttgttttgtttgtttgctagtagggctgtatcttttgctcccagcttgttaagttactgcttgtgatcgatttgtcatgtttccggcaactagctccaactcctgactcgggtttgttaagtgggcctaatatgttttcgtttggttgtggggtggtattcaattttcaagcctcctgaggttaattgtagtaaatagttatcgaaaaggattttttttttgccaactcttcaactatatatatatatttttatcaaaacacagtgaggggtccccacggttttgataaaaaaaatagaactaaaataatatacaaaatttggcagatgccaggaaagaaaagaaaagtcaatccatgactcaaatctggctttaaatttcttctccaaaaagaatcaaaaggctgaatttcctgaaaaatcttaaatcacaccgtaaagtcttaaaaaacagaggacgaagataacatcatgcaaaatcgtgatgctggtgctatgttgtcaatatcacacactttcattttctagctatgtatgacacatagccagaaatgcctatataatgtcgtacttagccagaatgcttatatttcaaaatggaaggagtacttatactaatataggagtatatactgacaaatttaactgcaaaagataaaaacaattattaatacatttgcatacatgcaatttaggccccattcgcttcattgtttggaagttacaacttcctcatttttcattagcgcacgtctcaaattgtttaacagagtgttttttttaaaaaaaaaacaaccttgtatatgatagtagaagtttcttttctaaaaaatcaattaaacttgtttttcaagtttatagtaattaatattataattaattatgtgctaatgatttgtcttgttttacatgtcaccaggcccggccctgaggaggtcgagctgtgccaccgcactatgccctcgaagtcgagcggcccaaccccatatatgtatgctatggatataggagcccataggccataggaacttagatttagaaagcccgggagaggaagatatacaacttatttgataagaatgtttttttatgtattacatttgttagaaacatcattatattatcagagttgtattaaagagcctatctttctagcttcgctccgggccactaaattgacaggatcggacctgcatgtcacaaagttaccacaacgaatggccgaaaataactcagcttaggtcgtgttctatagtcccctctcccaattttcacttccttgtttttcgtgcgcacattttccgaaccattaaatggtgtatttttttataaaaaatataggaaaattgcttttaaaattatgttaatctaatttttaaagttttctaaactaatgcttaattatttatgcgctaatgagttatcccctttcctatgcaggggaaaagttcccaatcagcatatcccaacacagccttagtagtagtactccagtttaaaacatggcaaggaaggggttgctttgatactggcacacaaatcatttcatgttccaaatttgaatgtgatgctatccagatccatatgcaccccatccatacattataccaccacttgagcatgtgagatagtagaagttggcctgaacacagtcaggactcaggacccagggagagactctggccactgctgttgcctattgctgctaactgatctagcagcagcagtgaactgaaagtctgaaaatcaccctctattcaaccatccatgcatgttttgctctgtttgtgaggggctacttgctttcttttcagcaatgattaggttctgatttgatagatgaggaggggatagatacggtgatgctgatgctggtgtttgttccctggagtacattggggtagtactgccacatttttgttcttttctcaagattcttgtccttgagctctgttttcctttcaccttgttccaggccggtctctgcacctttccaatcactccgttctttgcatttgccacttgttggttttacatttgacatccttttcaaaggagggactttggagggtttttgaaggaatttgatctaaattcaacaaaaatcattaatacccctaaccttctgtcttagtacgtgttggttggatagagacagagtaacatgtcctaagggttattttcgtcggaaacaagacaatgtcaaaaccggtagagacaattgggcataactcatcgggggttgaacgaattgtgccatttgtagtatctaaacaaacctttgtgttagatcagtttttaagatatggacataaacttatacctcattagaaacacataatttcacaaaaattctaaatatagcttaacatgaatcgatacatctacaagaatcaaagaaaaaatcttgacatttgagatgagaccttataatagtttgcgatgaaacaagtcctaccagttggtcccatgcatgaaccatgggggaagaaaacatatggccaatttggttatcatcaaactttgttacaactggtgtattgtttggttagagaatgagcagtcccaccattttatctacggttaattatgagttatagagcttgtttgggggagcttctagctactgcagcttctctcaaaatcagaagctctcccaaacagtctagcttttggtccaaattctgagaagttgcagttgtagaatccagaaaatgaactagaagtcagaaactgtaaaactcaacttttccagatttttagaagctggctaccaaccacctgcttttcagaatcttaagctcccccaaacaggcccataatgcttattagcgaataaaaaataatttatgattacaatttttatatatgtattattagcgacaaaaagccaagctaaaaaaactactatgataaaaaaaatcaaataagttaactctaaaattaagacttaaaatttaattttgactacaactgataggctgaagagtaaatgatggagcatactctctatatcccataatataaggcatggtcaaaattggcacggtctccaaaactaatttttagcttaaaatttctcatatactataaggtttgtaacaacaaaattataaccatatgaaaataaatttaaatctcaatctattgatataatttttaacaaataaaattcatttcatattatactaaatggtggtcaaatgttttaagggttgaatcttgaaatacgtgcgcgccttatattatgggatggagggagtataaagtaataaaacatgttataccacaactgatgatatctaacctaatcacaaacctaacaaactatgatacgtctaatatttgatgcgtgtgataatatgtggcagataattaaaatcaaggacgctacaatgattcaaaacactcagcacactataaaaaagatcaaatcataattactcttagattatactccatccatctcatattataagggattttggatggatttaacacatcaatagcactgtaaatctggtcagagaaggtgtccaattttatagtactactccctctatcccaaaatatatggcacaaccacttttctatcgtcccatagtataaggcatgcatgcatgcatacatacattaattagcatctcttggtcctataaaattgatttgttttaaatcttatatcatcaaatctcccaatcacattgcttgtatgtatcaaggtgatccaaccaaaaagtcaattaaatgttttttctggtctttgtgtatgagtggttatgccttatattttgggatggagggagtagaatgtatcacatttatctaaaatccctaataatataggatagatggagtatttaattggttggcctgtattgtgaatggatgatggagcagttgggggtggcaatggcattgcttcgatcccagctagggcagcacatggaaagcgtttgaccggtcggcaaaatgcaggggctgcatatgcatgctggctcgtttcaattcaattcggcggctcaggtctcgagccccaactacacctcagatatcactagtgatgctctctgcttgtctagctaatgccaccatcatgcatatcttactcgcataataatatatataggaggaggagagtatctcagtgcttggggagatgggacaagaaaagagcaaatttcgccgaattcgaagcctgaccggaccagacaaggctttgctcgcttgtgttagccccacactgtctgcataggatttgtttatttgagcaattgtttaatccttcgttacaacaataaacctatgataacctgttctttgaagatattacaaccatcttagatgaaaaatatataaaactaaaaagaaaattaaggaaaacggaagagtagagagatggtattacaaatgaccgcagccacaatgctaactaattcccgcatgtccatacggatatggataagtacctgtcatcattttcattcctttgatagattagcaactgacatcactaaataagtcaacaattcgaactataaagtcgacgccatttattggattatcaataacctagctgattagtccttctagatcttgatcaaagatgtcactaataaagtagacatcgacaaagattcatagaagaaaaacaagctctacatatctaatagattcatagcactaaacacgttatttcagaaaatcctaaaaacttatgcttggttagaaaaagagatggaaccccttcccccttgccgttggtgagagggagaccagggatgcaacattgtctcgagagtcatggtgtcgacgagctgttcaatatgtgtaatttgtcgtggatttgggtgacttgttttgattttaaaatgatattggatcaatagtagaaattaggtgtatcaactacgggctttacattttggaataaaaagctattatgataacatagaaactccgtgatttttagaaacttcacaattcttattgaaatttgaacatgttttcgctaaaactaatcaatcttttgctaagtttaaacaaattattttttactcgagatatgtcagaatacactggtacaatattgtataggccatactattagcaatagtgcaatttaatcaaatagtggtaaaaatgaaaggtttggttaactagggttggcagtggcgcaagagatgggtggttcgacttgttcaatttgttatggattttgatgacttattttgattttaaaaagatattggattaatagaaaagtttaggtggatcagtattttactgtatttgtaatgaaaaaaaatattaggataacgccgaaactctgtgatgtttagaaacttcatttttattgaaatttgaacatgttttttttgccaaaactaataaaccttttgctaaatttaaacaaattagtatcttttttttttctcaaggtacacctattgggacccaaaaagtataactttgtgagccctacgatctatgtggaaaaataaaatccaagaaccagcttagtaagtgcctgaaggatctatgttcaaatttcaaaacagagtgagtaatttttagaaccgtgacttgaagatcaaaaactatcaagtgcaacaacaaccttctgggagagacatttgctccggaccaacaaaaaaaatatctcgaggtaccggtacctcacggtaccaaattgttttcaatcgttggatctaacaatgcttatcctgcctagcaagatccaacgatcagaaacgatttagtaccgtgaagtaccggtacctcgagatattttttgttagaccggagcaaatctctttggaagaatttgagccaagtgcccaaacatcattagcacattccaaccacaccaccagtaaaacccatatcatatcaattttagatttttttttaagataatagataaaatctggcatttgctttatcagaaactacactcacttataacatatatttatttcttaggtaaaaaaaaagtataacagtatcagtttcaaataactgcaataaccaatgggccctcacaaatgggaaggagtattttacaacccacaaacagacaaccactgatgcagaggaacgcatcataggatctctcatcatactagcgatctgtgatccgtatatatggccactgattttgtctggagaaaggcaggaatatgggtaactgttatccactgcagtgcctgtcctcagtgtcctggatacacatttacacatactccgttcataaatataaacatttctaaattatttaacacatattaagaataagtggaaagactttcgctcatctcttaaatcaaaatttaaagttttaacttattagattccctttctaagcacctaacaattactgataatgcttagattttcgcacattagaaccggtatcttagaaatacttatattgtgcacaaaatataaattacagatgtggctggctgcatccatcagccagcccagcccgattctgatgctgatcgattgatgaactgaaagctgatgatatcatcttatctcaccaacactcgcacgaggcctgcactgttctacacacagatgttgtgcagccgctagctgcttcttctggcagctagctaagccttcaaatttcaaaaagagacacatggaatcatgcttgcgtggattaaacattgttaagcctgcatctcagatgaacaattatgtacatgttgatcgaaagaaagttggaaaacaagaggaaggagccactgcaagaatgcaggaagaatccaagaatttccaaataataatcaatataatgggatagtatttgtttgtcgcattctctcatctcagaaattccatcctcatagcataggggtaccatattttggatgcctttttttttcctctctctctctctctctcttttcttttgccttaagccatcaaaattcaactgttcatgtcagaatttaactcacatctatggtcctaaaaattcaaaaaactttaccatattattaattgttcacctaagttaaattaaaggcacttcaattcttgtcgtaagtgtgtcatttctttacaactaatgtcacgtactactatagtacttaccacacagtactgcctgttcatacagaagtaattataaacacgatttgaaaatttttaatattgcagcgtgactgatatcatgttccaagttcttcctttgatgtatataggcgatatattaacacctaagtacacgtactttttaaatcttgttaactaagtctgacatggggttagttagttctgcactgtactttcaaaactttgggattctctcatgttttctactactgtatttcatagctactactagcttctaacagttaatatgatcatatagcactaatattttactgctactagatggttttaattattttgttcaaaaatttgtggtgctgcagctgtaacaaaccggcatgcatgacgaacgagatgctggctcttagtgttgtccttaaatttgagcaaattaagtagtaggtgaatcttccacgtagtacgacgccctgagattaacattggatcaggaagctaagcatttaatttactgtgtattattactatatcaggtgtgtacttggttttagtgaagagcagctagatgtacttcagagtgcctaatatgggtagtcttacaaattgagattatataataatatatataaaagaaaaatgttgtttgtgccctgtcactgttgtcgatgcttatgtcgccaaaagatgaggatttttactgtataatctactggtaagtatatatactactgacaagggcaatttaaaaaaatattaaaaaaaagtaccaatttaattaagtatatacggatttatggaatctcggcacgcaatgcacaataggtatacagaggcaattctaccgattttagttttatattgtaatatattcaaatgagagggcaaattaatctaaaccttttgatcatttatactggcagaatactgtaaaagttctcacaactgtttataccgaaccacgagttaaactacatttctgtttccagtgttcaatctctcttgtagttttttatcttttcaactttttgtttaaatataataaaactctaaaaacttgtttataaaagattttttttgccaaaccagctttatgtccttttattaagtacctgaatgatttgtaataattatttgagatacaaatgaattaattaaaaaaatataaagttgaaaaataaattaaaaattactccctccatgctgataatattagtcgttttgaacaagggtaaaatcaatctttaaaatctttgactataaataatttctaaaatatttgtcttaaaaatatgaaaaccatatgtgtagtttagtattaaaaattacttcaataaaatcatatatatttgttgatatttctaaatatattataatagaaatagttgtcaaagctacttttttggagaccgtgcccttgtccaaaacgacaagtattatcaatccagatggagtataagaaatttatatatataattttttgagtaaatatttcttaaaactacaaatattttgattaaactatcgcaaaactacatatttaagatgttacatcataaaactacatatttaatattgaaattatcacaaaattactaattctagagtttaaatcactggcactattgttatgttggagctacaaacgttgttgttttgcgataattggcactaaacctgtagattgggatacattttttactttatttttatttttttttacaaccatcctaaatttgtagtattgtgaaaatttccgcgctaaatgtatagtttgtgatgcaatatgttaaatctacaattttacaataatttcatataagtatctacagttttatgaattttacttaactttttagcaaatactccctccgtactcgtaaaggaaaccgtttaggacaatgtttaagtcaaaccttgggaacataaatcatgaataactctcaagttgttgtgtttgaaaatgtaaaaattatatgaatagatttgtcttgaaaaatgctttcataaaagtatacatatatcacttttcaataaatatttttatagaaacaagaaattaaagttgtgttttggagaccgtgtcgctgttcaaaatgacttcctttacgaacacggagggagtaaatgtttagaagtttgagaagtgtgcccgtaaataggatggttccgttcttttctctctctctccctctctcttttaaaaaagaaaagaacacaaaaagttaaactgcttggatgatagggtagtcttggaggatgacatgtcaaaacgatctaatccggaaataagttctgcagaatttgttttcaacatttatcaagttcagaaattataaaaaatcctcttgtactttaataaaatatttcatccacttagggtgtgcattagcatatgattaaaattaaatagtgggttaatatgatttttaaagaaactttcctatattttttttaaaaaaaacatcgttttatagtttgggcagctagcgcgtgagaaatgagagatttgatattgggaatataaacttaagaatacagccttagtagtataccaccacctttgttgacaggtggtaaatgggtaattggcaggtggtaagtgggttaaattagagttatgtatgacataccatctttgttagcagcaaatctgccatgtaagtactgcactaataatttactctctgttcgaatatgatggagatgaggattaggtaagaacatgtaaaacgagaaatccattattacgtgattaattaagttttaatatttgtaaacttaaaaataattctattcgatattttagaaaaaattctagaaagttttcttacaaaaacacattatttaacggtctgaaaaaaatggctaacacaaaccaagatagaatctactgtacatcattcaaccaacagccaaactttctcaaaggaaaaaaaaaaggaaaaatccggtatggaagcatatgtgcaaaatgtaccacgcatcacacaaggagcagagagacagcattgaagctcataacgacgagccgtacaagtacgaacggtgttgctttgcttgctgcactctgcaagatttatatttgctggcctggtctgatctctctgcaagatttcgtttttatggctcctggggtattaccactgtaggtttaaaacaagcaaagcatgggtcactctgctttcttgtggtccagcttcttctgtgactctgtgtgtgtgtgtgtgtaactactgtttctctagtccttctcggtttccttcaaattttggtccacagtccacacacacaaacaatactgttaaggccaaaaagaaaacattgggaaatgtaagggagagggtagagagaacataagggcaatgtggtcactccatgatactatttcatctatttgactatatgtgtttattttgtaatgacaagttttaaagtgatctctactgatagtgtaatcaatttaaatccattatattttcttatctaattcattatatctatttatacttacaaatttagctactagtactacctttttttctaataacagtaaaactcataaatcgatggtttatatcgtttctaagagtaataatactggtggtagaatattagtaataggccacggtctaaattaaagataagttagagtagaacttctgttcaattgttcttttttctctcttctactcttcttaaatactacgtttacagtctaaatttaacacaagttcagacggttttagcttgtaaatatatcgattttaaacagaagatcatgttcaagaaacatatctgacgcttccattcgttttttttttcttttgattaacaggagaacaaaatatcctataagtttacagagacatagtaatccagcagagagagtaattgctgaagcagcagcaccagttacactgaacaaaaagaagcaaaagattcaatgagatggagattgatcatgtagccgaattaatacttttttccatgagcaatgcttcaatcagagacatttgaaaggactcccaattgattagccatatctgcaggcataacaaactttacatattcttttttcccttctgaattgtagtacattacatgagtttcatcaaccaattgtaggcttgttcaaatttcactgtcatccccaagcttaacccgggtgcattggttatttattgttgttgcacaaaagaatgcttaatgcactgtgctgatttctctgtctgcctgttcaacatatctactcggagttaagagcctatttttcagtcaggaccatctctgtgagagagacagccagcacaaacaattgtctgaaatgtgaaagaaaatctgttcatccaggatgcgtttcagtggccttcacttctctgctcagctataactaccatggacaccaaatggttcaagaatttgccaatgtgcaaagctcaggataccatgaaagttattctaccaatggtcaaatgcgataagtttcgaacattgggaatatagaatatttggaacacaggaatccaatatgaatttcatggttctcgctcctgtagaattcatgtgaaataacgattcaaaaaagaaagaattcatgtgaaagttcttatttccaattgggctataatctcttcatctgaaaacaacatgggtagtcaccttgtttgacaactagtgccattgaacactttgtcaataaatcatgtgaaaatttgcactactattaatctgtacaatcgtacatggcacacacaatcatacactcctgaattctgacctgcacctcctgatcacatagtttggctgatgaacaggtgagaattaaacgggcaggcatacttcctgcaattcagtgtgaggaaatcaaagggaatgtgctgttggtgtacctgaaaaaggaaagataatatacagtatacaaactccacaatcattttttttctcagaagcatgtgagagagaaataccttgcaaaaatgtatcaggaaatgtcaggctctgaattcatcagttctctcttcctccattcctcccaacaagagaatttactgcaaaacaacatatggccactccctctcagttctcaaggcacactctatttatgaattccccttatctgaatcacaaatactagtggctgctcctgctcagttcctaccagaattcagattttgcgcacacaaccaaagcctgcattttcatgtgactttgtcatggcaggaagcaacatcataataagttgctgaaatgaagatgtagggaggatggtacagcgatgatggggtgcagcaggaattgaaagcctgggatcattttctgacgaagcctgcagtgaattgatcaagagcctgccttatgttgctatgcaggtagtagtagacatgcaaaacgttggtaaaatgactgcctaattaaatggtttgcaagatcgaaggagaaatttggaagacaaatttacttatggttgcattgcgagctctggattagcattgcagctatgaaaaccaaaagaaaaaaaaaactcccaaatctctccacaggtaggatgaaaatggaacaggtatttcctgcccggccgccagaccagagactcgtgggaaggatatgaaagagaaatggggtttgaatccaaatccacaaaaaatattgattaggatgtgaaaatagttgtattcgtccgtttatcccgtattatcaaacatatatgaaaatttattctgaatcaacctacaaacataatggtacaatggttaatcactattttataagctcacaagtaatattacataattttttccttgatgtatcttctttaaaactctaattgcctccctagacttaatatctatgaatcaaagatacaatagaaattcgttcccgaatctgactcagaggacaaaaaaatatgagataagataaaggatgagtgaaacgttatccgggactatccgtacctggttctaaatttaaaggaaaatataggttaatatacgagaatgtcgtgatccaatcgttcctgacctaattttaccaccacaggaagtcccacattctcctgtctgttcaaaatttccgctacttttctaaaatattgacttttcatttcccatgtcattcgaaatgcatcataatacatagagctaacttcatattggaagagattgatcatttgcatgtaccacttccctttttctccctttgtatacatggcataaggttttatggggaatatgtcacatacaaataatataatccccatttttatacttctgcaattttttttcttgtgatagaaaacccaatttttttaatgagttgagggagttggttttgttagcagagaagaagttgtaaattgggatttatcgggccccatatcagaggtaggcccaagcggggaggaaggaggcaagtggagaaggggaggaataggatacaaagaagtgaggggataaggtggaggaagtggagcccactaacatgtgggtcctactattttttaatcttcttatttgactgatatgtggacccacatattttgttttattttttaaattattaaattttgcttcatgtgtcttgtagatatagaccgagtcaaattagccacgtaagtgccacttcagctgaaatgatagttgaaaccgtcttgggatttattttgcattggttttgatagttgaggaacccgttttatctggttttccggttgaaggacgaaaatcagatttgttgagaaggtaagggacctcagatgaacttattccattgaaaagtcgaatggcaaaaaggtaaacaggcctgaatttgcagcccacaatccctggcccataccaaaccaggcccaaagaaaacgtgccggttgattccccaatatgggcctcaccggcccatcttggcaacagcccattttaccacaggtaggcccaagggtaagcccaacccagtggcgcccttctgctttcattcatagctaagcttccaacggcttcctttcttccctccctcccctcttggcgctctccttttcgcttcccgccctcctctcctccaatcctcgccgcctcctccccgaaaccctagcggcgctcgacgaggcgggcggaatccggcggatgcgtggagcttcgcggctcgccgtggtggtggggagagaggagggggcgtcttccccggttgacggagtcgcgtccgacgaggcgggattccgggagggaggagagcgcagcacggcgcggcggcggagcgagagattcccgcgcgtgagaggagcgcggaggagggagcttcttcggttcttccccgtggagcgcgcgcggctggagcgagcgagcgaggcggcgtcggatcctctcgcgcacgcggtttcgctggggattggtaagttcgtgctcatcacaacgtttctgatgccattctgcacgcagatgtgctggattggggattcttatggcggcttgattgtgtgcgcgcgcgtgggttggggattctacacgcagatgctggattggggattcttatggcggcttgattgtgtgcatgtggggggtacattgcatattgattatgtgtgtcatcttctcgcggctaatggatttgcattctgcattctacacgcactagattgcgggtggtagactctgttcttatcgtgccttccgcggctaatcgatttggtgggagacaccactgtggcacgattgatgcaaacgaatgctaaatatttggattagttcatcctttatcaatcagctctgctcaattgattgttcaatatgtcttaaatgcttattgggtacttcgtaactccaatgaagttataactatgaaatgtttactgtaaatatcttgtattctgttattatggagtatttatcaaagtacattcaattatcccttctatttttttgcttctaacttatgcatgtgtcctctggagataatattatgtgtcctctatcaagttctaatgactttccttttgatattgtttgatgcagctttattgtgatcctatataagtggtcataaaaatggttgttccacattgctacatttaccttatattgcctcttctatggataacaaatgcatccgccgttaccatcttcaatgtgaattatatgcccatggaagacaaggtcaaaggccgcaaattatcagtagctgatatccacctaggtggaaatgtacttcaatctgggtgaggaactttacatgatctatgttctctctttctctctctctctatatatatatagatcaaccgtttgtgcacttactgaattctaactttggttgcaacaattcatttcaggaactattatgctgaactgatacttggtgagccaccaaaaaagttcattgtgttgattgacaccacatctaatcttctgtgggttaattctatatcttgtaaagattgccctacaaaaagtgcatccagagtaattatctactgctttatttttcttaacctaacaggtatttggaggtgactaaatattctgaaccaattacacttgtgtaggtcctgagtttctatgatctggagaattcacagactggacaacttttaccatgtagtgatgttttctgcaaacacctatccagctccacatctattccatgccaaaaagaccatccatgcattcactttgaaaagtatggcactgaaaatttgctccacggaaaaattgtccaagattttcttgtacttgaaattgtcatcaaccattacaaaacaagcaaagtcagaactaaagttcaatttggaagcatttctcaacacttgaaatccttatcctcaagctttacagttgatggtgtgatgggcttggggccatccaatacttctctggtgtaccagctggcaaagtcccaaaaatggaagaaaatgtttgctcactgccttgatggcaaaaggagtgggggcatatttgtgttaggccatattgtgggtccaaaagttagaaaaactcctctggatcaaacaaggtacttgacattgttgtttaatatgactgtggtgtagatgtattcttaattgcgaggtgatattgactatggagtatttgccaacgctgtagttctaggtaccgaactactttgctggaaataactgtaggagaaacttctctaagcctttcagctggaaatgttgagataaaaagtcaaaacatgacaatattggaaactggttctctgatttcttacctgccagagaaagtataccagtcgtttctagattctgtaagaaaattcactttcctctttcagcaccctttgctacattcattttacttgtcaatatttattgtcatttttctgtacagatattttctgatcttgaggatatcagtgtcataaacattggaggctattcatgtttccactatgaacgaaggtaaatatgtttatgattttagagattattttttcttcttcggaaaaaatggcatgtgctttctaagttcttaggaaacattaatggtctatccttttttttgccctacattaacatcatgttccatgagataagaatgtagtttgttctataggtaatctgttcaagtaattagatatattaaattttcttgctgatagtgatagattaactttttagcaatatatgaacatctttttgatacattttggtgttgattgcacaatcttcaccaataaattgttcaaagtcacagaataacctcctctctctcactggtctggggagtggcgacatgttttgacttaatggggctactagtcctctcagtttttcatcttgggaaacagcgtaccagtttagctagatccatcaaacaaccagataactaatcaacatgttgtttttgttagtattgatgctaggtttccagaggttgtatttcacttcaaggaactgcttactttgcgagtctaccctcatgaatatatgtttcacaatatggaggtatttcgtaaagaaactatgctgttgctcaaatatgcactgagaaaatattgtgatgtatattgtgttataaactgtttctctttaggagcactattactgtcttgggtttttgagttcagaacaaaggaatcatcgagagaaggacttgttcattctgggcggcaagttactaagcctgtactagaattgtactatttgatggtttgcatatttgacttggtggtaggtggtaactgcttcttgcgattataaacctgtggtgcaggaaatttgttcactgataaagttgttgtatatgacttggataatatgatggttggatggaccgaatttgattgtaagtcctgtcaacgttttagcttcattgactttcaaactgcaaccagtaaaatgttgttttataccaggttctttcgaatattgtgtgcactgtatctgttcaggtaaatccagtgtgcatgtgagagacgaaccgacaggaaaaatatatgaagttggatcgcacaggatgaactccgatgtgaagtgggatgatgaagacgtgtggagccatgatagagtgaagttggaaactgaacatacaactccagctgataacacgtctgagaaaacagaagttcacagtggactgctttcacgttcaagaaccaggttgcttgcgatgattggtgctctggtgtgttacgcgagacggtcaataaccaagctgtttgcgatgattggtgcgaccatttgttacgggattctcttggccacgttgttcctctgcaccaccttccgtcgatctaccagctggagaaatatgagtatgctgaaatggttgttggctctagttgtgggggagattttggttatcattgtagggttcatagttttgtagacaaagcacatagacattgtttcccacagatatacagttttgaagaaaaagttttacacgtagtggatgacacatacaactgcaaacagccagtttgtatagtaccgcacaaaacactgaaacagggggtagagaaagttaactgtacatatttccttcctgttaaaatttgaatgttccattgattgtaaaactgaaacgaggtttgaataatggttggattgagcctgctgcctgcagtgcaaaatcgtgttcagttttggttgtgaaattggtatctgtaacttgcaatgtttgccgtattcgagaagcttttgtttgtgtaagatcatctgatgctgttcgtcttgtgaataacaataaaatctttgatgatatcattgatatgtatatatacttagaaaaaatgccaaagcattacaacgggtaaatgatattttaattttattatcgttatatggtttagctagggtaaaattcactgtgtgaatttgcatgaatattttttaaagaaaatcatagactgtaattaggagtttgtatttcatctcaagttagcatgcgggtttttttaaaagagatttcttatatgactctttttgtattttcaaaaacaaacaagcttaaaattcaactcaaatagggatatgcatttccaaaagccgcagagaaattaaaaaccgactcaaacgaggtaccataatagtaatagagattactttacattacatcgttatgatctcttgttggctagagatgagaggatgaatgtaacaggactgcaaagaggacggaggaagcgggcgagttcatcaatggtgaatccgaatccgaatgcatcgtccgcgagcagcagcgttcccacgctatggaagagccaggcggcggaggcggcgccgagcgtcaagtagtggtgcacgccggcgacgccgcggcggtcggcgaggcgaagggtgacgacggcggccgtggtgctgagccagtagagcaggtttcccgccaagaagtagcgccaccacatcccctgcatcctcgccgcgtcggcctcggcggcggccggcgttagtgcggttgggccgccgcagagcgggcgtcggggcccttggccaggtggcggcgcaggcattcttggtgcacggcgcggcggcggcagcacgccggcgtggccagcgtgtcgcccaccttgaactcgccgaggcaggcgtggcaccaccgctcggcctccgctccggtgtgcctcgggcagagcggcagcacgacgaccgcgccgtcgtcgtcggtcgccggtggcaggtacagctgcaccggcagccattcttgcgtggacgggcgttcgtcgtacacgccaaggtatcgcacgtcgacgaggaggaggtggagtgcgccgccggcgccatcgccggcgacgtcggtggcgaaggagcatagctcgtcctcgaggcggctgccgtcggcggggaggtcgaggaagcggcagagtgagaaggcgagccagcgccaggggacggacgcggccggcgtgggctcctgcagggcgaagcgcaggtcgacgacggcgtgggcgtcggcgccgctgccggcaggagggtggatgccgaggcggacgacgatttgcttggccaccgcctccgcgtcgtcgccatcgtcctctcgcgccacgccgaccgtgccgatggtgaccgtggcgttgttgtagtgcacgtgcaccacgcgggtcgccgccggcgacgatgccatcgccgtgttccgccgtgtgcggtcgcttattagggatacataataataataataattgtagttgatattaatttgtcgaaagagacgtattgtgttggagtcggttttacaatttacatcagatcgattgaacatagtactacagtaatttctcctgatccgtttagactttagagatggttttcgtggatatcattatcatctattccttccgcccagtaatataaaaaattgttatgccatttttagcaaatattaaggaagtgctgtaggaacaaagcatggagaaacatccaggggtattccggctagctctataaaatgataggctagatgatctaggttcgaagcttcacctcttctaattatttgacattagatcattccctgctatttacatcttttttaaaggaacacagcatgatataaaatatgatggttgggagaataaagtagtaaaaaaagatgtgggtcatctatatggaaccggatcctctgattctacgtcagagggacatccacgtccgatcaccgttcactacgcatccaacggcagcatcatttttaagctcataagcattggattcacaaaatgataaaatagcaagaaatcttagccattgaaatgatcggaatcttctagaagttgtaaaatacagagagaaggaagagtttgagccactcattgcgtctcattggttatctcatgttggcctcccaaagaagcctagggctggcttggcgtagccaatcaacccaaacgattcttagaatatactccatcagtccagaatataagaagttttagagttgaacacagttattaagaaagtaggtagaagtgagtagtggaggatcgtgattggatgagtagtggaggtagatggaaaaagtgaatggtggagggttgtgattggttgggaagagattattggcgaagaagttgttatattttgggataaatcctgatggctaaaaagttgttatattttgggacaaaggaagtatgaccaattaaataattttagaagagggaaaattattctacatataacactttatcagtcagcaacaatcaaaacaaatatgtagaaaaaaagttaacatctcaaagcttataacataattacaattatgatgtgcaattttactagacccaggatatttggaaccaaggtagtagtgaaatttaattttgattcttacaataatatcacaagtttagcataattatagtaaattatttatttccattacaatatgtatttattacatatcaaaacagtatagtatttgtattgatcctacacttccgaccaaatactttcttcgaatattaatcaagtatgtaaaacaaaaatatattttctaatagtgggggataaacatatttataatataatatgatgataattgggttacacagcaatagagataacatgattgcaaggtggtggcccaagcagtagcaaaaaaagacacttacagtcgtgcgaataaaaacaggaaacaccaaggaaaagataaatacaaaccctaagtctatacattaattattggtttagctgaatggtgaaaaaattattgttaattgtaataacagctaatagataggttatagtcgcgcgaacgtgcatcattcactagttgctttgaaacactaacagaaagggataaattgattgcgcgacgaaaaaaaaatatactgttatataaaaaagaatactagcttggaaattgttcacgcttagaaaaaatgatacaggccctcggcaggttttttctttctttctttcttcaaatgcaacacaaaaactctcttatgaacgcgcatggatctttcttcaaaatacaacacaaacacatacgcccatataaacgcgtacatccgtgcatatcatagtcaaaaatgaaccacgcaggcaaattaacgttgttatctatacgctctgtttcaattgacgcactagtgatcaatatcgatacatacattgttcaccaatcctcgatatataggatggtgacgcgcctcgctaaaggacgttggcctctctgcagcaaagacgtggcaaacaacgaattgaatgtgaggttgggaatttgtttgtgccggccggttacaatggaagagaacagcggtggtggaacagtctgatggattttaaacactgcaaaccagacacagatgcatagaattcctagagtcattttagtgcatcgtatcttgaaatcagtaacgtgctaagcatcatccactgtaggaaaaaaaatcatggccagaagtatccgaaaacaaaagggagtatacatttctcgcctacaaacatttcatgcgtacaatgcaaatgtttcacatcgtttgtacccatagagcatttcagattcagcattcctgttagatgggcaaacccaaattcctgaagctgctgaacagtctatgtctagtagcgtccaggttgacccattgatgtaccttgcttcattctacattgcatctcccagataggcgttgcaggcttgcagcacagggtgtcctctaggttagatctattgactgagtctgtagctccttcctctgaaggcgcctgatccggtgttggcggccgcgggtcggaccggagcgttcgcctgcacacctattctgaatcgagcaacaatcttatgtctgtacagcagttaaggaaccatggagcgtgtaccatcgaaaatatagtagtagtagctattgaacatggattgaaatgctttggccatgaacccatataaaaaaggatacacccacattggtgtcttcaggtagttctttccggtggctagcgggtgcaacactgagaggaagtagtacgtgtgtccaacgagaattcccagaaggccagggagtatctctgagccaaatatcacatccaacccaagcattgcccatggtagataaaaggactgcagaaatggagtatattaaccacaatcaaacataatttgctccacaagacttgaaaccaatattgatgacctataaagggcatcgagttctatatatggtagtagtgaagcttaccctcagttggacaaggccatacatgctgatctgagaattcggatattctctgctccagacataaagaagcatgctgaccatgggtactcccaagaaataaatatccaggaagggaatagctgacaatgcctgatccaagcaagaaagatttatatgtagtatgtgagtccaatgaattgaatttttaaggtctgattaagctgctaaaaatacagtacaagctagcactgaccagcagtgatatggcaccaaatatcatcatccacaagaaatcagctgtgcgcttttcaaatgcacccttttctaactgcacgccgtatcttgctctgcatgcccaaacacacaattgattcaaccaatggctgcaagtttacttattgtaatactctgcatgctttcaaacacacaattgatttcaacaagacttacatcatcagaaggcgaatcccaaagttgatagaaaacttgcccaggaaaaagaagcttgtaaatagcctccatatctgtaaggcccagaaacagctcttatattgaaagtaaaatagcaggagtgcaacaaattacaggtgccaattgccaacataagcataggacaaactgcaatgcttgattacattggccaaatgctaaacaaatttgttcatagggcattgtgtggacatacaacactatgcacggtatagaaggtgcatgtcgcaactaagtatcagttagtgtttgagaggggaatggggtagacaaacaaatcctcagtcctaatgtgtttttaaaaaattcgggtgcaaaaacaaggggcaacaataaactgtactggtagataacagaacagacaatatataaacatatgctgacctgaaatttcttgaacacaaagggatagtataaggcaagaaaaggtggattcagtatctggagctggcacagtacagtggcaaagaaacacaatgttccatatgccttgcttattggtggaagtgagttgtagtacctgaaaagggaaagtaagtaatcgagtatccagaagcagctgtagcaaagagttatgactttgatgtgttcatgttctagctgtaaacctcgattaactagtaaaaaattacatccatcagtgagcaaaaacaagtgcaattatcaaacaaaatgaatagtttatcaaatatgatctcgttcaaaatttctgattacattgtaaaccaatatgctaaagcatgctcaaagagagactgtcacactaacagcagaggatctaggatgaaaattaccggatgtcctgtacctatcacagttctaaaactaacagtctagttatatgctaacatggtctaagctaatggaattccaaactcagcctgtgtcccgtgtaccaggcaggtactatatatatcaaggatatcaactcaggttatatattccatatacattacagacgaacagtacttcccacgtgtacccgacaatagaaacaaactaacacaattgcaaagcctttataacagaagtgtcactcattgtcgattcagaaattagctcaatacttgtagcaatttcaaaacccatagcagagccccaagcagttaagaatttaacataggaaaacaaaattcagcaaagctaaatgcattttagaaagcgaccaaattatttcaataactttcaactcataccaaaacagcgaccgcctttaatgaccacagatcataagagcatacccaatggccaatgtcaacccatgctaccaagcttcaagccagagtttattacaggctgttgtattcaccgtgtgcaaaatttatcaacaaataagcttataactatccaattgtgcatctaggttttgaagacagtgaaatacttcaacaaataagcttatagctatccaactgtgcatctttatgttttgaaggcagtgaaatactataacatactctataatttatgcgcattggagaatgaatattagcagatatgtattggagaacaaagactgcaactatctaatttaggtctttactagtggaacgaaccgagaagtgtgcttctgactccaaaatttacaaatagcatcagatacaaccttcccaaccaaaacatcaatttgttccaggcgcatgattgtgctttagcaaggagtgtaaactctacaacgacaatacaataatatccacttgtaaacagccaattcatatacctcaattttcatcaagtttgtaaacagccaattcatagacctcaattttcatcaagtgaggccatgccaaggaatccgtcagaacactcctacttcacagttcccaccaatgctaaaattacttgtcataaactcgtcaaaatcatcaaaagtagtgtattaactaataagcttatatccatctaaagacacctgcagttacaacagcccaacccaaccaatcaacccaaaatcctacacgcgatctctaattccgaaccctaagagcccaagtttaaaccactaaattcattgcgccaaaaaaaaaactaaatacaccacaacgacccacgcctctctaaccttgaaaaatgaaactaatcagctatactcacgataaatttagcccgggcccctcctgtaatcccccctaacccaggccaacctcgagtgatctgagacgcggcatcagagactaacagaaacagatcggggggagactgagggaggctcactctgccggggaggacatctcgtcggcggcggcggtggcggcggcggcggtggcggcggcggcggattcgaagcctcctcgactccttctcgtcggcgtcgtgttcgggggagttcgaaaaatcgaagtcgaaggaggagaaaaataataatggggaagtcgcgttcgcttcgtcgccggggcggaaggttccagagtcgagagagagtcgagaaggccagatgggagaggcgggatgggccgtggatcctggatcggacggtcgaggatgctcggacacgtcgacgtgggcgatgcggggaaggcgattggtcggagacgtggatggggcgctgaggtggccggggtggcgtggcagcgggcctcttagccgttggatcagagtgggatcgcttgatcctacggcaggaaacaggaaacactgtacgagcatataccgagagtgaacatagaaataagaaaaatataagaatataatagaattgtatgtcgaaaacacagagaaactccatttataggataatgcttaccatcggccgtccggccagaaagaaaaaatcgagcgtcccaattcaaaagaacaacaatgtagatgcatggtgaaccagttcgatagatgtactcacaagccaagggagcgtgcatgcaagcatgtttcaaaatttaaattttttttctcttaaactatttatttgaatttctaactaattatattattagattcattgcaattaaatctttgtaacaagatatcacatgactacattccgatgacttttttttactttttaaatgttgcatacattgttaatgaaatgttccaacaagtatctgttgatgtttcactaatgcatttgcaatatttcatattatcttttttatatgtttcagcgaatacttttttatgtttcatcaataataataattcgatgtttcaagctaaatataaaaaatgtttcactagtcgggacataatgtttcatgtaataatgattattgttgcagtcaatactttttatatgttgcatctcttcgaaacaatttatgaaataggttgaaacatctccacaagtgatgaaacaaatttattaagtatttgtacaaaatattttatgtttcatatgattttttttatgtttcactcattggtatttagtgtttcgtgtagtagttgtgattgcttcatttagtaatttctatatgatgtatttctcttaatctgaaacatttcaccatgtgagttgcaacgtgatgaaacaactttccatgaatggtgaaacaatggttgatttttcgaagcatatgtatatttttattaaaatataactatgtgagattttgttataaatatttaattacgatgaatctaatggtataattgaaacttagataagatatataatttcagagaaaaaaattaggcacatgtaatacgagggagagagagtatgcaagcagcagcagcacaagcaacatgtacagggcaggcaagcaacacggcaagcagcagcatatgcagccaagcaacgcagcaagcagatgtgcggcagtgcgtggttgggcgtccgatatttgtgaaatattggacgtccgacgcgtagcatcctccaaatttataggatgctttgttgtttggaacacaagtttttttttaaagaaaaacacatggatgttatgcctgaatacaagattaaaattctatcctatgataacgagagtgataaaaaacaataacgtcggagagcatatgttttagaatcctttagagatcctatattttcatgggaatgtctaacatgtcagtagtggcagatctgaaagatcatggatcctttaaaaaaaccttgtgaaaacacgctactatgagaaggttttttttttggataaaattttttcgctggtggcacagtctgccgcctgtgacaaataaccaatgaaaatagagccttttcacctgcggacgactagccaccaatgagatcccctcttcacaggtggccatgcttaagacggtaacctatgctaaaaaaatcatcacaagcgatgagattacgctggccgccaaggatgtcgtcatcgttgtcactgagccgcaaccctagccgttgtcaccaccatgggctaacgtcaccgagcctgtgtgcagagtcattgccgaggaccgtcgctgccagatctgatggtcccacacactatcgtcagtcgtcttcttgctccccagccagatcgaccaacggggaggccggggtcaccaaatacccagatccggtggcctcgacctcctcattggttgatgtggtggtggtacttgttgacggcggtttcctcatggcaacatgccacgacagtagcgcgattaggcgttgtgccttaacggcgggtgtagggaaggccaaagatggagtgagaaagatggtaggtatgaggggcaaggcaaccgagggatggagggtgaggcaggaccttttaatatggtgaaattttatcgcgagcgatgctctttacctaccgccagcgaaaacctatttttactagcgatgcttaagaggttcgcctcaaaaaataacatgtccgccaatgaaaatcggctttttctgacggcccatgacccataatcctccaatacatttttataaatgtttgtttcgcttctccgccagaaaagaggcggcatcataaaaagttttttatagtgtaaatcacgtgacaaagagatagaaacgtcggctatttaatagatagataaaataacggtttgtctagttaaatcataaaaataattatttaaaaaaggaaaaagtacgaattaccccctcgaaactaggacgacggcatgaattacccccctaagccacaaaatcagtcattttatacgaactagctataccggacgaataatcccctcgaccgaaaatccaaagcggtatcgtcctacgtggcgtgcgcgtgttaatctagtcagcattttttttaaaaatggtggggcccacctgtcatactctcccatctctctcttcccctcttcctctcaatctctctgtcaccgtctcagatatcgttgggagcgacgagttggtggccgacgatgggcgtggcggtggcggggcgggcggcgagcgcagcggcggggtggtggaggaggaggaggggtggtgttgttgcctccgatgaacgcgatggagatcctgcaggagatggtgcgcgtgctgcgggcggacccgcacgcgttcacgtcggtgctcttcttcctgctctgcccggcatcggtcggggtgcctcctgctgtccaccgccgcgctggagggtgcagccgtgctcccgttcgcgcggaagctactcctcgcggcggtggcgtcggggctcccgctcacgcatttcgtcaggcagctggcgcaccaccttgccgccaccctcatcgcgtccgttgtgtcattctcggcgacattcacgctcctcctcgccacccgcgccgccgttgcgtacgcggtcatggcgtctacgcgggcaagccgctcctcgccggcgccaagcctgcctctcctccttcctcgccctcctcgtcaccgcgtgttccacgctcaagtcgatgctttacccgcccgacattgtcgtctgtgccggcctcctcaccgttctcgccttctccgtggtgggggcagggcaagcggcaggcgtggcgggggcgcggagggcgtggtggagaggtgggcggtggcctgtggccagcgggagtgacggtgcccgtgtccccctgctgtcgcgccgccccgctgcccccgtgttgccgtgccccccccccctgtcgcgacggagggcggtgaagtggcgagggtggaggcggaggtcgttttcgcccttccgctccgagcccccggtggccaccgccaccgcgcccgagctcgtcgtcatcgtcttcaacctgggttcgtcagtctctctgtctctctcaccctctctctcgggctgtcgggaggtcggcgcgcacggcggcgggtcgacatggccgtggccgctgcccattcccgtgctctaccgcagccccccgcacgccgaccgcctgtccgcgcgctgctgccgctgcccactgcccgtcgacgcacgcctgagagagaaaaggggggaggggttgagaggtaatgacatgtgggccctatattttcttttatttctttttgttgattggatttccacatcaacgccacgtgtatgccacgtaggagaaaaacagctcaggattgagtcgggggagtaattcatccggtatcaatagttcgaggtgtaatatgtctggttttgtggttcggtggggggaggggtaattcgtgctttttccttttaaattaataggtatgtactcttcaccgattgcagtagcaccactatgaagagtatgctttaaagagcttaatttacttatagataccaacctcatgcattgcagtgggattttatgagaaacattaatctaacagctgatggctcatagacaatttgatccaatgatagaagcaccagtttgatgatgcattaagctcccttatactccctctgtccctacatatataagggattttaggtgatatgacgattcgtagtcttaggatacgtctcatccattcaaaatcttttatattttgggacgagagaagtaccaattaatgcacctaagtggtggttacatagaaatagaggattagttttcatgtacaatattatatctctgactacttcttctctataattcttcatcatttcagaccctgtttagatcaggggtgaaaaaatttggcgtgtgacatcggatatacggacacacatttaaagtatcaaacgtagactaataacaaaacaaattacagatttccgcctgtaaactgcgagacaaatttattaagcctaattaatctatcattagcaaatgtttactgtagcaccacattatcaaatcatgtaacaattaagcttgaaagattcgtctcgtaatttacacgcaatctatataattagtttttttttagggtttagggttaatactgtatgcatgtgtcgaacagggtgaaaagtttttgcatggcaactaaacagggccttagtcaagtgacaagttactctcatggcacatcattgtgtataggactgaaggaaaccctgctgttggcaagttgtcaatgtctttttctaaaatgggctgcatgttatcaaggtcttttgtcgcattgttgacaaacttgtatatcgccacctacgactccacgggttttcgatgtgactttgtttggcctccattatttacttcttcttgtaccacccttgcctcatagttcattccacatagaatttttacacctttagtgaacttccaagttcgaaggcctccatcactaatatcattaacacagatagtgaaatttagagaattatgggaccgagatgcaagggaaaggagaaagggtatcatgagagcagaaaggctcacaagtgggccaacctcattggcatgtaaaatacatgcatatataaatgtattttcttgaaaatgttacattgaatgacgatattttaagggcttattgggctaaaggtttactctctccgtctcaaaatgaacaaacgggatgtgaaacatcctaatactacgtatgtggacaagcctacaagaaatttcatctcttacattatatgagtaattccatatatttacactatatattgcaaatcttactaggaaagaacgattggttgcctatttgatttcttaaaactgtactagataaattaacacataaataaaataaaaatgaaaaacataagtcacagagaagagatagcatacaaaggagagagatagcaatcaaatgttgaaaaaaaatgttacggcatttcgtgaaaaaacttttaattatataaagattttaaaaaagtcaaataaaactctttttcaagttataataactaatagtgtgctactccctccggactgataatacttatcgttttagacaatgatgaggttaaactttacaatctttgattataaattatttttaaaatatttgtctttcaaatatggtaactacatttatagattagttttaaaaagtcatatatttcttaacacttttatacatattataatgaaaaataatagtcaaagttgtttttttagaccgtgcccttgtccaaaacgataagtattatcaacccagagggagtaatagcttgctctggtttccgtgctcagttgtttgataggaatgagtgcagcctcaggctgtgttcagtggtgggtgttggaaacacattacccacgcacggaaaacggaccgcattagcacgtgattaattaagtattagctatttttttcaaaaatagatcaatacgattttttaagcaactttcgtatataaacttttttaaaaaaacaccgtttagtagtttgaaaaacgtgcgtacagaaaacgagaggggagagttgggaactcatgtaccgaacacaagcctcaggctaattcgattgataagggtaggggtgaaaacagtaacggtaattaccggccgaccggcgttcgttttcgactttctaccggccgagccatatggaaatggtaatcgaccgaaacaaaaatggaaatggtaaaaaatatggaaatgaaaacggaaatggttttgctgttataccgatcgtgtccgtatttaccgtattctcgcggaaattaccgtttcttataatatggtaattaccgtattctaaatatgtcgatattataggacatgtctatacttaacccacagcttatagattgaatgactcttcaataaaatctctaacttttgtacatggctaaaatgaagttaatttataatttatatagtataagcttgaatttatgtatatatatataacatacttatgtaaagttaaatatatgtttttatagtttaatgtttccgtatttgttaccggtttccgatctgtaccgacatgtttccgtccgtattgttccgtttccggttttccgatatttccgatatcgtttttgtttccgactttaccgtttccaatttcgtttccgagaaaaatatggttacggaaatggttgaggctattttccgatcgtttccgaccgttttcatccctagataagggcatcaccaatgtatatttaccaactagtaaataaggtgggacctagtaaaagtaggtatttattgttaaaagtttcacaatgtataactagcagggttcactttctcgccggtaaccgcgcggtaaccgcggttaccgggcttaccgtggggggtcggtaacgaaaaccggcggtagggtttgggcaaattttgctcaaattcaaaaatttgaaaaataatcgaaaaaaatcaaaaaaaaatcatggatgtaaagcttgttttgtatgttgttatggtgaaaaaatttcatcaaaaagatgcaggtaaattcaaatttgagcgcaaaacctattgtgaattataaaaaagaaaaaagattaaatggaatgggccaagtatgcacttgttcacgaggcccaataaggcccacaatgggaggaaaatatctttggaagcctctgcttcgtttctctggcgaatcctaccgtttttcccctctctcgcgtagctgcgctcaggaccgaaggggcgacggcgtgcgcccgcgccagatccgccgcctccgcgccggcgaggccggttcccgcgcggtaagcggcggtaaccgcgcggtacgcgacggtaaccgcctgggtcgacgggcaagaggtaatccctccgttttgaaggttttcgcgcggttaggagcggtaaccgtgcggttttgtatggttaccgtcggcttcgtaatctatgagacgatatacgtatgtgcggtaatcgtgtgaaaaccgtggtaaccgtccaccctaccatggttaccgtggcttgaaccgtggtatggtattttttactgtgatatgcatggacatatttggggatttaggtcaatagaacatatttttaccaatatgcatgtgaaatacattgggaatatgagtttatttcggcatttggttgcccgtgcttggctaaaaccatgcatgtgaagtatatttgattgctttggtctatgtacatataggttaaattaaatacgtcatagtatggaagaatttggatgcatgcttaccagtgtacatataattacgtcgtattattgcataatgggaggtatgtttataattagcagtgataatttctcatgcatttgatacagggtggagatgtcagatagtagggaccctgtgtgggagcacggggagaatatcccacctggatggcgctgtaagtattgccatacaaagaggggcggtggtggggcaacaagactaaagcaacacttggctgcaagagggaagggggttacatattgcaattcagtgcctccggatgtccgtgagttcttctgccgtgagttggacaggataaaagatgcaggtgaccagcgtaagagtgatagcggaagaagggttgaagcagcaagggtcaactattatgacctaacaggtgatgccgacgaggaggaacaaatggaagcagccattgcagcctcacgacaagacgaaaactttaggagggatgttgaggagcgtggtggcacttatgagcatggcggtgggagtggatccgctcagccggaggcacggaaaggtagaagtaacccaatcaccaatatgctacgaagggctacgtctcatagggagtcacctgctgtgagagattacaacctagcatctgccaaggcccctgtgcagccacgcattgacacaggattcttcacaaagaaggggaagcaagctaggcaagccattggtgagtcatgggcaaggttcttctttaccgccggcattcctggtagaaacgccgataatccatactttgtgagcgccgttcgggagacacaaaagtggggtacgtatgcatctattaaggaacttctttttttctaactcattgtgcactacttatttcatacgtcaattgtaggtgaaagtgtaccttctccaactggtaacgagatagatggaaaatatcttgattctacagagaaggatgtgaagaagcaatttgataggttcaagaaggattgggatgagtacggtgttactataatgtgtgattcttggacaggtccgacgagtatgtcggtcatcaattttctgatatactgcaatggaataatgtttttccacaagtccattgatgcgaccgggcaaagccaggatgctaactttgtgctgaaggtatgtatggttcatgcaacaaattacttcatcacctgttatcgtcagtgttaggggcatggactaatttttattatgttatctaccaatgcaggagataaggaaggtggtacgcgaaataggctcggagcatgttgttcaaattatcactgacaatggctctaactacaagaaggcgtgcagactactacggcaagaatacaagacaattgtgtggcaaccttgtgtggcacacacagttaacttgatgcttaaggaggttggaaaaatgccagaccacgaaatggtgattgagagtgctaggaaaatttgcagatggctatacaatcataacaagttgcatgctatgatggtcttagctataggtggtgaactggttaagtggaatgctacaaggttcggaacaaactacatgtttctccagagtttccttaggaagcgagatcttttcatgcaatggatggcttcctctgtcttcatgcaaagcaaatttagtgggactttggaaggtagatatgcacatgcatgtctatctagtctgtcttggtgggagaacttagaggcagtagtgaattctgtccaacctatgtactcattccttcggtttgctgacgaggacaagaaccccaatttgagtgaggtacttttgagatatcagttgctcaaaatggagtacgacactctttttgcgaatcaaagggacaagtttgaagcatacatggagatcgtgaacagaaggatgcacgacctaaccaatgagactctcatcaatgccggtaaatattggtcataacataatccacatggcatattatgtaactcttacttaacatgtgccatgttttgtagctgccgcattgaaccctaggacgcactacgcgtattctccaagtgctactgtcttccaagacctccgacaggcattcgagtggatgacggatatcgatacggctgccgccgctttgctggaggttgagatgtaccgacgtaagacgggtgaatttgggagggcactagcaagaaggatggccatagatgggaaaacttcacctggtatgtttctaatcatggaactatgatatatctaattgatcttgatgtattcagaattatgaaatgacatgttacttggcttttgcagcacaatggtggtctatgttcgcctcagacacgccgaatttgaagaagcttgcgttgcgtttggttggtcaatgttgctcctccagtggatgtgaaaggaattggagcacattcgcattcgtacatacgaaggtccgtaatagacttacccacaagaagctcaacaagctagtgtacgtgaactacaaccttcgccttcgaattcagcaagcaaatgcccaaattagggtggaggacgatgatccccttcaaagattagcggacctctcattctatgaaactaacaatcatatcagtgcctggatggacaatgctcgctctaatgcttgccccgaactagatgaagattcagctgagagtgacgctcccctgcctagtcaacttgtgtctgacctagtcaacttggatgacctgcgaaggaccacgggagcttctagtattgctgagtgggctgatacgaatgtaggtgacactcatattgggaaaaggaagactcgaaagccgccaaaagcacgtccatctaaaaaggtaaagggcaagggtccacgatcgactagtgttgatagcgatgaagagacccaaggaagcccagagtaccaagagtccaatgatagtagctcaagaactgaaacagatgacggcgacgatgatggtcaaggaggccaaggcactactaatgtgcctcctaggggtcacacccaacaatcagatcaccacagccccgttcaattcactggtgtgatataattcagttgcaatttcaaccttcatcttccaattcagtactggataattttcttgcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgcctctagctttgaaagtggctatccaacgtatgtgtacaaccgtccccaagcttctgattatcctgctactacatgggtgtatgaatggcaagagcctcagtggtatgctcaattgtacactcagtggcaaacaacatcatcatggacaggtcaaagttgggaggaatacaaggcggggttgctacattcacatggcttgatgctcatgtccacagaggagtacaatatggcatataatcagtagaatgcgtagctatgcatgtccttgtttatttcctttcattcgaactagaattgtaatcgtggacattatactgtggactctacaatatagagtaggtcatgccgaatttttctgttgtataaccacatcttaattaactaaaatactcacattttagtttttttctattatttttttcatttttcttatttcagttccaacataaactaaaatactcacattttagtttttttctattatttttttcatttttcttatttcagttccaacatatcgcggttaccgtcctcttaccgcggttaccgtaccaaaccgtgcggttaccgtgtccataccgtggatttttaattcaaaaatttgaaaacgaaatttgtgcgatttttcgcggtaaccgcacggttaccgcggtaaccaccataccgcggggggtcggtaaccccccccccccccaaaacggtaaggtgaaccctgataactagtcataaggatcaatacatgaagggagagggatgaggatcaatacatgccaaaagaatcaatgtttttttctccttactagtcccttcttcccaaattgatcatcatgtaatagaatccaaaatttctcaaattgatcatcatataactgtatggacacggatttcatcagagtacaattaatgcagtgtgggagaatgtgtacatgctatggtgtaattggcatggagttttaattgatgtatgcattgtgggagaatgtgtgcatagtgtcttgattgatgtgatttaaattattcttcgtcttggtgcctaaacttatatgatgatcaatttaggaaggagggagtactaggttgcagtgctcttgtttggtaatagctatttactggttccacaatacttaggctccgttcgttccagggttcccaacctccctccctcgttttccacacgcacgcttttcaaactgctaaacggtgcgttttttgcaaaaaaaaatattctatatgaaagttgcttaaaaaatcatattaatccatttttgaaaaaaaaaatagtaaatacttaattaatcatataataataggtgctttgttttgtgttccggggaacccctcctcccgaacacagcattactagtacttggtatgaagattaaaatattgcctattatctggtttgggagcacattgtggatgccctaaaccacaaagaaaggtccaacaaaaatataattccagtaggatttttatatttctactttcagtagtttaaaaaccaagtaaacaaataggaaacaataaaaaagttggcattaaataagtatggaaatttaaatttcagctacgagttataagccagtaagcaaataatagggacgaaagtttggaaggccaattagaagtgccttgtaacccagattgagttttttttagcagctcaatcgcttgcaggaaaactctactactttcatgtactctctgtgtaaaaaatcaacttctatctacaattctactatggtccccatcgtttggcatattcatatgcttatcagccaaaatttgaattttcaacgttaaatttggagctgattttggggtttttatcgaagtttattttttagctttgtttttagatcgctaagaacacatatataaaaattttattcacaaattacttttcgtttgtaaatatgccgtttggcttattccactaatatgccaaacgatggctccagtccagatttttttggggggattttaataaaggaggctgtacgctgtaaaaaaaaatatctcccgtactccgtccgtctacaaaataatctaatatagaatgtgaactatcttttttttaaaaaaagaatgtgaactatcttaaaacaatgaaacaatgaatttagataagtgtttgtctaaatccatggttctattttgtgttaattttttttggaaaacgaggcagtacgtggcaatcacatgatgggagtagatgagaatattttcagtttggatccggtcgtccgtccacggcgcgtttggcaggtcaggtgcatgtgccggaccagcgggcgttcgtacaggcagttgcgatccgattctctgcacccccgatcttatccagacgccacgccccaaccaatcgacatcacacggtacgaaccacggcagtctcgtagtacagcgtacagcctccggtttccgcttctttctttccagcctctttcgtggttagagagaggcagttcctgtattttgggttttgtttatgcagagcatcaccgacgcattgccaaaacatttttaatcccctaaatcttttttaaatctttaatagtatgatttaagggataaaaatatcttttccttcgagacagcttgatttaacttattaaaaaaaaacaggctatgtaacttccaaacaaaactggtctctttgagagacattcctgatacgtggaaaggtggaaagcgagatttaaagagaaggaatgttttctttatataatgagtttaggaatattgttggtcgttaattatatgggattgtgagtggtatataggacaattgttagccatgctcttatcactaattaaaaacatagctttagacctaatttaagggtagattaccgagtactttcttcggtctcaaaataattttattttttacatcttattgtcccagataacttcatcttttaataatttaaaatcgttgtactagagtttgtgaaagtgggaggtttattaaagtgagaaattaactatattaagatttattaaagtggaaggtattctaaattctcttacctttgtattggtgtgtataggatgtgtggaaaataagttatgttagacaaagggagtgcattattaccgtggattaaatattttaataagctaactgcacctgttttttaagttagaatattgtggcatagatatgataaacacgtgacgcgtgctaaaataggagcattgcaaagtttgtgaaaatgtatatgtactatgttcatggtcaattgctcgtatttttgcatgtccgcgtcatgaattagccgacacaaagcttgttccttgctcgctacttaaatctgccttgttgactcgttttcttctgtccagcatccgtgggctccaagaaagccatctagtggatcttcatatcgtcctacccaacgatctgatcgctgctggagaaaaagactttaatcccggttcgcaactgttttagttctggttgtgtaacagggacgtataatccggcatatttattccgggactaaagatacattaaaaaaatgtgtggtatgtgggattcaaacttaagatctctcatctcagcccttacgtgcgctaccatcgcacccactacacatatttgatttggatagagacgttttctttttaaactaaccatggaatcatctttagtccgggctggtaacacgattcaaaattaagatctctcacctcagccctcacgtgcgctaccatcccacccactacacacatttgacttggatagagatgctttctttttaagctagtcatgtagacatctttagtccgggttggtaatagtaggcgggactaaagatggatgattttagtccaaccgggactaaagatcgttgggggcctgacatggcctgacagttattgaaccgttgctaaaataatctttagtcctggttcctatttgaaccaggacaaatatgattttcggcatcggaataaagatcagttctccagtagtagatagatttttagacgaaactcgacgttttggatatagagaaagaagatggaggaagcataaataccggtaataaagtggaaattaatgtgatgaatcactaatacagaaaccgacataggtgtctgctgggaaccagctataggtgccggttttctaaccggcacctattggtcggcaccaatacaaacagccgacacctatgcggaaaatagaaccggcacctttagctttgctcgagccaaaaaaaaaatagagagagccagctcgaattgagccgaactcaccatccacactccatcgtcgttcctcccccgagcccatccctactccccttcatcaccgcctcttggatcaagatcaactccaacaacaaactagtcatcaagaactagcgagtagtacaaagcattaagaactcaacaagaaatcaaaaagagaaactcaagaacacatgtcacaggggtttcaaaaaagaacacatgccactggtagccacctcacccacgccaccgccgtccttttacacactcaccgtcgtcgttgcatggggagggcacggccgctgccgccgtcgaggtgtgccaccgctgcctccgccaagcgggagcccgccgccttctcgctggctctcctcccgctggatctagaggaggggagggtgcggccaccgccaccacctttgccaggcaaccactggccatgagagcccgctgcctctccaccggctcccctgtcgccgaatctagtggaggggagctcgccgtctcccctcccaccggatctagcggaggagagggtacagccaccgctgacacctctgccaggcagccgccggccgcgggagcctgccgtctctcgcctcctccccccactgcctcccctcccgagtgctcgccgccttcgctaggcagccatcagccgcaggagcccgccgccttgaccgggcagccaccgcaagagagagaggggagggagagcgacgtgagagagatgggaggggagggagagagagacgagagagattgagaaggataaggcaaagacgagtagataaggacgcggtgggtgtggtgcgctgatggctcggcttaaagttataggtgctcttttttaaaaaaaagtacctataatatattataagtaccggattttgaatgatacattttaagttgctgtgtactatatatacacgagaaaactcatttatataggatttgttacccataagttaaccgcacatattacataacgctattttttttgagtcggaaatagtacctacaactcctccttcaagatccttaggaattacaaagtcaggtaaagttcatacccattattactacacagttacataacctttaccctttttaagacataaaacaggagataaaaatgctcaaactatttttatcacctgacagtgacacgtggcacgccagaccatcaaacccaatccatctctaatctccatatgatatcccatctataaatttcacccaaaaacctctcctcctccaaaaacaagcagcgatcccaaaaatccaagcagtttcctcctctccaaaccaggctcatctccatctccttccccgcgcgagagagagacccctcaccttcgccatggacggcggcggcggcgcgaagaagagccggaacccgcacaaggcgccggcggactaccgcagcgaccgcaagtcggcctccgggatgagcggcgagcccaagaagggcggccgcggcggcaagttcacctgggagggcgccgacggctacgccgacgaggacctcgacctcatctcccccaagaactccacctcccactccaagtccgccgcttccgccgccgccgccgacagcagcagcaacaagaagtccggcgacgacgagtagtaggcaggcggccgccgcctcccccggtgtcgctcggtcggtgttcatcccctcgcaatcctagctgttcttggaataagtgtgtcgtgttcatcggtagtggttggatcgacgggccatggggatttgtagatatatcatcattatctatcttttaactcttgctaatgttggagtcttcggttcggttctttggcctaaaccgatttatcttttatctcagccgtattagcaattgaaaatcctgcactttggttgaatttgctgctctttgttttcctgatgaatctatcgtcttcagtactcatctgaagatatttgcagctctagttgacgatatttactgaagattgcaggttataaatttaccagatactctaggatcaattaatcctagtgctaccaactctgaattatctgaacagaagatggaagtttcatgaatcggtgatctgatctaatcagtatctgcagtgtgatactgtgaatctgtgatacacaaactgacagtaatgacaagtcgctctcgtgattgcggcatcgcggtccattcattgtccaaggccgataataaaaagaatgattatccgtcatcatccagaaccgataaataaagggaaatgattatccaaaaaaaaatcatctatggtctattgcggtattgcctattggtctctcaagtcaactattcttaaccttttttttctgggcagactgattgcactgcactattgcactactggttttgcgactatcttcagtggacagtggcctgcagcaatgagctgagagaggtaggatctaaccaaaaaaaaaaaacacaccattgtgtttctgtgccagaattttgttggatttttttaataaaaaagttcaattcttgtaagaagtggaattttttttggacgtttcaactaatacaacatattaactactacccttgaaccacacttgacacttcccttcctttttcttctttccagatttatttatttatttattgattcaatagcaacattgaagcatgactgcatgagcagtagacactagactgtggtcgccaatttgtcgccattgacgggttaaagctgtgtatatggccgattttaacttgaaaatatagcagaattcagttcaattcagtttttggttgagctgatcgatctcgatttctggcattcgctgacatgctgttaccattgcacatctgtgaagttatcattgagatgttctaatgtattgaaacaaaagtgtgaccgctttgcacaagttttaaactcgtgtcaataccagagtttacaaaaccgcgcggttactgcggttatcatacatggtaaccttttcagtttttaaaatcatggtatgtctcgcggttaccacgcggttttcgcggtagccaccttaccgcgggggtgcggtaaccgcgccaaaaacaacaaggggaatcctcgtcaatactcaatagttgtgagttctgattaatcaattcatgaattttcagttgaagagatgaaaacttgtactgtaccttttagaacaggggccaactgaaggatccaaataaaagagagttccagctagctttgattctaccccttttcaatgagaaaattcgacctatagcacaggaaaaaaagcggtaccaaaaaatagcataaaaagttcccactttcgatctatagcataggccaccattttttttcgcccggtagcacttccgtcgcattttgaagtaacggcgttagatcggagtggagaaaatttttgtcggactcatttacccttcgttccccacgtgtttggccgcgtgttcggtgacgccggcggcggcggaggtcacggaggagtagaggccgctgcttaggaggctgttcctcgaggaggggcggaactcgtccgtcgggtcgtcatcgtcgtcgtcggacatcgccgagctggacggcatgtcgccggacagctactgcatctgggtgtcctcgccgtcgccagcatcctcgccgtcgcgccccccacggaagagcgggtcgacggggtccatcacgcggtggcgccgcatcagcgagctcgtcatcggccgcagccatagcgacggcaaggagaagttccgcttcatctccgcgctgtcgtccctggccagggagcaccccaaaccgaagcccacgacgaagggcgccaccgccaccaaaccgcattcttcactgacggcggcaaagaggccgctcgaggacgaggacgacgatgatgacttgggcggccctagtgtcaatgtggatggatgtgggccgttgtatgccctcgggctcatcagctccgtcatcgccgacggcgctggcaaacaccgccgtggtggtcgtactcggcgtcgcagcccacacctccgccgtcctatccctgctgctgctcgccgtcgaggttgccgcctacctccaggggtggaacctcgaggaggtggcgtcactccccgccgtcgacggcctcttcgccgcgcctccattgccctcttgctcgggaagaagggcaaatgagtcatttttcatgtcgactcacatgtttggatggcaaatgtgacgggagtgctataaatcgcaagaaaattggtgtcctgtgtttctggtcgaagtagaaaatttgtcgtgctattttttggtaccgggttttttcctttgctatggatcgaatttactccttttcaattgtaattggaaaatgtgtagctagatcatgtcaaggtgctacacccttttccaattgtgcttttaaaaaaaagaaaaggaaaattgtgtagatagatcatgtgaaattacgttgagataatttgaaattataccttttcgacgaaaaccaaaatattttgaggtttcggcacgggatgaaagcaatttctgagtaaaattctacacttgaccaaaacttaaattcacaatagtaaatctaaacgaaattcatcgaaacttaggtgaactctaatactagggtaaaaaagaaagttcatcccacggtctgcacagtgcatcgcaggctccccatcaggaaaaagaaatagaggggggcctcatttcacgctcgcagaaggcaggagaaactcacccttgtcaagatagcatggggcaattctatttcttcatgttggacatccacatagcacacaaatctaagtaaacaacgataaattattaaaaactagtggtaggtgagaaactggaagagaaattaaacttctaagaaatcttttatatcaaagttagtgataggggagcatagaaagactaatgacttatgttgactttggagcctaatggtagaggcgtgtgtaaccatgagtccaccatcatagtagaaaataatgattttgcaggtatttactgtagcaatgttgtaaacacaggaactatgctaaacggtagtatatcgtattattatttatttggtactgtagcatactgtaacgatcaatctcgttcgtttgctattcacctttaactttaacaagtcaggggatctcaatccattaacgtagaggcagggtttatgattccgatgaaatccgaccagatttcacgaaatttcgacgtttcaacgaggcttggaagtagaaaccgtctgagatttcgagaagtttcatccaaattcaaatttgaattaataaaaaaagaaaaaaaagaaaaaaaaacttataaatactatgatatttataaaacctattgggatataattttttgaaaaaaattatgtattgtgtgtatttactgaaacttacatcaggaaagaaagaaaagaataaaaaattaagaaaaagaaaaacttacatgggccaaaaccaaccggaattaaaaaaaaggaaaacacttactaattgaaatttcgatcggaatttcggtaaaaccgaccggttttcgagaacttgtcggcaaactcgaggaatttgtattcaaattttagtttatgaaatttgttcggaatttaccggttttctaccagatttcatgaaattctgaataccgcaagtgtctggaacggaagggcatgtcagaattgtaaaccctgtgtggaggggtttttggatttccgatttaattaaagaaaaagaaaaacagagagaaaaagaaaaggaaaatcgtcggcgatccatctcgcttctgccatcccatccccgcccgagatccatgccggcagtccactcgcggccccccccaagatccacccgcgcaagtcacagatcgcgccggccatggccatcggcggcgacgcggcgagcatggtggccgtcggcctcgtgtggggcaccaccaacgccctgatgcgccggggcgcgcttgtctgggaccaccgcctgcgctcccttcccgccacctcctcctccgtcaccggcgtgctgcggcggtgggcggagctcctcctgacgtggcagtactcggcgccgttcgccgtcaacctcgcggcatccgccgccttcttcagcctccttggcgccgccccgatctccgttgccgtgcccgtcacgaacgccaccaccttcgccgccaccgctgtcgccgccgccctcctcggcgagggcacgcgcgcagcgcccgcagcgctcggcacggcgctcatcgtcctcggcgtctgggtctgcatctcctagcacttcaggttgtgaaaagggaccctttcttgggaatttctgtactttctttttgtttctcttaaaatgatggaatagtatgtactcatgtttgatgaaattttctgtgcaaagcttttggaaatgatgaatgaattatggtcgaatttattcagcacagttgctgtgcttggaattctggagattgagcaaacaaaatgtgagcctgtctcagcaagcgattcttggaattccatgatcagtgtagatgaatcctctgaagaagatccgagtaagtgacaggttattgacattctgcagttcacaactctgtttgcccccctgactcgagctagctaacattgatgccaacttgccaagtgtgcattcatgtattttcacaaacatttgatgatcttctcaatggcattcatgtattttcagaagttttcaaactacacaaaatgcaaaatccaaagagagtgtagcttaactcaggagaggaaaatttctactctatgatagaatcttatcagccatttatgctagtctaatcaatagttcattactgaggctaactagttgtaagttgtaacttgcaaacactggttttgtgcacacaattaattgtcatgattaaactctaatgagtgatcttgtgacttgtgagcatgcccattctactgtctgatgtgaatccctatcaaaggagcatggcccatcaccatgagatttttttcagcactttgacaaggatagccatagaccagtacaagtgtacaactgaaatgtaagaacaagtagtacttgtctgtaagagattttttcacaatgattgacagcgattcacttgtaatatttatcctatcctttgttgactcatcctcattgtgtccatgaatctacaccaactaccatggattacgctgtcaaattgattctaattatgtgatcatgtgaatacagatgcagtatataaatgcaatatgtattgcaatcttgaaaaggctggcaataattttgatatgcaacaggtaataagctggagggctcacatgcatctcctgcctccatcctggacacaccttgcaggatggatggctaggattgatgatcagcaagcacctcctccaatggattatggatgtctcataatcagagtcaaagcagaggagaaatcacaaattcacaattcacaactaccagcaggcatggggagacagcatgcatggttgatggtccttggcagctatcacccaaaaattcagagtgagatgtttgctgctgcatctgcaaattcaagtacatgggctgatgggcacatggctgcatgatctgtatatctgcaagtactttgtggagtttgtagcaccacggttcatagctttgaccacatcaaggtgctagttgcagtgaaagttgtgaagtggatgttgcagttgatttgtggatgttttgctaccagggcagaggaagagtagatacagaaaataaaattactccctccagataaaaaataattacgtttgactttcttctttcatgttccttatagtgtgactttgcgcacggtttaataaaaaaatgtacaaaatcttttttatacagcataggcttgtcacggagcttggtgttactgtatgggcttgtcgacaagcagctgatatgataatatacttacctacatggcacttgccatgtcattcgcgttggtcttcaaaaggtttgggtttgaaaataaaattttatagcatctatgaataaaatattattttctaaatgtttaaataatagaaacactagtagaggcctggtcactcaataaattatattttatctagaattaagtagctagtcgtgtaataacataaaggactagaaatattaacttattgcttaaaatgaactttacatgtacaatggagatgctcttggacccctctaactgtcgaatgcaaacaaaccattgatccatcgaagtttttggggctttcatattacgcaaatgtatcgggtttgctctttagagcgagtactgtatgcatccaagtacttacccctaagtgtcatgaagctcacataatgaggtggagaagagaaggaaggaaagaggggagtcatcccttacataaggagcaacctctatacaaactccaagagggatgaaatgaagggatcagtgaattaagactaaataaataaaataaaattatcatggtacattgggacaagttcgccaaaggcaatatattgtatatattacttcttaattaagatgactattacctctattataaaacttgatattaagcatacatccatgctgcaactcatttgcaacatatgggagccaacattttggctccttggctgctccgactgatacaacagatactacttttgtgtagttgctgtgtttatttttttcgagcattgtgtctcctcctctcccccctcctctacagctctaggctataacccgaattccctccaaattcactgtattagtgcatcgctttcttatttttgtatgttgtatccattaagcttgagacatttgaaacattaaactgaatctctcataacaactctcttgttagtttaagatatgcctaacccttcacttcaattgcagaaagtatcaggggctattcaaaaggctattctatgactgcggctattgcaacaagggtttacctttttattttcaaagtgaaaattgctccttatcggtttaccgaataccaataaaaaacaataaaattttgtcaatgttgcattaaaactagctaatactaggcaatattggttgaaagcatttgggaatttcctaactgtgccgataccgttttcataaaactaatataatagtaatatctttaccgatttaaccatttctaaaatttagtctctctaatttctatgagcaccgcattaaaattgacactaaataattaaattcatacatataaaaatttcctaaccgtttccctaaaaaatgataaaaaaaataatgtttcagatcattttcaacttttttcatcactaccgggtgaaaaccgatcggttttgtgaaccctgattgcagcttgctattgaattcttggttgcaacaatattcctgttggttgcgacacagtgataacccaagctacccaaaaacccctaataccttgtgaaattccgataatataatttagttgataactatagtgctaaatttaaaatactcgatatgccgtgtgttttattatggaccaaaatataggcacacattttttttgtcaaaccgctaaaatgcagtagtacctatataccatggaaagccatataatgtgtgcaaatcaatgcttttttcatgtgatcattggtgaaaatactttgcttaagacatccgatgccaaagaaaatatcggatgccctttgcatgaggccccaccgcccctccccacatctctcttgccatttgcataggacatgttaggccgtcttgtctctccccatctctctcaccattttcatcaacccgaaatacgacgctcgggcgtcaagatgtccaccactgcggctataatctccggcgagagctctgtccccgtccttgtaggaccttggctcccatccacctcctctttttcctccttgttgccggtcccctccatggatcttcctccctccgttctcaatcctctccatggaggaaagtttgacggcttgacacaggcaggcggcggtgaccatatatgaaggaattggcaaggtggtggctgggctccgatgacggagaatcaatagatgtaagcaagagagacatatctggtggttggactagatgaagaaggaaggaggtaagcttttttccttttcgggagttttttttaagaatgttgcaacatattatttcgctctatttttattgtatgttgcatcttggtgtatatttgaatgttgcgtcttggtgtatatttgaatatttcactctatttttattgtatgttgcacactttgattctagggtgttgcaaccaaattcttcgagtgttgtatctcgttgcaacattttcctttaagcagtgaaacatttgtttaccgaatgttgagacatctgaaacattttttatcgattggtgaaacatgtgaaacaattttttacataggatgaaacattgtccgtgctgtggccctctccgatcattggcacagattaatttggcttcaccatgacaaaatgagtaggtagaccgtgagaagaattagggtgcgattgagacgtttttaattattacaagaacatctttcgaatatagaaatatactaagaaatcaggagaaaaaatattttggtacctatctaatacgatcatctaccattccttcccccaaaaaatagccagaaaaatacattgcctaattcaaaaaaaaaaaatcggtgcacacagcacaggcaccgcacagctatctcggcaaaatggcctttcctcttttctcctctcttcgggccttccctttcccttccctcccgcgactgactttttttcttttttatttttcacctccctcccaagtcccaactccccactccagcagcacacgcgcgttcccccccaaattccaaaatctcgctagggtttccccctcctccgctctcacactgcctcgcctccccggatggacgagaccctagcctccctgcgccgcccggtaaccctagcccctccgccgagctctcacccccctcgaccgctggattcgccatttttttctgattttttttttggatgaattgcacaagcgcgggcggccgccgcggccgcgggaggaccacttggccgccgaggacttcgaggaggagggggaggatgaggaggccaggcggaggcgctcgcgcggccccagacgaagcgcaagcgcgcggccagcgccgcggccgcggccgcgctggaggaccaaaccctcatcggttcgccttctacccgttcttcccattctcctttgcgcgttggtcgccgtggtctcgctggagtgtgggggttggttgtgcttggggatgcactgcttagtgtgtagctgctgagttgacgagagtgagagctagttcgcagtgacgcgggataaattagtctatgtggctctctgggtggtgaattggtgattcctaaggttgaactgaggttgggctagtttagttcatcaagcagtgtgattttctgcttttgtagttggtctagagaattttgttaggattgtttcttttttcaatcaggaaattctaggttagctgaacaaaagaccattgatttcgattggactgttagttaccttggtactccctctgtcccagtttagagggcgcgcgtaaatttttttgacggtttaccagtttagagggcgtggttcgtttttcactgcttttcttcctggagtaccctccgcatgcatgcacatgacgcttggatatgcccgctcaataactgatcaagcgacgcaaccggccggcgcgtggagctgcacatgtgtgggaccacaaggttacatgcatgcagctgttactaatctgcatgtgtttggatcaaacccattttattaggggcagtttaggaaaaaataactctgcatgtgagctggtctcggtgaatttatttgtgcgccctctaaattgggacggagggagtactatcacctgttactggttcagtaccctatcaattcattggtagtgccaaaacctagccaaattttggctctaccaattatttggtagggtagagttcagattatatatgtttgattagctaccaatttgtttgatatagtgaagaaagttctagagtgttgccaaattaaatatgggcattaccgctttggctctaatccaaacaaatcacactactatttaagctgccaaatatttggtaaggcacattttggcatcaatccaaaatgacccatagtatcacaagccgatcttgaaactgcatggagagtcatgatttataaagatatgtgctgacctcagctggggttgccctaaccatagtcctgccagtactgtagtgcctgcccagaatgatgccagaggcttgtagattatgcatcgagatttaaaagatcctatcataacatgctgctcaaaatctatgacttagacacttactcggcaagttattttatcttcaatttgtgtcttattcctaaaaacttggaacttgcagatattattaaacataatggcaggcttatcagccatgctgtcaaaaaattggtcgaggattatgaatcagatccaaaatctgtgatgtttcagatattagcgatgctatttgaggtaatagatgttaacttcttaatgcagtttcttttggttgcttatttcataaaccagtgaatcttataatgacaggcttgtggagctaggcataacttttatgcagactacctgtatgaggcagatgtggatggtgttgtgttttcccttgtcgagctagcaaaaaaggtatcctgctgcgattttccctagaagagtgaatggagaataattttttgcagccttgtgattatccaatgtgcatgctatgtttatcctacatgttactaatcttgaaatgatatgcaatgctctcttttggatgatttcttttaaccttaacttgaaaatagggaatggttgaagataattacaacaccaaacagaaggatctcaagaacttcaaagaaaatcttgtttccttttgggataccttggtccatgagtgtcagaatggccctttatttgatggtagcttattccaaaaaatcaaagactatgtggttgctttgtcatggtaatttatctaagctataccttttattttctttgtgttagacacttggatgcatgtatctaatgtgctgtggtgtatttcagtactcctccaagggtttatcgccaagtagcttcattggttgggctccagcttgtgacgtccttaatatctgttgctaagactctcagtggacagcgtgagaccactcaaagacagttgaatgcagagaagaagaagcagactgatggaccgattgttgaatctctaaacaaaaagctagctcatactcacaaaagcattacttacttggaggaactaatgcggaaaatattcagtgggtgaggacctgaacttgcattttaatgtacactgtttactttcatatttctcaaatttgccattctgatgtggttcacttactggtatctggacaaaaatatttgcatgtggctgttttctgtacatatctcagtctactatgtccacttaatatattattttaccacttgcaggttattcatgcaccgctatcgtgatgttgaccctgagatccggatgtcgtgcataaaatcacttggtatttgggttgtctcgtacccatcacttttcttacaagatatatacctgaagtatctaggatggacacttaatgacaaggtacatattttagttctatgatttttggttgaaccttgtctgaccaatgagatgtgcaagttttgttatgtcattttgtgcaatctttgtttttgtagaatgctggggttagaagaacttctattcttgccttgcaaagcctgtatgaagtggatgaaaacataccttctcttggtctctttactgagagattttacagcaggatgatccagcttgcagatgatgttgatatttcagtagctgtgtcagctatcggactcatcaagcagttactgaggtgagttttgggcaaaatcttttgcctgtgaagagatcatttggtcactgctgggcaaccttacttttttttaccagagctttcctaagatatggtagtgagtttggggtgtataactttcgattgtacagtttgctattagggtttttgtagattggccatgccgctatgttttgagaactaaattttcaagcaataaattgtattttttagcattttccagcataatggaatcatggattttagccaggaaccggtgaattagcttcctttcatcaaataccatagagaaataggggatagttcatcactagtgttatcattagctttaggatgcaatagcgcagttcaataaatattctcagtattcacaattcaaaaatatttttgacctgcaccattgtagaaatacattcaacatgcatttacacaagcttttgatttggaaccaccataaatactcgcttgttgaatgaaaattggtccaaagaaatttgcagaaacacaggcttaaatgtgcactcttaattcacaataaaatacataagagttgcatattcaaaacaatgtgctatggacgaatggatcagtacgagtggtatatggtatttgacttggcattaatctactcatgtggtaattgattgacttgttgggcaccatgtgtgccttgtctatcctgaactttacctagcaatcacccttgttattatttactaatatcagtatttgtcttaccaaagtgtgctaggggaccatgcatttttttcagctttaattttttacatgcattactgcagcaaaacaaataacttttctgtttattccttttgcaggcatcaacttttgagcgatgatgatttaggtccactatatgatttgcttattgatgagcctccgctgatcaggcgtgcaattggggaattggtttatgatcatctgatagcacaaaacatcaaaacctcccagtctggagcaagaggtacttgtctctggaatgtttctgcttttatgccaccttatcttgctatcaaataactttcttagttcatctactgattgtactatctaattccagatggaaacaatgattcatcagaggttcatattggtcgaatgctgcaaatcctgagggaattttcagatgacccagtcctgagctcttatgtcattgatgatatttgggatgacatgaaggctatgaaagtatactcagttttgtttcaacttatattatcagtatgacttaaccgctataactgcaatgtcctattctgtaggattggaagtgtataatctccatgcttctggatgaaaatccattaaccgagcttactgacatggatggaaccaatctagttcggatgctgcgagcctctgcaaagaaggctgttggggaaaggatagttcctgcaacagacaatagaaagatgtactacaataaaggccagaaggtgtcaatgtcatttctgtcgtatcatatgttgctgctgcaagttgattgtttatttcttgatcgtatcatttgttgtattgcttgtttagtgttgctgccttagtggttatttaggacttgtaagtactatgcgtagaatgtaggtttattttgttggatattggcaatgtcctacacctttgaaagttagtctgacaagttaatctcttaaaagacctgtttgctagatacatccatttttaaatattacactgttagactttatttggtcaaacttttgaaacattgaccatcaatatctctcaaaatattttgtttgggaacataaaaatcatattggtagtttttttctttaattgtacttttacaatattaatttttttagatattattgttatattctaatagaaaatagtggtcaaagttgcacacccaagaccaaagaaaatcaacagtgtcatctatttaaatacggaggtagtaattgctagtcatgtagattgtagttctgaatctgttgcctgcttgttgaatctggtttgtttgtcgtaccattgttcatgtatttgttgaattgttactgaagcattattattctgcaggaaatattggaaaacagcaagcatgaaataactactgctttgctgaagaaatatccacagcttttaagaaaatacatatctgacaaagctaagatatcacctctaattgatatgatgatgcttatgaaacttgagctgtactcactaaaaaggcaagatcaggtcagttgaatagctatttattcttctgcacaaactttctgcttgacttgttgacagtttcgtgtacattttggttcagcatttcaaggctgccatagatctcattgcggatgccttctttaaacatggtgacaaggagaccttgaggtcttgcatcaaggcaattactttctgttgcactaactgtcaggcagatcttcaaaattatgctgaaaacaaactgaaggatcttgaagacgagttggttttgaaagtcaaaactgcaatcaaggaagtagaggtatgcatgtcttattcacagtctctttgttttaaagccatgaaggtaaatatgttacaatctacattgcaggcaggtgatgatgaatactccctcatggttaatttgaagcgattttatgagcttcagttgtcaaaacctgtcaaaaatgatggtttatttgaggacatgtacagaatcctgagtcatctaaaagatatggataatgaggtatgaactattaccttgattagctattactactccagtctccctttgcagagttcactgtcggtactgtattagctaatatgttcatgttttaaataattaggtgaagagctttctcctccttaacatgtaccttcaattagcatggtgcctgaatgctattgatggtgaaaacccatctgaagcttccattgacgaacttttatccaggcaaagctctctttttgaaaaactctattattacttggtggttctgcctacttatcagaaagagggaaggagcaccactatactttcctgcagagtaagtcttctgagttaaacattgaagaaaagaacacatttttttgtattatgttgtatgctgatctgcaggctgtatgtcttggctatgtttagcccactgacttgatattgccttgtttttttgtaggtctgtgtcattactgctgagatgtggtgcctgtttaagaagccaaaatattcttcaacaaggctcgagagtttgggatatctcccgcaactagatgttgtccagaatttctggaaactatgtgaacaacagctcaacataccaggttttgatgttacacagattctatacttcattcgttgtatagcttataaaaataaatttctaaataaaacctcatcatcatgttggtgctactcttttaattgaagttgatcatgttcatcaacagatgaaatagaagatgaagatgcaaatgaagaatatattgaagacacaaacaaggatgttgtcatgattgcagctgcaaagctagtgctagctgatacagtttcaaaggtctctgctacgttttctaactgtaatgaactgttaggtcctcaagcaatgttttcctactacatcttctgttgtaccataatttggtcaccttggcagcttcctattgtcagacaaactaagttttcaattttatttctgtgtgcaggattacctgggcccagagcttgtttctcactatgcatcccatggaacaagtactacagagataatcaaacatctaatcacctcgcttcggaaaaatgctgacaacaacatgggtgccttatttttcgaggcactgaaaagggtaggtattttgtcccaccttcaaatgcacacaattattatttattatagtaactattgagtaattatattatgttactgattgtcgattaggaatttacttgttccagcttttacaatgtttaacaaactttaaaggaacttctgactttgtcaaccatatcttgtattttggaagtattttgactaaagacacttatactaaactcacttttgtattagaaacttttgctttatctgcttttaactgattttatgtgtgtgactttcttttgtaaacttttctttattttcatctaactagggatatgagcggtatatggcccatgtaagtgatggggaaaatcaaaccctcattggcaagtcttattcagaatgccaagatcttgctggtcggctcgcggggtcctatgttggtgcctcgcgcaataaaaacaagtctgagatcttgaagataatccaagacggtgtttcttttgcatttgtggaccttccaaagcaattgtctttcctcgaggctgctctactgccatttgtttctaaacttccatcgtcagatataccagacatgtatggcatttactcttgtcatttatgatgcttccatttattttatttatgcacaattttcatttatttcattgtatgtagcctgatagatgtacagaagaggactcaagatactaatactaatgaagatccaagtgcttggcgcccgtactttacgtttgtagagcatctacgcgataagcatgcaaagaatgaggttttgcagggtatgttgaactcttcctgaattttcccttttttatgttacataactgcaaatctttcttattgaaagtatggccgattctattgtttcctatccagaggaaaaggaggaaaaacctgtaaagcgcaggggtcggccaaggaaggttagagatgtacctgcaaggaatctttttgatggacacaagtctagcgatgaagagtctgttagtgactctgatcagcaagggcatggtgaagacaatgacgacgatgacgcagatcagcctctgatcaacacgtttaggtcttccgcatccaagctaagatcactgaaggtttctcagcaaggaacaagcggtcagaaaggaccttcgagggcatcaggtaaatggtcaaggattttgctctttccacatcagtcggatgcactgacgaatctacagcagcaaccatggtttctttctctgtttccattctatttttgtgtggtgttcccattttctaattacagtgtgtattttcaggaagcaatagctgagggcacgcactgacgtcgttacgcatgactgaacttggcacaaatgaatgcagcagatttgtggcgttgtagatgatttgtacctaggtgctcacccttttggtaaacaacgtgacatagacatttgttaggtttttaccccttcgccatgtatattatgttcagtaataatatatgtagaaaatcgcatgttgcattgtaccaatttgatcgatgtatttctcctgggttccgagactaaagaacacttgcatgcgagagatagggagagcagcaaccattttttatttattcaatggagaatccgaaccttggattggtttgcatgggaaccaatgagcccggcaatccttgcataccaaaccctccattctaaattgatctacatatatatattttttgaggttatttctaaatgatctacatatttgtgttcattcattaagtctatttgttatttgtgtattggagtaaatagacattgatgcatgtatcacaggtatttataacccacatgcaatatcttgatctgctattggctaggaaatagtgaggatggtgcatgcatcgagtttgctgctagagtaaatatagtacgagagagttattagcttttcttgattttggtatacctatgaaatatgtagatcaatttggaatggagggagtaatgattactctttcgctgtcgctcctcttcgtcgagccgctgccatccctcccatgccgctgttgctgttgtagccactccacctcgtcgagccaccgctgaccgtccttttcatctagccaccgttgcgcggcagccgttgcacaaggagggcggcgggaggaagttcctctcaggccgccgccgtcgctcccttcctccacaagccagcgtgccgctccctccctccgtgagccagcgtcgagcgaatcttctccctctgtgcctcgcggccgctccctccctccacgcaccgccgtgaacactcggcgagagagagagagagaggggatacgggggagagaagggaatagatatggatagggtttggtcgatgatattttagtcattaaaaagtaattatattgctttctttttgttgaatgaaaagttaacggtactatagtactatagaaacagggccaaacggagcactcatttttaaaaagtatggttaaataagcaaactataaaaggtaaggtcatattgatagttaagcttcaaaacagggtcaaataagtaattgtccctattgtgtttttgaatagcaagaaaatagcgctaagtcaaacatttttaactttattactaaaaaaaagataaaaaagataaatcatatgagaatggatattactggatttatcattaaacaaactaccgtaagatgcaattttttgaaacattataattttttaaatattattggtcattatagtatcttgaagattctatcaaagtttaaaaatgattatattttgatacggatggagtactagttttgggttatcgcctggtaataatcactttagttagtaccggtttgtttaataacattcacaatttgttgtgaaagcatttgattgaatttaattgagttgatgctgatgttggatgcggcattaacagaacagaaactgtcaaatggattagctgaaattaggtgcataatttctttcatagttattattataccctaccacgaaaaggcgagtgggtttgctgaaagaatatagaacatgttcttttgcgaattctaggcaggcaaaaacggaaattgcaaatggataagcaaaataaaaaaagccatttaggctgcttccgtttgggagtgttgggaatccttctcttcttgcaagtaaaatgtagcgatggattagtcaatattagctaaaaaatcttaaagaaatatattaatataattttaaagtaatttttgtaacaattcttttacaaaacacatatcgttttaactgtttggaaagtgtgtgcatgaaaaacgagagtgaaagttaagaaagtgtctaaaggatcatacatcacccaagaatcttgggaccattgaacaacacgcatgtaaaacttgtgtttcgaaagaaccaatacccttttaaccaataatgttattaacaatcatgtggtgtgcattttaaaatgttcatgtgttaagcatgtgttgtaacctactaaacttgcatatacttaatcgtactttctttctttgtcgtgccttaaaaataaaaaacacaatataagatcaactttgccccttatcattcttttctaccatcattgtctttaactaatactctgtctacaccactgttgcattccacctatcttttgcttaattcctttgatttgtcatcgttttccttacttgttttcagccataatatttagcggccctcttttcttcgaggctacctaccttctgaagatgttggaaggcattaattcaaatagcaacttgataaagccgtataatcaatggctggatgcagatagcctatacccgcaactttcaatgacactaacttctttaggattggaggcattaagcataaaaagatcaataacatgacaagtctgaaattcgacggtttgagtggataaccttggaaactacgaccattgaacatcgaagttggaaccagtatgcgtgtggctgacgaccctatagtagtattcgtctaatgttgattcaagtctatatgtgaagtggatatcgctgtgtttgacgagttctagcatgagtaattttctttgttgatgattaccaatcttctgcaatgcaatgctattttcatctcgtttggcctgtcgaacgtgtgccaaacaaagtctatcattcaccgatattttcttctatgctaatcgaaacacttacgtctatgctgactcctcttatgttcaagtggataaactcatctttctagacatagagtgaagatggcaccatataacactatgacttttaacttcactagtgaggtcataatgttataatgcaatagaaggaattgtaacgtaccacgtaggcgataatgtgaaacgtagaatgtattctttacaacgggttgggacttgggagcccttccttttcaaaacacaaaacagagcaacatattagcacacgagtaattaaatatcaacttaaaaacttattaaatggattagtataattttttaaattaactttcttatagaatattttttcttttgcaaaaacacgaagtttagtagttcgggaagcgtacgcgcgggaaatgagagattagaagttggaaaaggcaagaaaataacacacctttacataaaatttaatagtacaaccaattgttggctccaaaattattcacaccaagaatagctattgtcgacggataatacccgtagaccgtattccgagggtattggggtacactggagcaaggatctacacgatatgacatcaatcacatagaagacaaagattatactggttcagacccatcataaggtaatagtcctaatccagattttatggaccgtgaagaaaactacaaagattacaatagagaacaacaaaactgtagagtaccaaatagattgttgtcgagatcaactcgacgagatcgatcggcgactaggtcttctagtcttgcggattgcttctactatggttagtggtgaaattatgattcaatgaccccgtaccctctagaggtcttttatttatacccctaagtgccttgacctctaagtaaaactcggagagaactttatctgtacgagatcttaaagtcctcatcccccccgaataagattctaacacctattcagaggaacaatttccatatatctcagcaaattccttatgattaagaaaacctttccgtatacttgacggtataccgtatttgtacacaatgtaactccgaggataggaggcatcccttatccttaaccctgacagctatagctaatatggacaatagccaagtattagattacacacgttttcccataagctatcttttaagttttttaactaattttttttctgtctcatttcaattcacactcaatcaattctcttgcatggcatgggaagcatgggagaagagtggttgcaactagatttggacgacaaataagccgtaaggtttcgattcatgtgctgtagctggtgacggaagatatttcctactttatatctctttccatctagaatgatgcatacacggacaatattatcgcccgcctactgactacgctctacttttctttgtccttggagaatttggtgtcgtagtttttaggtaggattcttctgtaatatagaagacgccgccgtattacggagaactattttggtgtaaagaaaaaataaattaattacaaataagttcctggacaaaggaccaaactgaaaaaaggacacactctactgttcgccaaccgcacctctatactctccctctcttacggcggccggggcggaggaacggccggccatcttccgccgcctcgcctcgcctcgcctcgcccccccgcgcgcgccgccggcgaacaaacccgggaggcgcggcgccgacggccacctctcctccacaaccccccaccctagcctcctccttcccaccccgttcccccgcggtctgctgcccccgtcgcgcgcacgtcggaaaggcggcggcgtggagcccggcctcatcccaccgccagccctccatcgcggctcgaatcgagccgaaggtattgttactccgtcgctgctcttcacctggcgcgggcgtagattggagatccgtcccggtttgggttgctctctctccctctctccctccctgcgagttatgcatccggattcttattctgggatttggcctttgttttgatgcgtggaggaggagttgaatcctcctagatccattgctagtcgagtgattcgagtccgctctgctgttcggtgcactgtagcatcaatcatggccgacgattctgggaaggagcagaaggggaagtgggatacaaggatttttttaggttttccgttccatggctgcatgcttgcgttcctaacacgagttgcgttgcattgaactgatccaacatgtttgctgtatgaactcgttttgggcggcttcactgcacacgcagagcccgctcaggcgctcattagtagttaaccgatttaagaacataatagaagggaaatatataagatgttgcgttatgttcaaggccaggagaaatgaggttcaacttttggctgtttcacggtgacctttgctgcattctgattgtctgacacaattctaggctgaatccagaccagtcaaatataggtttggcagataaaggttggcccatttttgcactagatgttattcaactctgctttaggccttcaactgtacacacacacacacgcggcaaatgtgtctcgaaatagtcgttacacggggaatctgttcatttcgttagaaaatctttaaatgccatggcttgcatattggttaaatgattacttctatcatttccctgagcccacaatgctctttttcactcctgtgcaaactagtgtggatacttctctaactaaaaaattctcattttgtttcttaggttcagatgatagacatggtgtcagttattgaggagctcagtgggctaacttctagagaacttggagagatgctgaaggagtcagagaactttgtcttgcaggagaagacagaagatggtggtacaaagcaggtgtgtatgtataatatttgttgtcatttgagtttcttttccctgacatacatttctcttcgtaggtggacatggaaaagcttgtgtcctcgcttcctcttcaccttcttgctgtatgtttggaacttgaaagaggttcagatttagcgtatgtcctccgtggtatgcgcttcttgcatagtttgtctgagctatcagctcgccacactaggctggagcaggtttacttctttcaatatttcactcaagcctccccattttatccacaaataattcattttttttcttttgaatcacgatacgctttgagcattctttttctttcatctctgtattgttttatatctctgtattgtttttgttccctagtgttgtgaactaaatgcaatgcaactctttttttttgtccatctttagtcattgctaagtttaatcaagtccaatttgtttattgatttcattttactctctgttaaaattgaactggctgatgagtgttgagaaacacatgtttatttattgcaggttcttctcgatgatgtgaaattatctgaacaagtcatggacctgatattttttgtgctatctattctttcccactggaagaaggttcggcaagtgccaccaaattatatattgagttctatgtactgttttttttaagattatcatttcatactaatttatggtggcagctattgttttaaattaggaaaatcatcttggtgtttctccttttatacactcatcacttgtagcagccagtcttcatctgttgacaagttacttttcatctcagtggcatgaacttgttcatattctgcttgcacatccaaaggtaacacatgttaatttagaatatgtttaacttagttgtcttttcatgcctaaacgaaagcatgataagtaacctccagaattttgtgatgactttaaaattaaccttgaaatatcattgatttttaatgctgttttaccttgctttaattgtacctgaatcctttattattttctatttttatcctccttaccggcttgtctataatagtctctctgtggtgcaagatgattttgtacatgataatgccctgttatttttggttttatcgttatgagttatgacaaaatagagccggcaacatgatttgggatgtgagcccttattgttttaaggtcaaatcaaaattcatctgaacattttaccctgtcctgacatggcattttgtggtttaaatcatctatcagcgataaatctccatgtaattttgtgtacagcctactgtatcagaaagccatgctctgtcaaatgcaacttttgctgtgtttactttaaagtttctgttctaacatataattagcacaccaatatattttttcctttgagcattaccactgttcaaacttgtatatttctttgtttggggcatttgattgcagggatacatcttttgcatcattatatcatttcataagatagtgtattacttcagctatcctattgttttccttgaagcaaaaatacaaagtccatactaaagttttagtgacttgtgcccattgcatatttttcttgtactgtaataatatttgactgaattatgtcactcttgtgtttatagatgacaattagaaagattacttaaaaagaaaaaaaaaagagcactgggttactattgcaaattctttgatcatgattcacgaatgtttgccagattgccagcaatacatggatttgacagttaggcaattattcttcgttgtttttatctctttatctatcttaatgtttgatgtttcatggtcaggttgatatctttatggatgttgcctttgatagcctgcatgatgatgtgaggtcactgagtcacaggttgtcaacattgagcaccaatacctttcctgttggcccttttgactcacgactcacacacttcatctgccaacagtgtgaagcatcattgcagtttcttttgttactgtgccagcagaagttgttccgagatcgtattttaaaaaacaaggtctcagatatgcttacaaatcctgtttccttttatctttggtatcactgttgattaaaaaatatttaattggatattctcttcccttcatgacatatcaacatatacatgttatatcatactgatttgatgagaaaaatgtgtgtaccttgaggactgtttatttgttcctcgaatgcagtgttccattagtttacatgctttgctcttgttccacaaaacagatcagtctagactagcctcgttcaagagacatgttttatgtttttttttgagcccacgtgtctgtgtattcctataaattatgagtactagcgtcaaatctgcaatttgttactatatattattacatttgatgtgttggaacttggaagctagatctgaagtaacctctttcttaacgcaggaactctctaggaatggaggtattctgtcactctctcgatctatattgaagttaggtgttccagagtgtctgaagggatcaattgatattgctgcttccatgtccagattgaaggctaagattctttctattgtaagttggtcatgagccatgactcaagattgcacttcgtataaataattaaatagagtgctactatatttactgtttgcacagtaccgagttactaactaaatccttggtgcaaaacaaatgctagttgctccaactttgtgaagctgaaactgtttcttaccttgatgaagtcgccacttcaccaaagagtatgcaactagggcaaaccttggcactagaggttagttctaccagggatgatcgcaaactttgaaatgttaccgactctgctacccgtggatttttttttcagttactgacaaaattcttatgtcacatgcaggttcttgatttgctgaagactgcgtttggaagaaaacaaaaacttaccttggattctcacgataagagttaccctatgggttctgtgcttatcagtgcgttgcgtctagttgatgtcttttctgatgattcaaacttcagatcttcatttataactaatactgtaagagtaactatttctaccttgatctatttttagtttttaccattgagcaactgaaaatttccagcaaatataatgttttattcaagtcccttttgttcatctcctttgcagattccatttctgacccaaattttggctattcctcatgatgagtttgtctcaaactggtgctctgttaatctgccagtgatagaagaagacgctaatcttgattatgatccatttggtgcagctgagctggcactggcagctgctggtaataagttaactgaagctaaagcaaactattcttgccctttcgccctatcagtatgccttctatagcatatgcgcagacaagaacatcatgtgtggtgaaaataatagcatatttgcatgtttttgtcccaaacatatgcgaaggtcagagctttttctctcctgctacaaattgctaagttgctatgttgatttgttgttaaaagcaagttccactgtcatgttagcagagcaagaaagagacctttttcttcagaaatttcagaagtacttggtatcagggaatcctagatcatcagttgatcatccagcatcagctgatctcaaggccactacagtttgcagaaacttgggtaaagtggcttatacttttatccaattttgtggttatgtttatgactttattcattatacttcatgtgtaaacctcttttttgtgggttttgcaggatctttgtctgagtatgctagatcgttaattcctaataacttgttaaacgaggaagatgtgcaattgttaaggtagttaagcgtttttgacttgtcatgtttcttagtgtacaaactgtgttacaaattttttgtttaatgcctaattttgtgggtcaacatttggttttaatttgttgcgcgctgcatatagttttgaaacacttttactgatatttctgcaaaatgtgtttttttcctatttgcagtgaatttgcttataagttacaaacttggtgtaaatcacatgttggacagagtacatcccaggtttgtttgcttttcacagtaattatagaatcatagtagccacctacatatccaagcattttgcttagggtgcttggttccctgctcctccttgagggataactacaaatttcatttccaacaaaataatggttcaactgttcaagtacatcacttgcactctgtctctgtgcaagcttttttaatgaacaatattcaatactatagccaatttttttgtatggtaggtgataggtgcaacttgtgtataaattagaaaaatagctttgacccttgcatcagatggtcaattcatacttctagcaatctagttgaaatcgaaatgttggacgtgacctcattctgggatgttttaggcagtaaagattgatccgtcatcagaaagcaaggaagactttaagccactgcagcatcccttgataccaagtactgttgttccagattccagtataaataaccttccgaaggtaggtttgttcagttgttcactatgttgagtataatatattagccattgacttggtaattcatctgatcccaacaaaaatgatgtgcagaacatggaagagcctacaccaacaaacatggaagagcctgcaccaacaccctcaacaaagcaagagggaaatgccagggatgagactcctagaagcactgtcgctttaaatggtgggttcctgcagaattcagtcggccaggacttagtccatcttggtgtggcgagaactagttcaggctttctagggggaggtaccagtacaagtacaggatccctgcgctgcaaaatggatcttgatcctgcatccagcagtatggaccatttcaaaacaccagatagaaaagaaagtggtcttcaggatgatgagaaaggagacactcacatgtatgatgagagacaacctaagagaaggaagcgaaccattatgaatgataggcaaataaacgaaatcgagaaggctcttattgatgagcctgagatgcataagaatgctgctttactgcaggcatggtcagagaagttaagtgggcaggtatagtccttcacctggccattcttctgttagatcaaaatattttatatacttctcattcatgaaaatgtgttttcagggctcggagattacgtcatctcagctaaagaattggtaacactgaagctatctttgttattctttttccttagcaatttagcattacttgtatgggaacatatcctgtgcacacaagccttctcatctacacagcgtgcagaccaactaacaaatttcacaaaaatatctagaaaaaattgtacaagtatttccaatagtattacacttatgtataaagtcttaacttcaaattcattatatcttagctgtaaccaaaaaaaaaaaaaatctaacagttttgagagtataaatctgttagaaatttgtcttttttgttgctacctatatataatgaatttgaagatgagactttacacatagatgcaatactactagaagtacatgtgcaatgttttgtagaatttttggtgatatgttttagttggtgtgcacggtgtgtatacgagaggacttgtgtgcagagcataagtttcctgcttgtataccataactgacgttttgttcatcaagttcatacttcacttctgtactgtttttacttctcagtccatagcttacttatgacaaaccttctttaaattctaggctgaacaacagaaaagctaagcttgctcgtattgcgaaagaaagaggagtactatctgagggtgagaacgcagataagccatctacgccagctactccccaccactgtgactcctcagaaagtgctggcgaggagagctacttgccacctgcgagggtcatgagtgctctaggcatatccaagggcagcagatttgtgagcccagatggcaatgagacaacatcacaggcagaattcaatcaaaatatcatgcttagccgccctttcacaagatcattctcatttgaacctggccgtcttgtttcgctcattgataatgatgggaaggaggttggcaggggaaagatcttccaagttgaggggagactgcaagggaaggccctgacagatactcgcgtttgcatcgttgatgttattgagctcaagattgagaaatggcgggagctacctcatccctcggaagcatcaggaagaacattccaagaggcagaatcaaggaacggtggtgtgatgagggtcgcgtgggatgtcatcagactatctccagtggttcagtaagtcgaacttttctttgcaatgcgtagaaagacgctgtgacacccaagaaagtacaagaagtaaaaagaagtttaatttaggatcagaaaatcgtgaatcttccggagcagtttgtactaagtcgccgccctgactgatgactgttgtatccatcgatcgaatgctggacttgtttaggatgaagtacatcctaatttacaaaattatgttattctgcttatgctaggtgcaacaaattcaagtagctggtgttgaccatgagattttttttttcagtattcatagacctcacttgttagctgtcgctatatgctaaggacaaaggtttcttaagatggacaaaggttcatatgctaaggacaaaggtttcttaaggacaaatgtttcttgccaaggacctcacttgttatgtgttggtggttgctcaggagcggcaacatgtacaccacagaatatttcagatcctttgtccattgagatattagaaaacattaagatggaattcttcatcagggattgcaacctcgcatgatcaggaaaccgctcttcctactcctgccacgcccttaatttagcacacgtcacttcagtatgccaaatctctgttaggtagatcttagatttttctcggttagtccaaagtttttctgtttcagataattgcattagtgcatgatgcagctacaatgcatgcattgtccctgttcgccccagatgcagtggcagcgtgctagctcctctggcttgataaaaactggtgacaataaggtcttgaacatcctttgtctgggcgtacaactcactcgttggactgcgccacatccaggacacacttctgaccatacagctactgtcacgtgttttttttatttcagcccctacttattttttgtccgcctctataagattttttattataaaatcaagtgtaacttttatattgtaaaccttgagaaagagatagaactacacatataccctcaacatctcagtggacccacttgtcagcctacatatatctttccccaccctccatccgaatcctcgagctcaaatccgcacaccgccgcctctgaccgcatccacgctccggtgtccacctctaatcgtttatacttcgatactgctataggcatcaagctggtagtatggcactcggtgcccactaggggagttgccaaatttagcgataagctggccattatcgccatcgatgtgatcgcacacacttagtagatcgctactttcctctccggtggtttcttaacgttccatctttcctcgtctccggtggttgtcgtgctcatcctcccctccctaatcccggtagatctcggcgtttcacttgacaaggctattgcccaacaaagacaacgtcagtcgtcacagcatagctgagctgctgaacactgcgctttgacgtggtacggcaaaggcacttgccatgttgtggcgttgtgcacatccttagtattactagaagttgctctttctgtaatgaaagatttaggtatgcaaaacgatatgaactcttaaactattataaattgaacttaaaaaatcatgtccaaaccaaagtgttcatgacactaaagaaagctgaaaacaacaaaactccaagttagagcacccgcaatggtaaagtaagatgctctctataaaacatgtacatctcagtaatagactagattaatagtaaaccaactcaatagtatgtctacatgggtatctatagctttctaatccattgccttgtttttctctatagactatctctagattagtagataactttgttctctctcttcatttaatctctttcaagtaagaaaatatgctgacatggatctcttatagggagcctatagataaccattgcgggtgtccttacaattacacagcctagtttcacgcttcacacacttccatgggtaacgaagtacagaagccctacagcagagagcgcccggacatggagccccagttccagttgtcgctgatgagagcacaagaaatcaatcaatcaaagcatgcaaagcaacacagtcactctgtcctctctccatcaatcaatgctcacccagctcacctcacctcactctcctgctcctcctcttcactcgcttcgcctccgtctcgtcgcgatcccacctgaaaactctcgccatgaccaccgacctcctcctcctcctgctgcttctgtcgtcatcccgcctcgccctcgccgccgcgttcggcgtctggatcaatggcgccgcctcctcgtcgccgcagagccaggagtacgaggcgctgcaggcgctgaaggcggcggtggtggaggacccgcgcggcgcgctggcgtcgtggcaggggcccaacgtgtgcgcgtacaggggggtgtactgctcggcgccgcccgacgacgccgccgcgtcgggcgcggtggtcgccggcatcgacctcaaccgcgccaacctgagggggacgctcccggcggcggtgtccctcctcgcccacctcacgttcctccacctcaacagcaaccgcctcgccggccagccccccgactcgctccgcgacctccagtacctcaccgagctcgacctcagcaacaacctcttctccggcccgttcccggcggcggcgctgctcatcccgtcgctcgtctacctcgacctccgcttcaacgccttctccggcgggatccccgccgaggccttcgccaagagcagcctcgacgcgctcttcctcaacaacaaccagttcgacggcgagatcccggagacgctctggtcgtctccggcgacggtgatcacgctcgcgaacaaccgcctcaccggccccgtcccgtcggcgtacggctacggcggccgcgtccgggaggtgctgttcctcaacaacaagctcaccggctgcattccggaggagctcgggttcttgcccaccatcgaggtgctcgacctgagctacaactcgctctccggccacctcccgcccacgctgtcctgcctcgccggcatcgaggtgctcaacatcgcgcacaaccagttcaccggcgagctcccggacctcgtctgcgacctcaagcggatcaccaacctgtccgtctccttcaacttcttctccggcatcagccagcactgcaaccgcctcgccggccgcagcgtgttcgacttcgtcggcaactgcgtccccggccgcggcctgcagcgcccgccgccggagtgcgacggcggcccgggcgacggcggcctcagctgcctgcgcagcatccccgtcacccgccccgtcccctgcgcccaggcctccgtctccgtcggcgtcggcgtcatcgtcggcggcgcgatgccatcgttcggcgccggcggcgtggtcacggtcaccgtgccatgaacgaacgatcaaccgattaaactgtattttttgttctccctctttttttttgtccacgaaatttaatcccatggaccattagcccattgccatctcatcactaattactaatcaatcgattggctgcttaagaattcgagtggctaattaagaacatttttggcttttgagctggagggagagaggtgttaatggcgccatgaatacgaggggtggcgccaactgctaacgacttcctcctcaccccgtgcagccgcggccatgtgatgtgctgctgcagctgcacagcttgcagaaatgcagtgtactgctgtactgtttacctgcttactactcctgccctggtatggtctctggagtttggatcgatccgccattttcaccttggagaaaattggtccctgcacctgtgaattttcgtgttcaaacgagtgattatttgtcttattttaatttttttatgattaatattttttattgtcattagatgataaaacataaataatattttatacgtcatttattttttaattttttttcataaactttttaaataagacggacaatcaaaagctgtatacggaaaccggtaactgcacttaaaatgggacagaggtagtactactatcctgtctcaaaatatatatataaaaaatgatcggatatgatatattatagtatcatgaatctgaatagacgcattcaaattcgtcgtagtgtcacatatatcacattcgacttgtattttgggttggaaagagtacaagatcagaagttactcttgtgtgaaccaaaaatatggaatccaatatttgttgctccggttaatatttaatactcccttcgtcctaaattacacggcgtccttattttgttttagaaaaaaataaactcgttaacttttgattaatgattatactaaaattatttatgttaagtattatatatggagtatgctatatcactgtattcgtgtcttaaaaattttcatgtgatattaattttatagttgttgataatataatgtgaaataaaataatagttcattgaaaactatatgaaaaattatatgccttataatttggaacaaatggagtactcccttggtatttagaaactacttagtttgtccataaatataaggatttagggtataaatataagaggttttgatgtactactttctcaatacacctgaccattatatttattaccattatttactctaataaatagtaacacttcaataaatatcactcaagattgtaattgctcttatctccttgaccaaggttttttttattgtttcgctaataatttgtagtacacaaattaataaggtaataataaacgtttcttgagtgacaaatactacaggttttacaacatcgggccaatacattttaagtgtcatttcaaattatctttttactgcactaaattttctagatgtgtttgctacagctagctcgctccgcccggtgccgtgtggcgagaaggagaaagagaagagatgaaggagaggagaaaatgagaatgagaatgacatgtggatctacatgagctccactattcttttattatttttagtgtaactgacctatgggtctactatttttatatatttttggactgaattgccacgtaggtgtcatgtcaatgccatatggaacaaagaactagtcaaaatagcaacgtagatgtcacatcagttaaaactgagaaaaatgccgccgagagacctaattttcactagttttgtaagctgggaaatacattatatctagttttataattcaaggacgaatttgaaattcggtgacaagatgaggtgcctccggtgtactttttacctcggatcgcaaaagtgacccatgtttttggtgggcctttgtgggctttccaaaagcctgtctcaagcgagcccaactttggtgggccgaattgtgtttagggaagttgtgcggcccatcacggattggcccattatactgcaactaggccattcagagcttcggatccatggccggcgagcccagctctacgccggcggcggcgacggcgaggaccacgtgacgtgcggatcagctcggaggcaacggcgatccatctcttctctcccccctcacgattcagaggctcaaccgagcggcgaacgggagcgctcgacggcgaggtgcgcgcacgcgaatccagttcccctagaggtcgcaactacgcctccacagtgttcctaattttcttgatttttctgtcacctactagtttgttgatctgcttaatttgtttgtcacatgctagtttttttgcaactatcggtgcttatcgatttagcgattcttggagacttggtatctttttgtgttgactcgctggtgttaggagtgatgctctctagctgctcgatgaaatgcctgataaaagcatcctgtcatgccatgccaatacatctatcaacatttattctcacgatttgttcttctttgctaatgtacctatcaccatcgatttgcatgcagtaggaccatcggatatattagattaatggtgaatggcgtaatgattttattttacaaagtattgaacaagattgcgagtggcttgatgagttcattattctttccgatttcttctgggtttctagagtcatgcagggggcgcgcgttaatctgaaggggtggcaacaggcagcggttgcatttggttctgcatttggggcattgcttgaccctagaagagctgatctgatagctactcttggggagactactgggaagccagcatttcaccgtgtgcttcagcggatgaggaacagtgctgaaggcagggtaaactcatgctaccctctatttcctaaagggtgacgttatgccgatgcatccatttgttgtgcttgaccatctctttatagccttttttactagcatattctgtaaataatatacatatatactcagcttctgaaacagcaacagtttctcggtcaacaaatgctaaggactgtatgatgtagattttttgtgtgaagtagcattatcctttttacttggttgtttcagggagcaaatgttatcctgaaaaatggaatttaaggtgtaggtcttctagcgaattatttttcgtatgttgtccatctttttgttgtttgtttgttctgttatgcattttactctccagaatatgttccttatttggctgcagtataagtttacccatttagtgaacaataaatttaaacctgctattgctatacttgatgcaattttccttcttattacatcactgccatgcaatttgcaagtacatagcaacacatgccaactgaaaatgtgtacccaactctgtggactttttttcccaactgacttaactaagataatattcctgcaggatgttctcctggagcgtcctcgagttatatccacgcaggtttctcatgcctgggacatgcctcagaacacatttggtgcagcatatgctcagttcatgggatcaaggaacttctcaccagatgaccgcccacctgtccgtttcattgacacagatgagcttgcgtatgttgcgacccgtgcccgtgaagtccatgacttttggcatgtgctgttcggccttcctacgaacctgattggagagactgcccttaaggtcattgagtttgaacagatgttccttcctatgtgcatgctttcagtcgttgggggctctgcaaggttcaatgagaaacaaaggacactgtttttccagcattatttcccatgggcttcaaaagctggtcttaagtgcacagatcttatgtctgtgtactatgagaagcattttcatgaagatttggaggaagtgaggaggaactggggaattataccgtgccctaatcccaaaaggagcagtgtttagacttttagatcggtacattttgcatgaaagatgtatgaacttggtatttagctttgtctatgttagtattagctctttcctttgaagaataatagaaagagttatgctactgatacctaaaaaaaactagtaattctctgtaatttagcatagcaactaagcttgcaatgtcaatgttccctttaacaatagtgtagatgagttacttacgtgtttatgtgtaatactagttgttttgctatggatagaagaaaatgtattataataatatctaaaataaaattatactagcaaaagtgcccgtatgttgcaccgggtgattacggagtgtgtatattgaccaaaagtgttgtttggtttagaaaaagtgcccgtgcgttgcaacgagaaacatacagatcagaaaaatatgcaattaattaaaatacaaacacattcaataactataattataaatgcttctggaaaaaatgaagtactaaaaatgaacttcttttctttttcttcggcctgagggaccaaaaatagacttctttctggcccttgccagtcagcccaggcctttttcgctcacgcgggcgcacttcccctccctaggccgcaacctgggcttgggctagaaaagtggcctcgctctcgatccctcttgggccgatttcggcccggccgacgccggccgtctgatctctagggttttgatcggacggccgagcgtcgagatcggggaaacaaaaccccctctgggtttggtgtgaacttctgtgatgtatgttggtattgttgttgttcttggatgattttgttattgttgttgttcttggatgtggtgtatgtcgtcgttgttcttggatgattgtggttgattttggaggcaaagagtgattgattttttttgggcgacggacgaaaccggactgaaaaaggcagagttgttgattttttttgggggcgatggacgaaatcggactgaaaacggatggaccaatcggactgtgacgataggaaaaatacaaatatttatattattagttatatatatagatatagatttactatatggaatattcacctcaatttgattttaagggtatgttcagattggtgctaaaataaatcttattaaaatttggcaactttaaaattttgataaattagcaatatcgccaaattttcataggattgtcgtacatatgctgaggaagagacctagacatgaccgaaccgtgtcatgcctgaccgagccaaatctccgtgccattaggctatgggccattaggcaagcggttcgtcgtgaagtcgtgatggcgagggatggagatgggcagatggcctgtaccccacatgttgtagctgcagccgcatgcacttgcccgacactaccatggctgccgcacggcaccggccatgtactccttgctttgctcacaaaacgtacgtattcccggccgcaacagcatggtcaaattggtgccgacgcgacggtaaggccatgtacagtgcgtatcctcaaactatagcctcgctcacgccgcccgccgcccgttcacgagccatgcccttggagggaggcacgaccctcacgagggaaacacgcgcctctacctcctccaattcccttttcttgaggccgaggcgaataaaaggaggggcgacgaagaaaaagagaatagagagagggggagaagagaagagaggggaacacctagtgtagacttttgggttgggacacccactatgagcttgagtacttttattcaattgcttcagattttgagaagcctatttagaatatcctccattggaagatgagtgccccagagtgtcctcagttagtgagagcactctaagaatggctttgattgtacatgccctaattaactcccgtctgttggtggtggtggtggggttcgtagatgatcttgtatggggcacgtatgaggcaccggagcaacacgtacgtggcctcgttgggggcgatctcaacagggggatagccgtgttgttgtatgtatgcgtacgttagctgtcgacggcttgcaacaccctgactacatgtacacatatatagctaaagaaagttcgcttcttcttcagtggcgcccgcgttgagctgctactgcatctcatcaccagctagctctgtctcttcaatagtgaaggcttgtaggcaggagcgcgcacggtacagtctcatgcgtggcgaatggctcgccaccttgcacaagctccaaccaccaccgccgtcgatggcacccccgtcgcatgccagttagcgccatctttaccccgtcaggtgctctccctactccctcacctcgcctcctcctgctgcattaattcccgggaaagaggggagagacagagagagacggggaagaaaggaaagagaggggaggaaggagaaggtcaacctcactggctcctttgcgtccctcctcttcttctctgtcatggaccaccggagtccaccttgtctccgacctaccatattttagtacttttttttaactatgatgtcacattagcaaaaccaatcatctatactgtcatgggaactgacttaaatgattttgctggtgaagatttctggcaccgtgctttagggatatcgattaaagacaacataaagacgagggaagataactggacttattccagctaccaatagtgtaggcctgcctgccgattcttccctacgtgctctgcatgtacacaggcccttgctggcccatatataaaaggtgcgatgtggctgccatatgtagcactataccaggctcgatggagacgggaatagattttaaggatcccttaattaggtcagttttctttaaatataatgtaaatgattacgaacaatttcaaaaaaataatgatgtagtgtacaagtgacatcaatcacttaaaaattcaagttaaaaaaatctataaaatcgtcacacatttgagcatgaatagtaccggtactgttaatatattggatttgtctttttgatgtgcgagttaagtttagatttgattaattggtactttatataagtttgaaccttttcctgtagtttttaatttttttatatgaattctaagtttatttcacgtaattttataaattttatatgttggcataattgattattcaaccattgaagagtgataagtaatagctaataggaacgtgatgaaaccattaaaatattctgtagggatgagaaaagtaactgaaaattttgaaaatttaatttagacgcctaacactactaaaaataaatccaatcaacttggaacaagttcaatggaacaaaacccatcaattccattattactcgaaataaatacaacaagcttgcgatcaacagtacattgatcatcaactaatgaccaactgcatgccacacaagcgttattacaaacagttcatggccttaagcaaagtacgatgaaacacacgccaattacaacgtacggattcatggatagacagctagttaattactacctccgtcccaaaataagtgcagccgtggatatccgtgcccaacgtttgatcatccgtcttatttaaaaaatttgtgaaaaatttgaaaatatttagtcacacataaaatactattcatgttttatcatctaatagcaataaaatatactaataaaaaaattacaaataaaacaaacggtcaaacgttgaacgtgaatagtgtaaaactgcacttattttgagacggaggaagtagctagccagccagcaatggcgtctcctccggccggtgagcaatgcaagcttgttgacgtagtacacatcggattggaaagcttgaaggtgcgggctcccgccgccgggccgaggaggtcgctccactggtcaccgatgttaccgacaatggcatagccatcgctcaccagcttatgccgctcaccgctcttgaacgcctcgatggagagaccccccgtcggctgaagcaccagcttctcccacccggagtagccctgttgggaaaggttgcggatggtgacggccctctggttctcggtgcggactgtcaggaacaccggtttaatgccgagctcgagcagccgtcggtaaagtcgtagcgtccctgctagcgccggtgcggtcccctgctccacgtattggaggaagctcctattgtcgtacggctgggctctgtaaaatggataatatatataccggccgtttcaaaaatgtgtaagcatgtagtattagcaaaaaatatattacacatgttcaacttttttgttttatgcaaaatattttaagcaactaaaattgtgcctattttactacataatgtctaaaaaaacttttatatttttttactaccggaaagagtattttagtcatcactacctcttatgatgaacgggcatcaaacaattgcaagaggtattcattcattactagaaatatgagcgcggcgccacgccgcgcacgttaatatcgacgtggttagaaccacacataatcaatgttaatttgacaacgtggagtggaatattatatacatgtaaatttggtttaacatcagtttattatatgggcccccttttttaagaattgttagtttttttgccatctaaaagtggataaaaaatggtataattttggaaaacaagcggtaacacgcaagaacagcagagattggtttgaaaactataatttagtcgtatatgggtttataaatgataaacaacaggtttactatgcagaccaagtactaaacgaatttacagcgagttgttaatacttgtataagggtctgcacatttatccattactttttccattacataatgtaagttattctagcatattacttttttcattacataatgtaagttattctagcattttacatatcattgtgaatgttactgaatttagacgcatatatatatctatattcactaatatccatatggatgtagaaaatgctagaatgacttagggtgcgttcgtttctgggggattgggtgagaaagcccatcgtatgccgcacgcacgctttccaaactactaaacggtgcattttttgcaaaaattttctataggaaagttgctttaaaaatcatattaatctatttttaaaatttaaaatagttgatactcaattaatcatgcgctaatgactcacatcgttttgcgtatcttcccaatcttattaatccccttctgctcaaactcacccttacattacgaaagggagcaagtatatggttattggtaaggatttatagggaggctaaggtctagttcaatctgtgaagagtataagtcagcagcctatatacgtgttggaaagttactttatcagtatggtattatcgtgccttaattctgggctttggaacatatggtactgcgtggggccggtagagttaatattagggtgtgtttcgtgtactctcatggtaccaaaacacaacagagcatttacggcaagagtagtcaggaccaccatagtaagatcgaccagaatacgcagctaaagaaaaaagaataaaaataaataaatagccatcagaaaaaaaggtagaaggaggaagacggaaacaaatacgataaatggagtataagggaaaaaagcacgagaggaaacaaacctttcaaatggcatatataatcggtggaaaaaacaacatatccaacagggaaagaaggattagaagtaggaactgtaaacgaggaagaaaaaaaaaagttttcacaccgagcacgggaggaagaaactaagaataaacaaagagcagcagagaaaacaaggctcaacatgggagcaaataatcaaagaaacgataaaaaagataagataatgagaaagaaccaatctggtgaagcaaacaaccgccgacgtaagatcgccaatttccttttccttcgattcaccaaagactggtacgaaggaccagacttgaacgatgcagcttaaaaaaaagtagcatgatcaaactatctaaaaagtagagggtaaacacaaatttaaatctaatgagtatcgaaaagcatagcgcgctaatcgtacagtaaaaaatgcaacggaagaagtcatgtttaaatttgggtcaaaaggagaataaaaatgaatatggtaaccaatgaaactgaaattaccagtttgtcgtgtcagttcacatgctgagcgcgaggaaaaactcctaccacgaaggattgcagcacggcgagctctagcagctgatgcagacggcataaaccaatacggccaagcaagtatacccagtgcttaatacgatttggcaagtaaaaacaataaacacataagtttacagaaacaaggaggcgtacaatcatcagaaaattagcacagtataattgaaagaacagagcaagcgtcgggaacgggaggagaaaataacaaagaaaagacaaacaacaaagacaagcaccttgaacgaacggatcgcagagagaacagaggagctatcactaatgcagagaggaacaatataaggggaggagcaagaagagacaacaagcaagagcatggacacgcataaaacaaacagcaggcatgcaagctgacacctaggccattaaacagtgaatcaaatcgccagcaacctctgttaacagtaaataccaaaagaggtcgggacacatccggaagaatacaacgcatgggacaacaaagtcaacttacagaaagaacaaacggacagcaaggtcgacaagaaacaccagctgtttttttaccactaataacatattaaagactaatcgagcaatcaacttgaaaaattacaaggcatcacagcaacctacatcacccaaagggcgaaaaataccgcttacaaacggaagttaggcaggttaaaataaatatgcccatgtgtgtacgtagttagtacacattttttttacccctacaaacagcattttacattttaccaactacgtaaatctgtaacactgaaaccatatttggaaaatagattaacataccgcacacaacagcaaagagggcaactcgtcatacactgacacctgatgaaaaagggagatttttacaagcggtaatacatatcatcaatcaaggttaagcaaggggatttgggaaatttaacaagcacaaagtaaatctaggtgttataaaaccggccccgaaatcacatcggaaaccaaatacggaagaaaacgccataggagatccaaacatgatgacaacaccgagacacgatatttgataacggagttcagccgaggcctacatctccggggcactgattacgggcgcttctccccgatccagcatattacagcgtatgagagttacaatgactcacggtcggtcgctgccggtagctgctccctctcgctatgctaagtcaccatgcggttacaacaggcacgctcctctatttatgagagaacctaggatagagtccgactcttaccctagtcctaatacctattacaacttcaagtccaaaactgtaaccgactacgtacacatattcgatataaactctaacaaactccaccttggcgaatatgccatgccaacctgaatttgttacttgctcgaacctccgtgtacccggacttgagttggtcatttttcgctgctcaggccgagctgccccgacaaacctccatcaggctcaccgtaaacaagagactcccgctatcccggtaacttcttcctctcgactccacctgcagcagtgctacaccttctctcatatcaccatagttgtcttgccaagcgaaattgaattcctttctagctgtcacatcatagactccccgaagaccatgttcacctccatcttccgtcttaaatttgacttgatctaatccatggccagataaccgatgtcatcaccaaatagataaattgaacttactagacatgaagagaacctttcttgcttgttgtcttatgaactgagctaaaaaatccaatatccacgcttctccgtatctgtagactgagtatccgataatttgagaaaatcaccgttgcgttgaatcatctgaagaacttattatcatagagcttgctctttctcttcagtgatgcagattccatatatccccatcatgcaaacccgcagattctggatataccctgtattgccaaacagaccgttgacaccctcaacgattttcccccgctgttacccgggatcttcttcacgcacctttgccacacccctgcaccaccgcagccttgccttcgaatcataatgcagaagccctgatgcacagttatttgctgtcaattccagccacctagcctccgtgctgatctccacgtccattgcgactccgagttgataaacaactctgcaaccgtgtcgatctccaccagctacgcaaactgcacatcctctgcaacctgattccaataccaatttgctgctccgtgcatggacctacacacaatatgcccatggacttccctgccgcatgcatgcacatatccagagccaccacgaaaacgagcctgcatgcacatgcatccaattaactactccatgcatgtaaccatgcaattaattaattgatgtcttcatgcttgacttgttcttcgtgtctgattatgatccatggcaaaaaatccaaacggctcctattgcttggtccaattttattgtgttgctcctgtgtgcaccgccaccgcctcctctgaccggagccggcccgacgaactacgccagcacctgcacgacgactacaccaagccgtggtcctaccgctcataattcgttgcccaaaccaccgccgccaagaaatcgggaccgatctcttcatcgctttggttgtttgattcgattgcaatctctgcaatcccgtggattcctcttgctgctttacagggacaaattgagcccgattctatttccaaatcgaattctcctccgatcccctttcgtgtctgacgcggtatccttcttgatctctttttgttgtgtgtattgaagccgagctcgtgctcaactccttttctaccacggcccccttcgagtcgagtcctgcatgaacccaaatcgggtctgctaccaccagcaccgcttctgtctccgtcgtcggcttggcctcgcacgtcgctacgaccctgacgtccaagcttcacgtacccccagcgatatcctcgctccaagagcaagcacacacaggacatagcatgaccaccgacatcgtcaatgacttccgctgccaatctgcgtcgaccctatcctgtcctctgtaatccattgcatgtacgtctctaagtagcaatcctccatgcagtaccttgccgtcaacacctccaaaacagcctctaggaaccatccgctccgacttccgattgaacgccatcaatctagtcaagagccgaagccgacaagtcacatgccgtcttcccagccgccgaacgacctgagcgctacgtctagccgtctccctgtcgaacgcagctcatcgaaaggcccaggtcacctcgcccagagtgttcgattccaccaaccgagaacgccaatcgcctccagcttcaatcaaccccgagcgtgtggccacacgtctccctgttgagagtagctcaccggaaagttcgagccacccacccgaagtgtccgacccatcgattggatcgccaatcgcttccgccgccatcaacccgagcaccacgtttagtcatctccctgttgattgcagccatcgaatggttcagacagccacctgaagtgtccgattccaccgatcaaaattcctttgatcgccgccgtgctccaccttgcgtccatgtccgtccctggacaccctgtgtagccgtcgcggcgtggagcacctccctcgtacctctactatggatctcccacaggctttggtaccacttgttataaaaccggccccgaaatcacatcggaaaccaaacgcggaagaaaacgctataggagatccaaacatgatgacgacaccgaggcacgatatttgataacggagttcagccgaggcctacatctccagggcactgattacgggcactcctccccgatccagcatattacagcgcatcagagttacaacgactcacggtcggtcgctgccggcagccgctccctctcgctatgctaagtcaccatgcggttacaacaggtacgcttctctatttatgagagaaactaggatagagtccgactcttagcctagtcctaatacctattacaactctaagtccaaaactgtaactgactacgtacacatattcgacacaaactctaatactaggtaggaaaaagtaaacagcaaataaattgaaaagagggccaaaacctgcgtaccgtagtgcttggtaccatgaaatacaaaaaaaaaaaacaaagaattcggcaagtaacgatgtacagagcgtatagccgtgctgctccttcttctccatacacccccacagtaaaatttccaccatctctctccatcgtggagccattggaaccggcatattgggggcatccccccgatcaaaatctgtccggcgagcaggaactccccgacggcatcgggatagagcggctgacgtggacgcggttcaacacctccgacagagcggggacggcggcgtccgtgcagcacaacacccacgcagatcccacagagctacccctcatcctaatcgcaatccccggccaggaacgggcaaatcccatcccccatcgtcggcacctcctccggtcagcaaacacaacggaagggaacacatccaagatcgaaggaaaaaaaagcagtcacaacagaggggaaaagagactgaaccgagtgatgaacaaatacagcaagaaagaacaaagaacaacacaaccccaatgtggactaacctcgaccgattcaggaagggaagatgggaagcagcaaggggcgccgacaaaagcaacaggacaggcgagctcgtacgaggaaaccaccggcgacggggagacgaccaatccgaagggcacaagaaagaagaaagggtcaacgagggccccatacagagacggccggcaggggaaaatcgcacctccatacccaacacaagaacaaaccacaaacacaccccaaaaacagaattttgccttcttcacattcaatttacataaaagctaagggcctaaacagaaaatcacaaagacacagagtacagaatagatagaccgatgtgaaataatagaacacacaagtggaccaaaacaagaaatggcaacatgccacgcgccattcaacgcgccagccaaccggaaatagccgtcactgtgaccggcatccaaaccccaaatgcatgaactaattacctgatcaaccggcgtaattaagcaggcaaccggcgcaccggcaaatcataaacgcgcaggttaggccgaggagcagagaacagtaaacggagacgtgtaaaaacaatcagatagccagaaaaaaaccaaaatcacgagaaaaacggtggggttaggggagctattgattgatgatttatgccccctaatgtataaacgttgttatatacatttgtcccatgaatatggtatacatgatgaggccccctctttgtactcttctgtaacagtttcaagttactatatggtatactccgtacattatgtcggttatcatgttggctttggcgtttttcccgtctcacgacatatgagtaccagatgtgttatactcgtgatagaaatagactgatgcacataactaataacactggccgttaacccgtgtgttatttgggctattacgattggtataaaataaatactgaattttaaccatacattgaacgcattggttattttctgagttacaactggtttttcccatgccctaattagatcgatgaaacatgcaagtactaattccaaaatttcagaataataaattgagctatgatatccacctgtatgttttggtttgacacatactatcataataatcgacctaatcgacagacggtcaaatcttcctatatcgtattcctaatggactctacactcttattttcatatttcttatattttaattccgaacttaagttatttcctgtatagactctagactcttctcctaatcttcattattttttaatttcgaatttcagtgttttctaaattgtaattctatgtgaaccctaaaccataaaatctattttttgcaggcggacctattaagaggccacacacaaaaataagcatatttttttttgcagacaggcctctttagaagccgtatgtaaaaatgaatgttgatttttgcagacgtgaccaactacggtctgtcttgtcttgtagtaaagttctaaaaggacaatgagttgtatggcctctcttttcgtatgcgggttcttaagtggcctacacgcaaaaatattcattatattctgcctttttttctccccttctctctcttcacccacttcaaatttttttcacctcctctcttctctctcttccactcccttttattttcactcctatcatgtctctctttctcttctctcccctctctctcttcctttcctctcctctcctctgagcgtctggcgcacgggtggcggctggctcggcaccgaccatgagcaagcggtggctaggagcgggcgggcggtggccggctcgggagcggcgctaaccccatccccgctcggcaccactgccaacgaggaggaggaggaggaggcggcctagagcaccgccgcatggccggattccggcgctggcgccgccaccaccactgcatgccagagttttgatttttgtttttgagatttttattttttcggatttatattttttgcatgaggaagacataagcacccgcaagtgaaaattgaattttcgcgtgcgtgtgtcacccgcacgcaagaatcctgttttttgcagacacttccgggcagactggccagagtttcacatgcaaaaatcccttttttgccttctggaaagattgtttctgtacttgtggaagatttgacaaatctaatagcgttttctattcttcatgaaaaattaagttcaattaacttcgaaaatgctcaattctagaaaccatcttgacccatcattaataattccactattaattactgtaaaagatacaacaagcttgctcaacacagtacattattgatcgatcaatggccaattaccaaacaaaccattttttatagcaaacaaacgttattacaaacttaaatcccatcccaccgacaactaacaagcagaaaccctctccctctaaaaagaaaaggagaaataaagcatatgagtcgaagattaattatgagacgcaattaatgagaaaacgagtagatgaaacggacacgaagcatggatatatagttagctatatagcgggctagctagctagtcgatgtagtacatgggttagggaacttaaaggtgcggcaagccggcaaccctccgcgatgagcgacgaaatatagttccactggtcatcgatgttgcctacgatgatgtatccgtcattcaccagcttctgccgctcgcatgtcttgaacgctagcgtcgaggtctctagcccttctggttggagcacaagctttcccaaattgcagtagccctgctggagaaggttgttggtggtgagctccctctggtcgtcgtcagtacggtcactcaggaacagtggcttgatgccgagctgtagcggctgttggtacagcctcagcgtctcctcactggagaatgccttttctctcccaattagaaactctttttgtagtcccggattataaattaggagaagaaattcgggattaaagatagcggtttaaatacccgggaataaagatgcatctctactctcggttggtgttaccaaccaggactagagatattttatctttttttatatactcgtgaatcattgtttttagctatttgcacttgtttttcaaccaaactcatccacagatcatctcccgacatcccaaatcattcgtaacaacaaaatcatcatccacaatttcaaatcatccacaacaacatatatagtcaacaaaaatatcatccacaaattaagagggaaaaaaggaaaaaaaaacatccggcgtgcgcccggccgcctgccgcccggtggccgtcgctcgccacgcgcccatctgcgccgccgcccacctccgcgcgcccctccgtgccgtccgccacccgttgcgcggtccttcatgccgctgcccgcggcgcctccctcagccgctcgctcacctctaccgcaagcaggcagaagaacacgacttagtaggaataaggataagaaaatagagagaaaagagagaggatacgaaaagaaaggaggaggacaaggaaagagtggttgctagaggataagtgcgagggattatatactatgcgctgatttttagtcccggttggtgtttccaaccgggaataaaaagagtagaggagcagacacttttcaaccgggactaaagatcataaaaaggctatggacttttcaaccggggctaaagatgatttttagtctcggttctttttggaaccggggatggttttcggctgacctagcaaaaatcagttctctagtagtgcctgcagagcgggcacacctcttgcacgtattggaggtatagttagccgaaaggctcgaggctcaatggtctggtccatggcacgaagttttggtccgtcctaggcatggcacaacccgaccgttgggccgtgcttgggcctctgcatcggcatggcgggccggcccggcacggtctaaagatttaggaggcaaaatcgataagggagccaaaatagacttattccagtcattcaaggcaccgccaaagagttgtgggatgcaaaatagacttagtatagctttatatataagacacaacccaatgagttgagggacgcaaaataaaaatttttctaagaaggagcacggtggctttcgtgccttcgggctagcgggacacggctcgaatcttattgggccgtgcctgggttgttggtgcagcaagtaggcgggcatgtaggtcggttgttcgactaatctcggatccggcttgatcatggccgggccgtgctgggctaggcggctcgtttggtcatctataactggaggcagtttacattgttgaatggttaagtcctgcaaatcaagggagttagattttaaagaatcatagtagccaatccatattgtatattgtattattattgatattagagattaaaattttaggtatatatcaccaactatgttggtcatatttggaattatagcgcttaagattaaggaaagtacacgttgtgatttttgccttactaggcccccgtgtcgccccgctccagggcaacacgggcggcgacgccacaaaccccgccgccaccccttccccctctcctcctccgcctcaccaccaccgacaaagctaagcgacatcaaggacaacaaatgtggggcctctcccttcgctccagccacagcggttggggcaacaccaagatctcagctggaggggggtggcgaccgtcggcgctagttctggcaccgacgaggccggtcgcagtggattcggcccacccgtacccagatcgggcaacggaggcgccgacggcgccgcttctggcttgaggaagaggccacggcggatctggggaggcaagtccgaccccctgcggccaaacgggaacgagattgatagcacggtggcaaagtcggtggcgtgcgtggccctagagtcacgtgctcgcgcgggaggcgctaggcggcgtagacgcggccggcgggcctgggcggctggaggaggagggcaattttcttatattattaacatgtatatattatagatgttatagtgcaatttttgaacaccctcccttaaaatcgtgggcccgccacacctcaggccaaccaccatggatgcatatgcaccaaggaatggatgcaagcaatgccctacctagagtgtcaagttagttcattttacgtactgataccatcaagaacatatggaccaactataaggtgtagtgtcccatgcatacagaaaacaaatttactactccctccgtttcgaaatgtttgacaccgttaactttttagcacatgtttgactgttcgtcttattcaaaaacttttgtgagatatgtaaaattatatgcctacataaaaatatatttaacaacgaatcaaatgataggaaaagaattaataattaattaaattttttaaataagacgaatgatcaaacatatgataaaaagtcaacggcgtcaatcatttcgaaacggaggagtattcaacaataatctgtgcaagctcatggttgcttgtgaacagcgaaaataggacgcttcgtaggatcgatctgaggtgtttgttttcaatattaactagcgtatatagtcacacgttcgcctgactttaacctccctctatactgaatgtgtttttacatattatttgtggtttataaacatataatgaggattcatttgaatttattttaaaattatttatatgtaaataaagatcacggatagtactgcgaggatatgactagggtttatatttatcttctccattatattttctctctccctatccgctcaaccataaccatatctgcgaagatatctttttctcatgtacttgagccaccgcacgcgcttcttcaccaaattaccaatcagcatctccatggttgcatgacccctttatcttcatattatattctattcattctcattttcggcaaattatgtttttacatacttgaataggtgttaagaaaatgtactatttggcaggaaatctaagtataacacaaattgattgtcctgatatgtaataaataaatattatcacggaaataaatattttacaatgattatgctaaacttgtgaaactaccctaagaaacagactataaaattttaggtgatcttatcatttattttttaaaaaatgataaacaagaaaccaggagacatcctgttgagagataaaaatccatctcccttattatttctcttataatgatatattcagtcacataatggatgtcttctagcggaactattgaactccctcgggggtacgaccctcctttgttgcatgcagtccaagtgattacaaaacatttttgaagatggaaaacatagatggctgtgttacatattcgtggaaaattttaaaaaatacatcacatcaggcaagaaagtaaagttcagttaaactcgtagttggattgttacttttatttgtcgatgtatagtttaaatttgttgattaatttttatccttcatttttatggaggaatgtacgtaagtggcaatactatatatatcctcacatgtttgtgaatggacatatatatcatgaacgattattttatcttcttttgttcttaattttttataattcctgcaacaacataatcgtagtctttaaggtcttgaaatcgactttctatctccaaaatgtgatcaaatcccaaaaagagtggattttaaattaccattttaatatctggctaattactaacccaatctggaatttcctttgggccttgttcggtttggagggggttgaagggaattggaagggtttgagggggaataatttcacactataatagatgtggaataaatcccctttaatccccctcttgggattaaccgagcatggccctggtgaaaacttttcttgtgggctagcaaaactgccgaggaaattgctgtttccttaacggtgctaagcaaactggcaataaattgtactgtatatttattgaggagtgactgcaagtatatggtagttttctcgggtgtttcactgaatcagcaaattaagaaattgccttttattgcgctttattcgaaaccaccaacaatccttttctagatggtgctaagtaaagtggcaataaattgtactgtatatttatagaggagtgactgcaagtacatggtagttttctcgggtgtttcactgaatcggcaaattaagaaattgcgccttttattgcgctttattctaaaccaccaacaatccttttctagacggttttggtacttccttggtggttttgtagcactcaagaaatttcctgatgctggtaattcagtcaggccatctcgaataaaactaaaaattctagagagagagataagttaatttgttactatttttgaagatttgacaactccaatcacttttctgtttatgtataaaaaactaaactcaaagaacctcgaatatgttgaatgcaactctattagaaaaaccattttttccgacgatgacattttttttttagccaggtagatctctcggagctaaatggccgcctacgaaaatgacaaccggggtccgagatcgccgtccgcctgcgaaaatatattttcccatgcaggcggtaccttaagaggtctgcatgcaaaaatattgagcaccataaaaatagtcacctacgtagccaaaaatcgttaagtcccgcccctcccacgagtcttttacccctataccattaaaaaagttgctgcttatctgtgtgccacaaaaaagtttggagtcacctgtatgccatgagaaaaactttcactgacccgtgtgccattccgtccaccttctgttagaacttaacggttccatagctctgacatgtgggacccatgtatgaaaatgactaatttgcccctaaaggattttcagctctattctcctcttctgctatctcccgtgagtgcctgctctctccctgttgcgccgcacgccgccgcaccctaaccctagccgcacgccgccgcctcgccggagccgtcaccgccggaagaagatggcccggtcgtgcgatgccatggagagggcgcgtgcggtggctggggagagcggcaagtggtgggcgctgctgctggggtggtcggggaaggccgactacatcgaggcgccaacgccggcgaaggagaaggcgcgggagctgcgtgcgaggatggcggagacggagagcttccacgacgccatgtaccactccgccatcgcctcccgcctcgcctactccgcctaggcgcgccgccgcctccgccggaggaggaggaggagggagatgagtccaactcgccgccgccgccgggggtggcatcgccgcgacggcgtgtatataaaacccgggtgggattcgtctcgttgctctagctgctgttgttgcggaggaaatttagaagggatctggtttttttagaattgatcccttgcatccatccatctactttgccttttcattttcttccgagatgtaatctggatctgagatcgagatctacccgcttgtggtggactatgatgcatcagatccattaggtttgatatgaacttgttgctatggatgcaatggtcatgtatggtttgatatgaacttgtcgctatgggtgcaatggtcatgcccttgttttttccttgtgatatgtcgttatttgttggtatgcaatggtcatgcacctgttttttccttttcaaaaaaatcatttccgatttttccttattttttccaccattttctaatttttcccacattttcctaattttccccggaattttaatcatttttaaaatttattctcactttttctgattttttgccttttttaatattattttccattttttctgattttttaacgccttttccaaattatttttaatttttctgattttttaaacccattattgtacacaagggcaaaactgtctttatatagcccctaacacctctgttatgtatccatccatccaaaatggcacacgggtcaacgaaagttgggctcatggcatacaggtaactccaaacttttttgtggcacacaggtaagcaacaactttcctaatggcacaggggtaaaagactcccccttccacctctccctcactctcctcagcatgtatcctcttctcctttccccagcggcagcggcgggtgacgtcggctcctcccctttggatctggccggaggtaggttgtagcactcggcggtagagaggaggggcggcgcggtgccggcggcgggtggcgtcggctcttccccaccggtccgggggtaggtcggcagcgcccagtggtagggaggtggaggggcagcgcaacggttgcgggcggcatcggctcatcccctccggatcttgcggcaggtggcttccggctccacctctccggatcttgcggtgggcaaggtccagttcctctcctccggatcttctccctctccttggccagaggtttggttggtagagcgacggcatcctggagcatccgccaggcggtagggggaaggaggggcggtggcggaagctcacgtggcggctcccctctcctccctttcctagatcctcgctccggtggcttggcgcggtagcggtgactgcttgctccaccgacaacggccatctgcgatgatggtgtgatggatttgttttgtttgtgaatttatgatgcttccgtgtggattcgatttgattttggagatgggggattggattagattggatgggaattgggaattgggaaatgggaaataggaagctgcggctggccaaaacggcatcagctgcaattttttttagcataacaaaatctcttcgcaggcggatcagttgcccgcctaggaaaatcatggtttttacgggcgttgaggtacagacgtcattgctgtccgcttgtgaaatacgttttgtccgcctgcaaaatacctttttttttaagtagtgcaagacatcatattggcccatcagttccattattaattctgtaaaaatacaacaagcttgctcaacacagtacattgaccaatcaatggccaactgccaaacaagcgttattacaaattcaattttcatctcacgaaaaattaacaaacatatcaaacatatgcacgcgtcaaagattaattactagatgcaaattcatgacaaaaaacgagtagatgaaacagacacaaacaaggtatatatccatggatagctagctagctagtcgacatagtacatggggttggggaacttaaaggtgcggcaaccatccggcgagcggcggatgtcgttccactggtcgccaatgttgccgacgatgatgtagccatcattcaccagcttctgtcgttcgcaggtcttgaacgccaacgtcgaggtctgaagcctaaccggctgcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29101 - DNA, 331 bp, Oryza sativa
ccaggcgccacacggcggcgtggccgcgtatgtgacggcatgatgatgactacggactacggtggtggaggtggttgtgggtggccgtgtcgccgtctaggggggtgtcgcgtacgacgtagacggcgcacgtcgtccacgtggtgcacagaccgtcaatcggcggctgactctgaccaggaacagggtttcaggtacggggatggatgctgtcacgttggcacaccaaagtcagcggcgtacacaaactttctcgtgaacacgctcacatatgtgtggtacaaatgttcaccaatgtgtagtaggtaatccctccgtcctattttaagtg

SEQ ID NO: 29102 - DNA, 478 bp, Oryza sativa
gctccgaaagattcttacgttccgtttgcaccacagctcctaggagatgagaatcactagggtctttatgaccttaatcggattttgcatactgtgcgtaagcatgtaccaccactcttcgacggaggtgcaattgtcctaattttgaaggttaaggtgtaggcccgactatcttttaatctatctccatccaaattcgctaggagaatctacagtcctgccattggtgttggtattagaggttatgtctcgctgcaaaacgttaagaattatgaaactgaaaggagtaggattagacgtgttattacgtgactacgtgagtcgatcgatcaagtagctgactttgccaagttgccagccactcactcaccacttcgcaagcagcgggagaatgtggcgcggccaactacctcgaggctgcctgaatttgctgaagcaaagagcgcgcacatgcttgattcgaaattgctaaacttca

SEQ ID NO: 29103 - DNA, 414 bp, Oryza sativa
ttttatgatcctcggaaaagtacctcgagattttttttttacctagagataccaaattttatactagaaggtataatacatcccggaatttttttaaggatgataaaattacccatattacatacatgaacacctaagcaaaattctcactttgcatttttgatgaaaaaaagatgtgtgatgtggtcaaatatgttcatggttaatttgtgtttgcccattgtttttgttgcagataatgaccaatgggaccttcagggctccattgcatagggtggtgacaaatgcagagagggagagaatgtcggtggccatgttctacgctgtggatggcgagaaggagatagagccggtggctgagctgctggggctgaagcaacaatcagcacggtacaggggaatcaagggcaagga

SEQ ID NO: 29104 - DNA, 1063 bp, Oryza sativa
  unsure (1)..(1063): unsure at all n locations
nnnnnnnnnnnnnnnnnnnnnnnnnnnnnnnnnnnnnncagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccnattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgaggg

SEQ ID NO: 29105 - DNA, 666 bp, Oryza sativa
  unsure (1)..(666): unsure at all n locations
acttcagcgccgtagcgcctggtatgagcctcgtggagaagcaatggctagtccacggggctcatacttcagcgctgcagcgcttggtactcggacctcggctcgaggcattttctctaccccttcttaccctgaaaaagcagggtcaccttgtgtccttaaacctataaccatctttcggctaacctagcctcctccgtccctccgtaccaacaaggggtagnnnnnnnnnnnnnnnnnnnnnnnnnnnnnnnnnnnnnnnnnnnnnnnnnnnnnnnnnnnnnnnnnnnccgtggacgaaccttgcggaggaaaccttgggttttcggggcattggattctcaccaatgttttcgttactcaagccgacattctcgcttccgcttcgtcgacccccgctttcgcggttgcttccctctaaggcggaacgctcccctaccgatgcattttgacatcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcacccccacctcctttatcactgagcggtcatttaggggccatagatggtgatccgggatgtttccctctcgacgatgaagcttatcccc

SEQ ID NO: 29106 - DNA, 1412 bp, Oryza sativa
ctggatcacctccttttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcggggg

SEQ ID NO: 29107 - DNA, 502 bp, Oryza sativa
  unsure (1)..(502): unsure at all n locations
taaaactagcatattggaagattaatcggtttaaataaccatgagcggccacaatattataagtttcttcctcttgaccaaatctgtaaccctcattagcagattcgttttcagtggtttccctgatcaaactagaggttaccaaggaaccatgcatagcactgaatagggaaccgccgaatacaccagctacacctaacatgtgaaatggatgcataaggatgttatgctctgcctggaatacaatcataaagttgaaagtaccagatattcctaaaggcataccatcagagaaacttccttgaccaataggggaaatcaagaaaacagcagtagcagctgcaacaggagctgaatatgcaacagcaatccaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29108 - DNA, 403 bp, Oryza sativa
gaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgat

SEQ ID NO: 29109 - DNA, 353 bp, Oryza sativa
aagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctgga

SEQ ID NO: 29110 - DNA, 1676 bp, Oryza sativa
aacagaatgtgatacgatgagataaaatgcaatagaaacaaggatagcgaacgggttacctactcctaagggtcaaagcaagccctttaattcaattctttattcttacattaaagaatgaatcaaatctcccctctgggatgtaaaatatatcccttctcaccatccccttatgcattatgttcgatatcaaggaaaggcaattcttgcatcaaaaggaactcttcttttgaagaagaaatggaaatgttaccttgtccgtttgtggcaatattctttctctttttggactcaaccgcaaaggatccatctaaaccaattagaaaactcttgcttcgattttctggggtacttttcaagtgtaccaataaattctttgtaagtaaggaatcaaatgctggagaattcatttctaatagatactcaaatgaaaaaattcgataccaaagtccctgttactcctctcattggatctttagcaaaagcccaattttgtactggatcggggcatcctattagtaaaccaatttggaccgatttatcggattgggatattcttgatcggtttggtcggatatgtagaaatctttttcattatcacagtggatcttcaaaaaagaagactttgtatcgactaaagtatatacttcgactttcatgcgctagaactttagctcgtaaacataaaagcacggtacaaattgggattcatttagcaaccgatttttatcttccatttgaactcatttccataattcttctagtttctttaataggtgcaattactatggctcggcaataagaaatacttagaatgagtcaaaattataagaatttcaaatctaaaataaatcactaaagaaccacaattttgatttagtaaaactcatctactgccaacaaataccttcttttctcttttgttgtgtaattgttctattctaattaattcaatcggttcaattcttgtccccatattgaaatgaatcgagattgataaggagttagttaatgatgtttgagcatgtactttttttgagtgtctatttattttcgattggtatctatggattgatcacaagccgaaacatggttagagctctaatatgccttgaacttatactgaattcaattaatctaaatctcgtaacattttctgatctatttgatagccgtcaattaaaaggagacattttcgcaatttttggtatagcccttgcggctgctgaagcagctattggattatccattctttcttccatccatcgtaataggaaatcaactcgtatcaatcaatctaattttttgaataattagacatagaatcttctaaacaaagggacacatataataataatatgaaatagtaacatgaatactatttattatttgagaatatctattttttgagtaggttattccatagtattcttttttacttagttgaatttttgcaattcattgatattgcaatttgaatattgcaataatttatattgaaaagacgatagccaatttattggctaatcgaattcgtatatacaattcgtataattatgattgttgaagcccaaaattaaagtctcttggctcttttcatgctttctcacaaacggattaagaaatatattgcattatttgttgaagtttggatgaaccattgcttcgtctggtgt

SEQ ID NO: 29111 - DNA, 4592 bp, Oryza sativa
  unsure (1)..(4592): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcggctgctgaagcagctattggattatccattctttcttccatccatcgtaataggaaatcaactcgtatcaatcaatctaattttttgaataattagacatagaatcttctaaacaaagggacacatataataataatatgaaatagtaacatgaatactatttattatttgagaatatctattttttgagtaggttattccatagtattcttttttacttagttgaatttttgcaattcattgatattgcaatttgaatattgcaataatttatattgaaaagacgatagccaatttattggctaattcgaattcgtatatacaattcgtataattatgattgttgaagcccaaaattaaagtctcttggctcttttcatgctttctcacaaacggattaagaaatatattgcattatttgttgaagtttggataaaccattgcttcgtctggtgtctacaatacatttgattgatatagtactaatttcattttgaccagatcgaaaatttttatgttgaaaaggaaaatttatagacccaatgtcacattccgtaaaaatttatgatacatgtataggatgcactcaatgtgtacgagcttgtccaacagatgtattagaaatgataccttgggatggatgtaaagccaagcaaattgcttccgcgccaagaaccgaagattgtgtgggttgtaagagatgcgaatccgcctgcccaacagattttttaagtgtccgcgtttatttaggacctgagacaacccgcagcatggctctatcttattgatacgttacaaaaaattccacttgaatcgtctgattcctctttaccgaagaagcctgtgctcaaaataatcgagcacgggcttttctggtcaaaacgtatcttgtctttatcactttatcatgagttcttttccttggttaacaatacttgttgttttgccgatatttgcgggttcattaattttctttttacctcataggggaaacaaaatcgttaggtggtatactatgtctatttgtttattagaattccttctaatgacttatgcattctgttatcatttccaattggaggatcccttaatccaattaaaagaggattctaaatggatagatgtcttcaatttccactggagattgggaatcgatggactttcattaggatctattttattgacaggatttatgactactttagctactttagcagcttggccggttacccggaattcccgattattctatttcctgatgctagcaatgtatagcggtcaaataggattattttcttcgcgagaccttttacttttttttatcatgtgggagttagaattaattcctgtttacttacttttatccatgtggggggggaagaggcgtctctattcagctacaaagtttattttgtatactgcaggtggttccatttttttcttaatcggagttctaggtatgggcttatacggttccaacgaaccaagattagatttggaaagattaattaatcaatcataccctgcaacattggaaatactattttattttggcttccttattgcttatgctgtcaaattgccgattatacccctacatacgtggttaccagatacccatggggaagcgcattacagtacatgtatgcttttagcgggaatcctattaaagatgggagcatacggattgattcggatcaatatggaattgttacctcatgctcattatctattttccccttggttagtaataataggagcgatgcaaataatctatgcagcttcaacttctcttggccaacgcaatttcaaaaaaagaatagcctactcctccgtctctcacatgggtttcattattataggaattggttccataaccaacattggactcaatggagctattttacaaatattatcccatggatttattggggctacactttttttcttagcgggaacggcttgtgatagaatgcgccttgtttatctcgaagaactgggaggggtttctatcccaatgccaaaaatttttaccatgtttagtagcttttcaatggcttctcttgccttaccaggaatgagtggttttgttgcggaattagtagtattttttggactaattactagtccaaaatttctgttaatgccaaaaatgctaattacttttgtaatggcaattggaatgatattaactcctatttatttattatctatgttacgacagatgttctatggatacaagctatttcatgttccaaacgaaaattttgaggattccggcccgcgagaactctttcttttaatctgtatctttttaccagtaataggaatcggtatttatccagattttgttctctcgctatccgttgacagggtagaggctctgttatccaattattatcctaaataggattttttttcttctactagtccgctctatattccatagtggaaatactcaaaaattcagaaaaaagtaaaagagtctaattagatctatctcgaatttttgagaaccctttgagaaggcgttcaaggggttctcaaatcaaacacaaaaatggaagttttttccatttcattaaggttttatgttatgtaatcatttagatgggtaatgtaaatgaaccataactatgtaaacctattcctaatagattgataccaaaataacagatccaaattataagaaatcctatggaagctacaaatgctgacttcgtacccttccaatttggatttgttctactatgtaaataaattgcaaatatggtccaagtaataaatgcccaagtttctttaggatcccaattccagtaggatccccacgcctcattagcccatactgctccacaaagaatacctatggttaaaagggtaaaccctagactaatgacacgataactccaagaatccaaacgctcaattaattgatatttgtaataatttggaaataaaggaaaaaaggtgctttttaaagcacttctttttgcatagaaatattcaatctcattaaagaaaaatgttttgcttaaaacatttttcttctttttcgaaaagaaatctaaattctttcgaaatctaatcattagaagagcggcggataataaggatccgcacaaaagagtcgcatagcttagtaacatcatactgacatgcatcattaaccactgagattgtagagcaggtactagtattgtggattgatgcatttcagttaaaagacccgacgtggcaaagccttgcgttaaaatagtactcggcgtagttattgtgcttaaatcatttttagagttctgtatcttaggaatcatatgaagaatatacagagcccatgaaaggaagatcaatgactcatataaattacttaatggaaaatgtcccgaagaagcccaacgagaaactaagaatcctgttatacagaaaaaagtggctatcattcctttttctgacgaatcacgcaatcccccaagttcacgaactaataaggttattaaatgaatcgtaatcacaattgaaattgttgagaaagaaatatgagttagtatatgttctaaagttgcaaatagcataaggagaaggtcccattacaaaattggaaatttcgaattgaatccattttattttataatctattgtattctttttcgagactgccgccactcggactcgaaccgagatgcttgagcactgcttcctaagagcagcgtgtctaccaatttcaccatggcggctaagttgaaataacaggtttattaaaagaatattaagttattttctcgcgaatcgtcgagattggaagattccatagaatttaggacattagaatcttcattaaaatagacttcgtttggtagtatcgttgcgaattttttaacaaaaaaattcttgctttgcccaatagaaactttgaaagagttggaacaattttttctcagttgcatatagaactaatttttttgttaatttaggataagataggtagaagttgtaagtcttattgcaggaatactctacttttcataatagaatcccctttttttatttattatacggattctattacgaaaagttcattgataggaaaagaatatttaggtcacagtataccaaaaaccctttttttatatatcagagaggtttgttctaagaatattgtaccgaggaattcgacacataaaagtaaactcattaattaatcctaattattcctaattattcatattaaataattggaatttttgggggataggtcaattcatattatcccaaaaccctattatttgtttgttgccgagaaaaaccctttggttttggatgctcgctgacgccagaaaatnnnnnnnnnnnnnnnnnnnnnnnnnnnnnnnnnnnnnnnnnnnnnnnnnnnnnn

SEQ ID NO: 29112 - DNA, 3053 bp, Oryza sativa
  unsure (1)..(3053): unsure at all n locations
atagacttcgtttggtagtatcgttgcgaatcttttaacaaaaaaattcttgctttgcccaatagaaactttgaaagagttggaacaattttttctcagttgcaatatagaactaatttttttgttaatttaggataagataggtagaagttgtaagtcttattgcaggaatactctacttttcataatagaatcccctttttttatttattatacggattctattacgaaaagttcattgataggaaaagaatatttaggtcacagtataccaaaaaccctttttttatatatcagagaggtttgttctaagaatattgtaccgaggaattcgacacataaaagtaaactcattaattaatcctaattattcctaattattcatattaaataattggaatttttgggggataggtcaattcatattatcccaaaaccctattatttgtttgttgccgagaaaaaccctttggttttggatgctcgctgacgccagaaaatgatcttgattttgctaaagaataagattgtactatggaaaaataagtctttttcttccaaagatttttacgaatacgcttttttgacatcgaagtacgtttttttggaactgccattcaaaaaggaaattacttttttctagttgtatgtgaaagacatctattgccgcaaatcaatccatctttcttctttttcttagtatttatacttagatactaaaagatattgaaattctgaattcttttttacttcattttgtctaatgcggataagacaagagttttttaacatattatatattttttttagactttgttttaataatatagaatatatacaaaggttttctatttaaatcaatttatatttcaagtatactctccatatacagatataaggtatgggggcctatcccccatataagacgggaggataaaaggaagggaaaattcaatcaaatagttaattaaagtattccagaattgaattccaatcaatttgagttacgaaacaagggagctgcttcattttaatacaaaaaaatattaaagtaaaatgattcaatcttttttttgtattttaataaaagtccttctttaggtaataactaggtaacgaagttatttcattaactttttgactttaaccaacaaaacctattcttattttttgattgtttcaatgagaaaatttttgaaaaattaagaattctagtatttttttattccttcagaaatagataagaattagtttggtgaatcggaaacttttttcaattttatagaaaaattgaagtaaaattttcaagtaaaaattgcaatttcttttcttatggaacatacatatcaatatgcatgggtaatccctcttctcccacttccagttattatgtcaatggggtttggactttttcttgttccaacagcaacaaaaaatcttcgtcgcatatgggcttttcctagtgttttacttttaagtatagctatggtattctcagttcacctgtctattcaacaaataaatggaagttctatctatcaatatctatggtcttggaccgtcaataatgatttttccttagaatttggatacttaatcgacccgcttacttctattatgttaatactaattactactgtaggaatcctggttcttatttatagtgatgattatatgtctcacgatgagggatatttgagattttttgtttatataagttttttcaatacttccatgttgggattggttactagttccaatttgatacaaatttattttttttgggcttacacgtagacttgttgaagtagttcaacatattattggcgtagaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataagactccttacgagcgttctttctatctactattatctaaaaatagtcaagttattaatgactggacgaaaccaagaaataaccccttatgtgcgaaaatatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggtaatgaacttataatcatggaatcgactcgatcatcagattataagttcattccataccggaccagaccgtgcacattcttattatgagaaggggtcattcgagcctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagnnnnnnnnnnnnnnnnnnnnnnnnnnnnnnnnnnnnnnnnnnnnnnnnnnnnnnnnn

SEQ ID NO: 29113 - DNA, 5131 bp, Oryza sativa
  unsure (1)..(5131): unsure at all n locations
ttacacggccaattgcagcgagtgcttgtcaaaaagcttttgtaactaatcgtgtaggggattttggtctgttattaggaattctaggttttttttggataacaggtagtttagagtttcgggatttgtttaaaatagctaataactggattcctaataatgagattaactccttgcttactattttgtgtgcttttttattattccttggtgcggttgcgaaatcggcacaattccctcttcacgtatggttacccgatgctatggaaggacccacccccatttcagctcttatacacgcagcaactatggttgctgcggggatttttcttatagctcgacttcttcctcttttcatatccctacctttgataatgagtttcatttctttaataggtacactaacacttttcttaggagccactttagctcttgctcagagagatattaaaagaagcttagcctattctacaatgtctcaattgggttatatgatgttagctctaggtataggttcttatcaagctgctttattccatttgatcactcatgcttattcgaaagctttattattcttgggatccggatctgttattcattcaatggaacctcttgttggatattcaccagataaaagtcagaatatggttcttatgggtggtttaagaaaatacattccaattacaagaacttgttttttatggggtaccctttctctttgtggtattccacctcttgcttgcttctggtccaaagatgaaatccttagtaatagttggttatattcacccttttttggaataatagcttcttttactgcaggattaactgcgttttatatgtttcggatatatttacttacttttgatgggtatgtgcgtgttcattttcaaaattacagtagtactaaagaggattcgttgtattcaatatcgttatggggaaaaaggatatctaaaggagtcatagagatttcgttttatcaacagcgaagagtggagtttcttttttttcacaaaatctatccaaaattcatgttaatacaggaaataggatagggtcctttagtacttcattggggactaaaaacacttttgtctatcctcatgaaccgggaaatactatgctatttcctcttcttatattactgctttgtactttgtttattggatctataggaatccattttgataatgaaataggggaattaaccatattatcaaagtggctaactccctcaatcaactttttccaagaaagttctaattcttccataaattcatatgaatttatcactaatgcaatttcttctgtaagtctagctatttttggtctattcatagcatatatgttttatggatctgcttactctttttttcagaatttggatttaataaattcctttgtaaaagggggtccgaaaaagtattttttccatcaactaaaaaaaaagatatatagttggtcatataatcgcggttatatagatattttctatactaggacctttaccttgggtataagaggattaaccgaactaacgcagtttttcgacaagggtgtcattgatggaattaccaatggagtaggtcttgctagtttttgtataggagaagaaattaaatatgtagggggaggtcgaatttcgtcttatttattcttttttttatgttatgtatctgtgttcttattcttttttctttcttaaggaattcccctatctcctgcctaagtagctttcctatttgccgattttttccattcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcggtagactcatatcctttcttccttaattcattattccatgaaaatggattattccatgaattcctcaaaacgaggctcatcaaaatgcaaaatctaagactactataagactactaataaaataagaaaaaaaattcgaacgatgaaattaccgctccctaatatccaactgactgattaatttcttataacgtactctatttttctttgccaaataagccagcaaacgttgacgttttcccaaaagtcttcggagacctctttccgatgaaaaatcttttttgtgtaattccaaatgtgaagcaagtctccgtatcttattggtgaaactgaatacttgaaattcaacagaaccccagttttcttctttttcttctttaaccataaatccaaaaatttttctacctcctttctttttcatgtatttttctgatcaggaaaaataaaaaattatgtcagttattttgaagttattctaatctcgtacacacaaaaatttgcaattattcatctactactggaatttggatttattttatcgatgcaaattggatttggatagaagggtacattcttttattttagatagaagaaaagtttcttctatctaaaataaaagaattttgctgatttatttattgctatatccaatttatggaattgatacaccgtttaattgatatcatttagcaaaatgaaacatagcatatgcatccatctttcggctcgagaatttcacgggatagagatatggtataagaaataggctattaagtaactctaaatgaattgtggatacatctgtatccttaacatactgaaacaactgccattattcgtatcaaaccaatagcgattcatacaagttaaatcttctaatcaatggtgggccaataatgaatttttttgcatatgtattaagacgcttggcctgatttcgaaattgtccagagttttttatgtagttttcattgcaaaatgatggatctccttccgtaactttccaattacgagtacgagaattgaaagacatgaaaattctcaattctctacggcgtctaggagatagatagaatattttcaggaacaagaaaaccagaagaatctttctctctattcactaccattccgcgtcttcgacttctattagtttcttttcttctttaatgcaatagctatagtttgatatagaatccatttctcaaagtaatggaaacctttctcttataggaaatggttcgaaaatcgctattccaccttttaggtatcgtgaaaagtgatacctgtgaagatcgtgcatttcagtcacattcagatccgttttttgagtccatgatataaccaaattggatggatcttccacccgtttagctaagaaagaatagatgcagaggtggataatagatcgatatgaagatcatgagctgccccataatgaaaccaccaggagtcgcgaatatctccttcttccctaatccaagattggagaaagaagatctaagagggacccatggagaatgtggtcagaaacccataatagagtccgaccgcaacgaccgaattaattatcctcatcgagaaacttagactactaagtagaaaagatttgaaaatcatggcatgggtctcctttttttctttctttagagttttctatatgcacaatttctcgatgtttcgatgagaatttcttgactttccatatatagaaagagatagactataaatgacatctcttatgtcaataagaccaaagggatggatattaaatgataggaagtgctaggaagtgaaatagaatgaaatagagccactctgggcttacctatgaaatgaggcatggaacggagccactacgaagaaattccgggagttacgaaagaagcttcggactcatattgttcatgggttgagagcgggagttgaactctaggaggtcgaatcccccttgttcctcagnnnnnnnnnnnnnnnnnnnnnnnnnnnnnnnnnnnnnnnnnnnnnnnnnnnnnnnacttggggagatttgattcattctttaatgtaagaataaagaattgaattaaagggcttgctttgacccttaggagtaggtaacccgttcgctatccttgtttctattgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttggaaggctgtgggcgaggagggattcgaacccccgacaccgtggttcgtagccacgtgctctaatcctctgagctacaggcccaccccgtctccactggatctcttcccgggggtaccccccaaaaggaacctccctctcctcagccatttcatttcgggttaagaagatgggaaagcccctttctctctataagaacagtgcgttccgaggtgtgaagtgggagagaggggatgtgatgattgaggttttgaataagacgacctttgcattttggatttggatctttttcgtatttcaaaatagtgaaaaagtcaaataagaggtgttaagctttttatcattctggcatcgagctattttgccgcaggacctcccctacagtatcgtcaccgcagtagagtttaaccaccaaattcgggatggattggtgtggttcctctacgcctaggacaccagaatatcgaaccatgaacgaggaaaggcatgagagaaatattggctagtaattgtgaagccccaattcttgactggaagggacaccaaaggcctctgccctccctctctatctatccaagagatggaagggcagagcttttttttggttttttcatcttttcatcaaagagttgaacaatgaagatagatggcaagtgcctgatcgatttgatcaggtcgtgtaggaacaaggttcaaatcgttcgttcgttaggatgcctcagctgcatacatcactgcacttccacttgacacctatttaaacggctcgtctcgccgctaccttatcctatttccatgcttctgtcgctccatccccgtatgggtggagaacccgtcgctgtctcggctgtgctaccggaggctctagggaagtcggaggagagagcactcatcttggggtgggcttactacttatatgnnnnnnnnnnnnnnnnnnnnnnnnnnnnnnnnnnnnnnnnnntg

SEQ ID NO: 29114 - DNA, 418 bp, Oryza sativa
acttggggagatttgattcattctttaatgtaagaataaagaattgaattaaagggcttgctttgacccttaggagtaggtaacccgttcgctatccttgtttctattgcattttatctcatcgtatcacattctgttctacgattccacttcgacaaaaggaaagagctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattcgggtaccgagctcgaattcgcc

SEQ ID NO: 29115 - DNA, 262 bp, Oryza sativa
  unsure (1)..(262): unsure at all n locations
aaagatggttataggtttaaggacacaaggtgaccctgctttttcagggtaagaaggggtagagaaaatgcctcgagccgaggtccgagtaccaagcgctgcagcgctgaagtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29116 - DNA, 915 bp, Oryza sativa
  unsure (1)..(915): unsure at all n locations
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggataatagatcgatatgaagatcaacccgttcgctatccttgtttctattgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttggaaggctgtgggcgaggagggattcgaacccccgacaccgtggttcgtagccacgtgctctaatcctctgagctacaggcccaccccgtctccactggatctcttcccgggggtaccccccaaaaggaacctccctctcctcagccatttcatttcgggttaagaagatgggaaagcccctttctctctataagaacagtgcgttccgaggtgtgaagtgggagagaggggatgtgatgattgaggttttgaataagacgacctttgcattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29117 - DNA, 183 bp, Oryza sativa
accccttgttggtacggagggacgggggaggcttggttagccgaaagatggttataggtttaaggacacaaggtgaccctgctttttcagggtaagaaggggtagagaaaatgcctcgagccgaggtccgagtaccaagcgctccagcgctgaagtatgagccccgtggactagccattgctt

SEQ ID NO: 29118 - DNA, 550 bp, Oryza sativa
tgtaaacctattcctaatagattgataccaaaataacagatccaaattataagaaatcctatggaagctacaaatgctgacttcgtacccttccaatttggatttgttctactatgtaaataaattgcaaatatggtccaagtaataaatgcccaagtttctttaggatcccaattccagtaggatccccacgcctcattagcccatactgctccacaaagaatacctatggttaaaagggtaaaccctagactaatgacacgataactccaagaatccaaacgctcaattaattgatatttgtaataatttggaaataaaggaaaaaaggtagttcgggactgacggggctcgaacccgcagcttccgccttgacagggcgggtttgagattttgagaagagttgctcttttgagagcacagtacgatgaaagttgtagctgtgttcgggggggaagtattgtctattcgtggcctctatggtagaacccgttcgggaggcctgagaggcggtggtttaccctgtggcgatgtcagcggttcgagtccg

SEQ ID NO: 29119 - DNA, 876 bp, Oryza sativa
cagtcggacaagtgggtaatgttggggtgaaccaaaaaagttgggtagagccgggtctagtgttgctaggtaaacgccccgtagtaagaggggtagttatgaaccctgtggaccacccccatggggcggtgaaggaaagcccccattggtagaaaaaaacccacaaccccttggggttatcctgcgcttggaagaagaactaggaaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaaagaaatacccaatatcttgcttcagcaagatattgggtatttc

SEQ ID NO: 29120 - DNA, 621 bp, Oryza sativa
  unsure (1)..(621): unsure at all n locations
nnnnnnnnnnnnnnnnnnnnnnnnnnnnnnnnnnnnnnnnnnntcaaattgccgattatacccctacatacatggttaccagatacccatggggaagcgcattacagtacatgtatgcttttagcgggaatcctattaaagatgggagcatacggattgattcggatcaatatggaattgttacctcatgctcattatctattttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttgcagaatttaagtgttttctagtgagtc

SEQ ID NO: 29121 - DNA, 723 bp, Oryza sativa
ctcggtacccccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattggggtttattactcatttttgtacttgctgttttattttccaattacttcttcaattgagagaaagaaagagagtagtaagaattctcttatccccatttggaaggataccatccttataactatccatgactgtttttgctctagcatgaccacttgataaaatgtggaggaaagtaggggaaatggccgatactactggaaagaatcctcttttgctgataggtactgtaccccgtattgctgtgaatggtttaataggtgtttcttttacgggtcatattctgggattgggtcatctctatagtattggagggaccaggtg

SEQ ID NO: 29122 - DNA, 732 bp, Oryza sativa
ttcttcgaatatgtccttgagtttattcgagacttaagcaaaactcagattggagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggct

SEQ ID NO: 29123 - DNA, 888 bp, Oryza sativa
ttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtaccgagctcgaattcgccctata

SEQ ID NO: 29124 - DNA, 802 bp, Oryza sativa
  unsure (1)..(802): unsure at all n locations
gaatagaaatagcctattcctacatagggaaagtcgtgtgcaatgaaaaatgcaagcacgatttggggagaggttttttctctattgtaacaaggaataattatctactccatccgactagttccgggttcgagtcccgggcaacccatatggaaactagaaaggagcaatctgagttttgatttttcactcacttcatttacaaaattttttggtttggtaaattttgttgtatggatatacaactgtcggggctggcttggttgacattggtatatagtctatattatactgttggctcataacaaattaaaagttgctcctgctactcagcctagagccttgagcattatacaaggacgtgctgtaggagtaacccattaccttctgggtggaattgccacaacatgggcattcttcttagcgagaattattgcagtaggatagtggctaggaggatttgaaaggcattatggaattaagatttcccaggtttagccaaggcttagctcaggaccccactactcgtcgtatttggtttggtattgctaccgcacatgatttcaaaagtcatgatgatattactgaggaacgtctttatcagaacatttttgcttctcactttgggcaattagcaataatctttctatggacgtccggaaatctgtttcatgtcgcttggcaaggaaattttgaatcatggatacaggatcctttacacgtaagacctattgctcatgcgatttnnnnnnnnnnnnnnnnnnnnnnnnnnnnnnnnnnnnnnnnnnnnnnnnnnnnnnng

SEQ ID NO: 29125 - DNA, 1012 bp, Oryza sativa
attttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatcttt

SEQ ID NO: 29126 - DNA, 1821 bp, Oryza sativa
  unsure (1)..(1821): unsure at all n locations
nnnnnnnnnnnnnnnnnnnnnnnnnnnnnnnnnnnnnnnnnnnnnnnnnnnnnnnnnnnncagttcggtagagcaactcgtttacacgtgcgccaatgcttttcaagggagcttattatgcaatgaacatagtggatcttcttgcaaaatcaatgtcttacttcatggattcgagagaataggagaacagtcgcctgacaaatagttggttcagtccgattcaggtaccaatccaggtgcctaaacaaatagaacctttattgatttgctagttgataaggtaaatatccagcccactaaatgctaggcttaatgaggataagggcctccaaaaaaattcttttcgttctatgaactttaaggtgtatgaagtctcatagtcaactcttgtagcggaacgatagagactctatttcacttaggttgatttaatttaggccggaggcagacctaagtcaaggtaatcctcctttgaaacactttggtattgctcttagatagatcataatacaaataatcaatcagagcgcagggagccatctcattatctttccgtaaagaaaaactatggtggactaactgatctttctatcagttgataaaagagcccaatgcaaaaaaatgcatgttgggtctttgaaacagttcgaatcatttcgataataatccgtttgatctgttttaccgagaaggtctacggttcgaatccgtatagccctaatatgtccttttttagattttaggagagatatcctacgtttcctttagtatagttttcatttccctattagtacttgtttatagactggacaggcgcctgcgccataaaatagagataaaaggattaccagaggctcattcatcgaaaattatagagacaggaaaagaaaaatgaatttctatcaaatcaactgcaagatgttctccatcttgcaaattcctactttgtttgaagtatattactttgcttatctatatctatagattacctaaatctaaatcaatctacgttctgaaatagagttctttatttttatagaattactcctcattaggctgcatacattagtcatcctatcttaattaggctctaattcgtagtattttcgtttttattcctttttctagagattctagagaaaatgagacaaagtgaagcgagagagttttgtttctataagaattatgtctccaccatacctaaatagaaaggaaatcaaaaagaaagggggtcgggattccattggatgaatctttaaagaagacgtggcaaagaggaaacaaaggctaaactaagccctttggtttgagaaaaaccgatccttgtttcaccgaggaaaagagagaaattctgtataaattgacaatgctgacttgaattgactaattcagttccgcctattccacattaatgggagtacatttatgtttctgcttcacgaatatgatattttttgggcatttctaataatagcaagccttattcctattttagcattttggatttcagcacttttagctccggttcgtgaaggaccagagaagctttctagttatgaatcgggtatagaacccatggggggggcttggttacaattccgaatacgctattacatgtttgcgctagttttgttgtttttgatgtggaaacggtctttctctacccttgggcaatgagtttcgacgtattgggtatatccgtttttatcgaagctttcattttcgtgcttatcctagttgttggtttagtttatgcatggcgaaaaggagccttggaatggtcttaactgaatattcagacaaaaaaaaaaaagaaggaaa

SEQ ID NO: 29127 - DNA, 7604 bp, Oryza sativa
  unsure (1)..(7604): unsure at all n locations
gtgagattatatgagcaaatgcctgaaccaaaatacgtcattgcttgggagcttgtactattactggtggaatgttcagtacggattcctatagtactgttcggggagttgataagttaattcctgtggacgtctacttgccgggttgcccacctaaaccagaggctgttatagatgccctaacaaaacttcgtaagaagatatcgcgagaaatagttgaggatcgaactctatctcaaaagaaaaatcgatgttttactaccagccacaagctttatgttcggcgcagtactaatactggaacttatgagcaagaattgctctatcaatcaccatctactttagacatatcttctgaaacttttttcaaatccaaaagtccagtatcttcctacaaattagtgaattaggaggagctctttgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttgcaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaagttccgattttcaagaacgcgaatcttttgatatggtgggaatctcttatgataatcatccacgccttaaacgtatcctaatgcctgaaagttggataggctggcccttacgtaaggactatataacccccaatttctatgaaatacaagatgctcattgaatgataagaaattcatgctcacttatacaacacaactccagattttatgcaagtcaaggaatatttttacgctctgttcctagatgaaacagaatacctattacattctaattaattccaattatacaaaaggttcagatagactaagcaaaaaagggcttcatttcgttggaaaatcacatattcatttccttcgtatgaacagaaaaatatgatgactcaaagaagttccctaccacgaactttgtaccgcgtgcattacttagaacaactagtaaagtaagataagataagcaagaataaaaaaatatttgtcggaatagcggaatagaaaattaagaaatgcaaaaatgcagaaaaagaagtgcctctatttagagatttatctacttagatgaaaaaatcatactctatctatattattaacgaatatgtatcccaacccatctcgaggtatttgtatcaatacctattcggaagatcccttttttctgtgccaggaaccagatttgaactggtnnnnnnnnnnnnnnnnnnnnnnnnnnnnnnnnnnnnnnnnnnnntgaccttttcttgtgcatcatcctagtagagtatttgtatctatgtcaatatccaaaatttggaaatggggagggggcagtcctatgcattgtacaaagaaagcctatttaataatatttaaatatcgagttaataatcgacattccttgccgatactataataaaaaagaaatgtattccattgaatcttaaacctattaataaaaaaacaggataaatactagagttagggaataaaagagggtttggggatagagggacttgaaccctcacgacttagaaagtcgacggattttccttttactagaaatttcattgttgtcagtattgacatgtagaatgggactctctctttatcctcgtccgattaatccgcttttaaaaagatttcgaaaactatgaattgaaggatttgattactcaatattcgattggaatggattcacaacaattctaaaaaaattatgaattttctatttcataatcattcctattttcattttaaaaaagaattaaagaacctatattatgatatgagttctgtgattaatcgtttgctatgccagtatctatacgtgtgtattagatttcgaaagcccttctttccctaatttagaagggagttccgctagcaacacaacgtaattaactcgattcgttagaacagcttccattgagtctctgcacctatccttttcctttgggttctagttcgagaaccgcttgttttctcaaaacatggatttggctcaggattgccccttttttaattccagggtttctctgaatttggaagttgccacttagcaggtttccataccaaggctcaatacaatcaagtccgtagcgtctaccgatttcgccatatccccattttctttttctttgagaccaggattccttgtgcaatttcctccatctgttagttttttttgaatcgttgaattcattactctatgtagtctagcggttcgtctctagttgagagactccgcttattgcaattcagcattgaattgattctatcgttgatgtatttgcaattcaatgcgaatcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaaacaaaatatctcaaaaaatgtctataatgatggactgaaaatacaagaaattcgcatgttctctttattatgttttcgtatataatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagaaattccattctgggaaaaaagaacaatatcgtattcgtcttcaagaaaaacagaaattgcgttttcattatggtctgacagaacgacaattacttagatatgtacatatcgctggaaaagcaaaaagttcaacaggtcaggttttactacaattacttgaaatgcgtttggataatatcctttttcgattaggtatggcttcaaccattcccgaggcccggcaattagttaaccatagacatattttagttaatggtcgtatagtcgatataccaagttttcgttgcaaaccccgagatattattactacgaaggataaccaaagatcaaaacgtctggttcaaaattctattgcttcatccgacccggggaaattgccaaagcatttgacgattgacacattgcaatataaaggactagtaaaaaaaatcctggataggaagtgggtcggtctcaaaataaatgagttgttagttgtagaatattactctcgtcaaacttgaacttaaggaaaaacggaaaggttcatagaattttcttccccttcccctttccccgaactaaatcgacctaaggctcttaattcgtattttcccattcacctaacagaaatggattaaccctaggattcctttttgttttttgttctttcctctatgtgtattttacataccatagtaatttggtatagagaatttctattaaataaaggtattgtattattgctggaataaattgtcatttgatttgatacattgtaatcattaacgttgctgaattaagaaaaacggaaagagagggattcgaaccctcggtaaacaaaagtctacatagcagttccaatgctacgccttgaaccgctcggccatctctcctccataatcttattatggaaaaaaaactgagtgaatagcgagttttcctattcctgcagtacaggtacaaccacaaccgcgcgagagttccattgttctattagatagaaaaattccttttcatctaagtggacgggtccaggatttttttactaggaattccgctccctcgaaaagttttagtttgggttttccccaaaccaaagaaaaagagaatggaagaattcttcttattcgataaaaaaggaaccctagaattctgtttgcataaggtatcctaccccatacaatcaaatagaaaatagggtatgggacgattaatgactttgaaaatgcgaaatagttgatgagagaagttgttgttgagaaaagaaataggaaagtggaatgaaatccaatcttagtcaaatattttctatctcttcttgttcaaacagaaggaaaaagagagaatttgggctgagcagaaatacctctcttatccatttggagcatagggatcgatttataagaattgaatggatttgttttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatggtgcgatttgactcttttttttgtttttttagccctacctacaccccggttttacgagaaagagtgggggttcgcggagagaaaaccaaattagtaagggaaacccacgcttagggaaggtgaggtgaactaacaactccttctgtcgtgtatcctcgactgacgcggcctcggatgcttcaattgtagattttagtattgagcgaaaggttacacctacaggataggttctgtattacaggctaatcctactctactagtactaataggtagcataggggataaaagcactacacctagaaataggaatcaacaagagaaaaactttgttagaaattaaccctttcctgattggtatcagggctgggaagaatggttgggataacaaacaaccatcaagtttgtactttggatacccctataaccatcaaagatcgttgaagtggctaattcctctaaataggaggcgttgagaacaaagaaattcttggagctatcgttttcctctagcattaatagaattcattggtgttaagaaaaacctcttgtgggaaggttggctagagatttcttggaaaaataccagcccctttcggtccataatgagatggaactaattctatttttattctctagattttttcgcttagtactatgtacagaagggaggagccgtatgaggtgaaaacctcatgtacggttttggaacggagattttttgaatagaacgaacgaccgtaacggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacgtgcgactatctccactatagaaagaaaaataagaaaggatcaaattttctagtatttactagaaaagggggctttctacatagggatcgtcaaaacaacgattttgccctatcagctgtaggaagaaaggacacttcacgagaatcaaaataggaagaaagaaagtatggcctatactactctatggatagagttctcaaattgatagagaaagcaccgtaaagatcaattagtgaccgactgggtcgatacaactaaaaaaaactgcttacttatcccatgatatggggcaaaatttaggaatccgcttatgtaatagagccgatccactaagggattaagcagcggtgtagtatcagatcccaaagatagtaagttcttttttcttgcttatggggaaaaagtctttttcaaggattctatagaaatttcatatatgaaaccgagatagttacctttcagaaaattcggacgaaggatataggtctatctatgcttcatttttctgcaggtgggagaaaagatcaaactgattattgatcaaaatttagggtttgaaacttaggtaattaacttcttctgcgtaacccaagaagaaattggatcgatttttgagaaatcgaattcagttaagacaagggaaattaagatagcaatttctgagccgtatgaggtaggaaactctcaagtacggttctaggggaaggaactacctattccgaccggggagaacaggccattctacagggtgattcagaaattgcagaagcttggtttgatcaagctgctgagtattggaaacaagctatagcgcttactccgggaaattatattgaagcacagaactggttgaagattacgaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaa

SEQ ID NO: 29128 - DNA, 1530 bp, Oryza sativa
tttccaattatgaagcatggctaagtgatcctactcacattggacccagtgctcaggtagtttggccaatcgtagggcaagaaatattgaatggtgatgtaggcgggggtttccgaggaatccaaataacctccgggttttttcagatttggcgagcatccggaataactagtgaattacaactctattgtaccgcaatcggtgcattgatttttgcatcgttaatgctttttgctgggtggttccattatcacaaagccgctcccaaattagcctggttccaagacgtagaatccatgttgaatcatcacttagcagggttattaggacttgggtctctttcttgggcggggcaccaaatccatgtatctttaccgattaaccaatttcttgacgctggggttgatcctaaggagataccacttcctcatgaatttatcttgaatcgcgaccttttggctcaactttatcctagttttgccgaaggagcaaccccttttttcaccttgaattggtccaaatacgcagaatttcttagttttcgcggagggctagatccaataaccggcggtctatggttgagcgatattgcgcaccatcatttagctattgctattcttttcctgatcgcaggtcatatgtataggaccaactggggtattggtcatggcctgaaagatattttggaggctcataaaggcccatttacaggacagggccataaaggtctctatgaaatcctaacaacgtcatggcatgctcaattatctcttaacctagctatgctaggctctacaaccattgttgtagctcatcatatgtactctatgcccccctatccatacctagctactgactatggtacacaactttccttgttcacacaccacatgtggattggcggatttctaatagttggtgctgctgcacatgcagccatttttatggtaagagactatgatccaacgactcgatacaacgatctattagatcgtgtccttagacaccgtgatgcaatcatatcccaccttaactgggtatgtatatttctaggttttcacagttttggtttatacattcataatgataccatgagtgctttaggtcgtccccaagatatgttttcggataccgccatacaattacaaccgatctttgctcaatgggtacaaaatctccatgctggcgcgcctagcgtaacagctcctggtgcaacaacaagtaccagcttaacgtggggaggtggcgagttagtagcagtaggcggcaaagttgctttgttacctattccattaggaaccgcagattttttagtccatcacattcacgcatttacaatccatgtgactgtattaatacttttgaaaggtgttttatttgctcgcagttcccgtttgatacccgataaagcaaatcttggttttcgcttcccttgcgatgggcctgggcgagggggaacatgtcaagtatccgcctgggatcatgttttcttaggtctattctggatgtacaattccatgtcggtagtca

SEQ ID NO: 29129 - DNA, 196 bp, Oryza sativa
gtttaaggacacaaggtgaccctgctttttcaggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctc

SEQ ID NO: 29130 - DNA, 261 bp, Oryza sativa
caatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttg

SEQ ID NO: 29131 - DNA, 716 bp, Oryza sativa
  unsure (1)..(716): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcaatttggcgaagaaaaaactagtcggataaataacagaattaaaacaaatacaggttaaactaagtatattaggcataacaagcgtttcgttcttgtagagtagataattggattttgattgagttatttttctaagggaaaaaggaaaaggaggattcaaaatccttttttcttcggactttcccaaacacaaaatacctccttgtattcgcactctcaaatgagagtggaagaaattcgactttcatataatatcttaatagaattccatgtaatgatcaatgcattttttggattctatattattcgcatgtctagaatcctaccaagagaataccccccatttttatgtaatggaagtaggattgacgaataagaaataaacataata

SEQ ID NO: 29132 - DNA, 761 bp, Oryza sativa
  unsure (1)..(761): unsure at all n locations
nnnnnnnnnnnnnnnnnnnnnnnnnnnnnnnnnnnnnnnnnnnnnnnnnnnnnnnnncttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatacaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggtaatgaacttataatcatggaatcgactcgatcatcagattataagttcattccataccggaccagaccgtgcacattcttattatgagaacgggtcattcgagcctatggaaataggatactctgtttacatagaaatccccacgtccttacattctatttaggagtaggaataggtgtaatcagaactgcttttgacatagatatcctatccttatttgggaccatatgcacctctttgggcttcgattgaatcgagaaatggattgtacatctttttgactttgaacatataa

SEQ ID NO: 29133 - DNA, 1455 bp, Oryza sativa
  unsure (1)..(1455): unsure at all n locations
gtctcttgcctgctcatggattcagcaggcagttcaaaaggttgacctatttgggaatctccggatctatgcttattttcaactccccgaagcatttcgtcgcttgctacgcccttcctcgtctctgggtacctaggtatccaccgcaagcctttcctcttttgaacctcgccattaacgttaaggctatgccatcctaaggtgctactaaatggaaggatcttatcaacgtccatgaatgcgaaatcatagatcgaactgccgaattggcaaaattcggtgctatcatagtatccgctaagttcacgggctggagataagcggactcgaaccgctgacatccgccacagggtaaaccaccgcctctcaggcctccccgacgggttctaccatagaggccaacgatagacaataactcccccccgaacacagcttacaactttcatcgtactgtgctctccaaagagcaactcttctcaaaatctcaaaacaaaaggtgctgagttggaatcccattctaaggattcttgtggttccggggaatccagctacaggagaaccaggaacggggagctctcccctttttccgcccgactctttgatcttaaacttaagaatgctggttttaagaacgagtgattgcccttctccgacccttactgcccaaccggagagcggacggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagagcggagctctccaagntgagctatatccccccgagccaagtggagtatgcatgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactctccgttgtactgcgctcttcaagtgtgcttcttccccttctcccccttaccatggcaagtc

SEQ ID NO: 29134 - DNA, 4209 bp, Oryza sativa
aaaacagcagtagcagctgcaacaggagctgaatatgcaacagcaatccaaggacgcatacccagacggaaactcagttcccactcacgacccatataacaagctacaccaagtaagaagtgtagaacaattagctcataaggaccaccattgtataaccactcatcaacagatgcagcttcccaaattgggtaaaagtgcaatccgatcgccgcagaagtaggaataatggcaccagagataatattgtttccgtaaagtaaagaaccagaaacaggctcacgaataccatcaatatctactggaggggcagcgatgaaggcgataataaatacagaagttgcggtcaataaggtagggatcatcaaaacaccgaaccatccgatgtaaagacggttttcggtgctagttatccagttgcagaagcgaccccacaggcttgtactttcgcgtctctctaaaattgcagtcatggtaagatcttggtttattcaaattgcaaggactcccaagcacacgtattaactagaaagataatagaaggcttgttatttaacagtataatatagactatataccaatgtcaaccaagccagccccgacagttgtatatccatacaacaaaatttaccaaaccaaaaaattttgtaaatgaagtgagtgaaaaatcaaaactcagattgctcctttctagtttccatatgggttgcccgggactcgaacccggaactagtcggatggagtagataattattccttgttacaatagagaaaaaacctctccccaaatcgtgcttgcatttttcattgcacacgactttccctatgtagaaataggctatttctattccgaagaggaagtctactaatttttttagtagtaagttgattcacttactatttattatagtacagagaacatttcagaatggaaactgtgaaagttttaccttgatcatttatcaatcatttctagtttattagttttgtttaatgattaattaagaggattcaccagatcattgatacggagaatatccaaataccaaatacgctcactgtgcgatccacggaaagaaaagtaagttgttttggcgaacatcaaagaaaaaacttgctcttcttccgtaaaaaattcttctaaaaataccgaacccaaccattgcataaaagctcgtaccgtgcttttatgtttacgagctaaagttctagcgcatgaaagtcgaagtatatactttagtcgatacaaagtcttcttttttgaagatccactgtgataatgaaaaagatttctacatatccgaccaaaccgatcaagaatatcccaatccgataaatcggtccaaattggtttactaataggatgccccgatccagtacaaaattgggcttttgctaaagatccaatgagaggagtaacagggactttggtatcgaattttttcatttgagtatctattagaaatgaattctccagcatttgattccttactaacaaagaatttattggtacacttgaaaagtaccccagaaaatcgaagcaagagttttctaattggtttagatggatcctttgcggttgagtccaaaaagagaaagaatattgccacaaacggacaaggtaacatttccatttcttcttcaaaagaagagttccttttgatgcaagaattgcctttccttgatatcgaacataatgcataaggggatccataacgaaccatatggttttccgaaaaaaagcagggtacattaacccaaaatgttccatcttcctagaaaagatgattcgttccagaaaggttccggaagaagttaatcgcaagcaagaagattgtttacgaagaaacaacaagaaaaattcatattctgatacataagagttatataggaaccgaaatagtcttttattttcttttttcaaaataaaaatggatttcattgaagtaataaaactattccaattcgagtagtagttgagaaagaatcgcaataaatgcaaggatggaacatcttggatccggtattgaaggagttgaagcaagatatccaaatggataggatagggtatttctatatgtgctagataatgtaagtgcaaaaatttgtcttctaaaaaaggaaatattgaatgaatagatcgtaaattctgaaactttggtatttctttttcttccggacaagactgttctcgtagcgagaatgggatttctacaacgatcgcaaacccctcagatagaatctgagaataaaactcagaataaaaaaaattgttgtaatccaataatcgatcttggttaggatgattaaccaaattaatccaaaaattctgctgatacattcgaatcattaaccgtttcacaagtagtgaactaaatttcttgttattagaaccaataatttcgacaagttcggaaccatttaatccataatcatgggcaaacacataaatgtactcctgaaagagtagtgggtagacgaaatattgtctaggaaatttaagtttttctgaataaccctcgaatttttccatttgtatttctacttgaatcagagagagagaaatatttctcggtttatcaaatggtgatacatagtacaatatggtcagaacagggtgttgcattttttaatacaaacccctggggaagaaaaggagtctaatccacggatctttttccgctccttttctatccaatttgtttatgtttgttctaattacaaaagagaacaaatcctttatttttgcaggccaattgctcttttgactttgggatacagtctctttatcaatatactgcttcttttacacattcaatccataacatccttttcaatccaaaatcaagaataattaggatttctaaaaaaaaaagaaaaaatcaaaggtctactcataggaaaaccagcttttccctacatcaggcactaatctatttttaacgtctaattagatcagggagttcttccaattaagaagttaagctcgttgctttttgttttaccagaattggagccaggctctatccatttattcattagacccagaaaatcagaatttttttattccattccaaaaatccaaaataagaaattgattttattacgacatgctattttttccattcattacccttgaggatcagtcgcggtcttatagactctaccaagagtctggacgaattttttgcttcatccaaatgtgtaaaagatcatagtcgcacttaaaagccgagtactctaccattgagttagcaacccagataaactaggatcttagatacgatcgaaatccaaaaatcaatggaattacaccgcacacccctgtcaaaatcttaaaatagcaagacattaaaagaaagattttatcaccattgaaaacactcagataccaaaaggaacgggtctggttaaatttcactaaggttaaaagtggcaccaatcacgatcgtaaaattgtcatttttttagcatttttatttaaataaataaataaatcttgtatgagagtacaaacaagagggacaaccctaccatttgagcaaagtgtaggcaaaaaacctaatagggagtgaggataaagagacttatccatctacaaattctagatgttcaatggacctttgtcaatggaaatacaatggtaagaaaaaaattagatagaaaaactcaaaaaaataaaggcttatgttggattggcacgacataaatccagtcaaaaataggattaagaaagaggcaaattatttctaaatagttagacaacaagggatactagtgagcctctcctagttttttattcatttagttcttcaattaactcaaagttctttctttttctttaaagaattccgccttccttaaaatatcagaaacggttcttgtaggttgagcacctttttcaaggaaatagagaatagctggaacatttaaacaagtttgattctttatcggatcataaaaacctacttttcgaagatctcttccttctcttcgagatcgaacatcaattgcaacgattcgatagacagcttattgggatagatgtagataaacaaagccccccctagaaacgtataggaggttttctcctcatacggctcgagaatatgacttgcattaatttccgtacagaaaaaacaaatttcatttatactcatgaccaagttgactaattttgattgacagacttgaaagaaaaaaatcctt

SEQ ID NO: 29135 - DNA, 7067 bp, Oryza sativa
  unsure (1)..(7067): unsure at all n locations
nnnnnnnnnnnnnnnnnnnnnnnnnnnnnnnnnnnnnnnnnnnnnnnnnnnnnnnnnnnnnnnnnnnnnnnnnttccttaaaatatcagaaacggttcttgtaggttgagcacctttttcaaggaaatagagaatagctggaacatttaaacaagtttgattctttatcggatcataaaaacctacttttcgaagatctcttccttctcttcgagatcgaacatcaattgcaacgattcgatagacagcttattgggatagatgtagataaacaaagccccccctagaaacgtataggaggttttctcctcatacggctcgagaatatgacttgcattaatttccgtacagaaaaaacaaatttcatttatactcatgactcaagttgactaattttgattgacagacttgaaagaaaaaaatcctttgaaattttttgagtcgtctctaaactcttttctttgcctcatctcgaacaaattcacttttattccttattccggtccaattctattgttgagacagttgaaaatcgtgtttacttgttcgggaatcctttatctttgatttgtgaaatccttgggtttaaacattacttcgggaattcttattcttttttctttcaaaagagtagcaacatacccttttttcttatttccttcgataaagcatttccctcttctatagaaatcgaatatgagcgattgattctgatagacttttaatcaaaagagttttcccatatcttccaaaattggactttcttcttattttaaccttttgatttctatattatttcgatttctatattaagggtagaatgacaaagttggcctaatttattagttttcactaaccctagattctttcccttgataaaaaataaattctgtcctctcgagctccatcgtgtactatttacttagcttacttacaaacaacccagcgaaaattcggttcgggacgaatagaacagactatgtcgagccaagagcattttcattactatggaaaatggtggatagcaaaatccacaatcgatcgtgtccttcaagtcgcacgttgctttctaccacatcgttttaaacgaagttttaacataacattcctctaatttcattgcaaagtgttatagggaattgatccaatatggatggaatcatgaatagtcattagtttcgttttttgtatactaattcaaacttgctttgctatctatggagaaatatgaataaaagaaattaagtatttatcgggaaagactccgcaaagagccaatttatttaaacccatattctatcatatgaatgaaatatagttcgaaaaaagggaataaacaagtttgcttaagacttatttattatggaatttccatcctcaacagaggactcgagatgatcaatccaatcctgaaatgataagagaagaattgactcttctccaacaaataaactatcaacctcccgtttaattaatttaattaatatattagattagcaatctatttttccataccatttttccgtaacaaaactaattaactattaactagttaaactattgcaatgaaaagaaagttttttggtagttatagaattctcgtatttcttcgactcgaataccaaaagaaagaaaaaaatgaagtaaaaaaaacgcatttcctgtaaagtaaaattaaggtctttgcttttacttattttttcttttacctaaaagaagcaactccaaatcaaaattgaatccattctatctaacgagcagttcttatcttatctttaccgggatggatcattctggatatttaaaaaatcgcggatcgagatcgtttttgcttaaccaaagaaagaaaaagaagaaggaaccttttttactaataaaatactataaaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgcattaggactgcatcgaatctaagagtttataagagaaaaaaattctctttaataaactttatgtctcgtgcagaatacaatacgatttcatctttcgtttcatcagaaaaaatctgggacggaaggattcgaacctccgagtaacgggaccaaaacccgctgccttaccacttggccacgccccatttcgggttttatgcgacactaataaacagtattatgtttatttcttattcgtcaatcctacttcaattacataaaaatggggggtattctcttggtaggattctagacatgcgaataatatagaatccaaaaaatgcattgatcattacatggaattctattaagatattatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagacaccaccggttttgcttggtgggccgggaatgccagacttatcaatttgtcgggtaaactacttggcgctcacgtagcccatgcaggattaatcgtattgtgggccggagcaatgaacctatttgaagtggcccatttcgtacaagaaaaacccatgtatgaacaagggttgattttacttccgcacttagctactctaggttggggagtagggcccgggggagaagttctagatacttttccgtacttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttgggcgaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattc

SEQ ID NO: 29136 - DNA, 2348 bp, Oryza sativa
aggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaaataaatttttttgtatcttcatccatagatcctttactcatatttaaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatat

SEQ ID NO: 29137 - DNA, 1405 bp, Oryza sativa
gaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttgga

SEQ ID NO: 29138 - DNA, 4918 bp, Oryza sativa
agagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaattttcttcgataaacagaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttga

SEQ ID NO: 29139 - DNA, 12589 bp, Oryza sativa
aaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagtgaagagaaaaaaaagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctctttcgaaatttttcgggactcttaggtactattgcacctagtatatcgaatttttcttcatcttactatttactaacgtataatcagatcctgttaaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctgccttacgaggtcctattgattggttgaaaggcctgaaagaaaacgtagttctgggggggattatacctgttggtaccggattccaaaaatttgtgcaccgttaccccaaaacaagaacctttttttcgaaattcaaaaaaaaagactatttgcgtcggaaatgagagatattttgtttctccatacagaattagtttcttttgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattgattcttaacaaattagtatttgcaatttgtgagggccgttctctctatataagaaatcattgattaagaagaatagttaattcttgggcaactgcgtagatttatggaatcacttactattcttttttgttttgcatagaaaaaagacggggaatattgatatatattagagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattggagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctatacccggcatgttgcttggattatttacaagcggtattcaagctcttatttttgcaacgctagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctggagacgtttccgcctatattcctactaatgt

SEQ ID NO: 29140 - DNA, 2967 bp, Oryza sativa
  unsure (1)..(2967): unsure at all n locations
agtaggatccgcggctcaaattaaagccatgaaacaagtagctggcaaatcaaaattggaattagctcaattcgcggagttacaagcctttgcacaattcgcctctgctctcgataaaacaagtcagaatcaattggcaaggggccgacgattacgagaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatannnnnnnnnnnnnnnnnnnnnnnnnnnnnaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagtttaaccataggtaatctcttaaccatcccatcaaataagtggaggattcattaaattgtgaaacgttgccctgccataatgtgatgtgtttccaatgccaataaaaagtaacccatccaatggtatttaacatccagaaaactgccaaataaaacgcgtcccaagcagaaatatcacaagtaccgccgcgaccagggccgtcgcaaggaaaactatatccaaaatcttttttatccggcattaatttggaaccgcgtgcatctaaagcaccctttactaaaatcaatgtagttgtatgcaaacctaaagcaatagcatgatgaaccaagaaatctccaggtcctattgttaagaaaagcgaattactattctcgttaacagcattcaaccatccgggtaaccatagggttcgacccgcattgaaagcgggaccgctcgttgaagataagagtatatcgaacccatatgtcgtcttaccatgagccgattgtatccattgagcaaatataggttcgatcaagatttgcttttctggagtaccaaaagcaagcatgacgtcattatgaacataaaggcccaaggtatggaatcctaggaagagactagcccaacttaaatgagatatgatagcttctttatggtctaacattcttgccaatacattatcctcattctgttccggattgtaatctctaatgaaaaaaatagctccatgagcaaaagcccctgtcatgatgaaccctgcaatgtattggtgatgagtatataaagctgcttgagtagtaaagtcttgtgctatgaatgcataagaaggtaaagagtacatatgttgagctactaaggaagtaataacccctaaagaagctagagcaagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggt

SEQ ID NO: 29141 - DNA, 637 bp, Oryza sativa
  unsure (1)..(637): unsure at all n locations
nnnnnnnnnnnnnnnnnnnnnnnnnnnnnnnnnnnnnnnnnnnnnnnnnnnnnnnnnnnnnnnnnnnnnctttggatgaatcgatctattatcgggcaatcttattgggaataacaagggtttccctgaatacccaaagtttcatatctgaagcaagttttcaagaaactgctcgagttttagcaaaagctgccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaaactatttgcgtcggaaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctcagaggttagattttctatttttattttaatttaaaaagaagtttagttaattcatgacggttatgcttataccatgtagaaggttccatcggaacaattattatttatttcaagctatt

SEQ ID NO: 29142 - DNA, 802 bp, Oryza sativa
  unsure (1)..(802): unsure at all n locations
nnnnnnnnnnnnnnnnnnnnnnnnnnnnnnnnnnnnnnnnnnnnnnnnnnnnnnnnnnnnnaagcctaggagagccgccgactccaactatcgttcatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgctacaattgagaaggtcttatcaatgaaatttccatttatacgggatctaggcataattcccaacccattctatcattctatatagaattcttttcattccttcacaaaataacataaaaaaaaaacaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgatggggtaggataccttatgcaaacagaatctagggttccttttttatcgaataagaagaatcttccattctctttttctttggtttggggaaaacccaaactaanaactttcgagggagcggaaatcctagtaaaaaaatcctggacccgtccacttagatgaaaaggaa

SEQ ID NO: 29143 - DNA, 614 bp, Oryza sativa
  unsure (1)..(614): unsure at all n locations
nnnnnnnnnnnnnnnnnnnnnnnnnnnnnnnnnnnatattaattgaatatcttttttttaagatttttgcaaaggtttcatttacgcctcatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgnnnnnnnnnnnnnnnnnnnnnnnnnnnnnnnnnnnnnnnnnnnnnnnnnnnnnnnnnnnnnnnnnn

SEQ ID NO: 29144 - DNA, 761 bp, Oryza sativa
  unsure (1)..(761): unsure at all n locations
gcgaattcgagctcggtacccgcgttaaaatagtactcggcgtagttattgtgcttaaatcatttttagagttctgtatcttaggaatcatatgaagaatatacagagcccatgaaaggaagatcaatgactcatataaattacttaatggaaaatgtcccgaagaagcccaacgagaaactaagaatcctgttatacagaaaaaagtggctatcattcctttttctgacgaatcacgcaatcccccaagttcacgaactaataaggttattaaatgaatcgtaatcacaattgaaattgttgagaaagaaatatgagttagtatatgttctaaagttgcaaataggtactctatgcccccctatccatacctagctactgactatggtacacaactttccttgttcacacaccacatgtggattggcggatttctaatagttggtgctgctgcacatgcagccatttttatggtaagagactatgatccaacgactcgatacaacgatctattagatcgtgtccttagacaccgtgatgcaatcatatcccaccttaactgggtatgtatatttctaggttttcacagttttggtttatacattcataatgatattatatattttttttagactttgttttaataatatagaatatatacaaaggttttctatttaaatcaatttatatttcaagtatactctncatatacagatataaggtatgggggcctatcccccatataagaacggagggataaa

SEQ ID NO: 29145 - DNA, 769 bp, Oryza sativa
  unsure (1)..(769): unsure at all n locations
aacattacggcaaatatgatcaagacatttatagctcccacataaataagaagttgtgccacagctacaaagtaggaattcaataaaatatagaataaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29146 - DNA, 767 bp, Oryza sativa
  unsure (1)..(767): unsure at all n locations
nnnnnnnnnnnnnnnnnnnnnnnnnnnnnnnnnnnncgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29147 - DNA, 550 bp, Oryza sativa
cttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggcgtaaaagatcatagtcgcacttaaaagccgagtactctactccgccaaatacggtaacaaacatgcataaaccatttctcgaagtatgtgtccggatagcccaaagtctcgatagttagctctagggttcaccgcaaatactagtttggctcattattgccgcgacaacggcctacttcttcacattcaccgagcaatgcatgcagtaatgatagacagaaaaatcatggtatgcatctccgtgtattagctaaagcattgcgtatgtctggtggagatcatatccacgctggtacagtagtaggtaagttagaa

SEQ ID NO: 29148 - DNA, 2623 bp, Oryza sativa
ctatagggcgaattcgagctcggtaccctttgatcttgtagtccaaagaattccataccatgacgtatctgggatagtagtcattagtgaaaaaggaatagttatacaaacgagtgaagtgaacccatctccaatagtccaaaaattcttatctttagaccattctgagccatttacgaacattacggcaaatatgatcaagacatttatagctcccacataaataagaagttgtgccacagctacaaagtaggaattcaataaaatatagaataaggatatacaaacaagaactaatcctagcgaaaaagcagaaaaagttgggttggtaagtaataccacccctagaccccctagtagaagaacaaatcccccaaatagcacaagaatttcatgtattggcccaggtaaatccattatggataagaagaaattaatagtataaattttttcatgaactgactaaaactaaaagattcaaggaagaaaaaagggattaggaaatttttttgtatattgtatataagttctttctatagttagaaatcacatcacgaaaatctactctggtttaaaatcaggaataatttgcaataagcagtaggtattcgtttttctttctagttagtaaagaacttttggattctaacaaaaaaattctagtaatcagtaatcgttcttgaattccaagatttttcttcgtctattttactttgagttgaattcctaattgtttgaattgtgtaatctcccattatggagattggtaaccgactcaaagcaatttgattgtaattcaattcatgacgatcataagtagaaagttcatattcttcagtcattgataaacagtttgtcggacagtactcaacacaattaccacaaaatatacaaactccgaaatcaatactataattaagcaattgtttccttttaatatccttttcaaatctccaatccacagaggtagatctatagggcatacgcgaacacatacttcacaagcaatacatttatcaaattcaaagtggattcgcccccggaaacgctccgatgtaattgatttttcataggggtagtgaatcgttataggtaaacgatttgtgtgggataaggtaattatgaaactttgaccaatgtaccttgctgcgcgtattgtttgttgaccataactcatgaacccagttaccatagggaacatattcgaaatatctatgaaaaaggtatgtttctttctcttgtttgagaggacttttgtgttgaaaatattcttactgttattgtattatcttattttatagtgaaacaagttgggaagaagttgttaataagagattgcccagggaaataggtaaaagaaatttccatccaagatttaataactgatccattctcatcctgggtaaagtccatcttattgtgatagaaatgaagagaaataaataagctttagttaatgtaataaagatactcattgtcatttctaaaattccaaccattttattcatttggaaaaatccaaaaaaggatatatagggaatagacaaattccacccgcctaagtagagaactgttacaaataaagaggaaactaataaatttaggtaagaaacaagataaaataaaccatatttgataccagaatattcggtttgataacctgctactaattcttcctccgcttctggtaaatcaaagggtaatctttcacattccgccaaagaagaaattagaaaaaccagaaaacctataggctgacgccaaagattccatccaaaaaaaccatattttgactgtgcttcaactatatcaactgtacttgaactgttggataatcatagtcgacgataacatcacagttcccaccgctattccaaaaccgtacatgaaaccttagtttcatacggctcctctatgatcagaaaaaaggaaagtactgtttcatttcgttattatcttcttgggcgtagttagaattatctaagataaaatcgatttcaacgtcctaaattagaccaaaggaattctgtctgctagaataataaaaaacgcttcggaattcatctcatcctttataatataatggtactttttctttgttcagcaataacttaatcttggaataaaacactcgttataacaattaataaacgaaaagagttgggtattagttcatgaagaattctgtatgaatatggataaacgacggaaagaataaataaagatctttttttttgtattgcattccatatcttttgtcctattcttctttccccgaggggtatttaaaaagaaaaaaggaataaagggttaattcgttcttgatagccatttccttaacaagtgaatgggaacatactctggatcggaatccgaagaaagtactacttgctcatttccaccaatttcaagtccttattatgattccttttatgaggaaaaatatctaatgctttagattccctcattactaatcctttatgtactttagtgtttctaatccctcactaacttttgatggattcccttatgattacaactttctgtatcgggaatcccttattattgcccgcttcaagatatgatgactaatcaaaaaatctcaaccttggggtaaagaatt

SEQ ID NO: 29149 - DNA, 1456 bp, Oryza sativa
cctgaaaaagaatatttattatttgagctatatcctgccataagaagaccaataggagcaatacttgaaatggcaatccataaaaaaaccccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtacttctattgtgattcccagtaagagggtcaaaatgggtagaatccatatcagtccatagacttcttttaataattccaagttcgaaaaagaattgatagcttctacctgtaccctgtctattatcatttcaacgatcaacttctcccataatgatatctatactacctaatatcgtcatgatatcagccaatttcatttttttgactagctgaggaagaatttgcaaattaataaaaccgggtggacgaattttccatctccaggggaaaagactatcatctcctaccagataaattcctaattcaccttttggggcttccactcttgcataaagctcttgttttgacaattcaaaattgggtgaaggttttttaccaagaaatcgatattcaaaatcattccattcggaattctttgctttcttaaagcgtcggacttctaaattctcataagggcccccaggaattttttctacagcctgttgaataattttgatggattccctcatttcaccgattcgtactaaatagcgtgctaatgaatccccttctttttgccattggactttccaatcgaattgattgtaagactcgtaaagatcaactttacgaagatcccattgtattccagaagctcgtaacatggggcccgataagccccaatttacagcttcttctccgctaataaaaccaactccctcaactcgttccaaaaaaatgggattctgtgtaataagttgttgatattcaataactcctcgtaaaaaataatcacagaaatctaaacatttatcgatccatccataaggcagatcggcagcaactcctccgatgcgaaagtaattatgcatcattcgcatacctgtagcagcttcaaatagatcatatattaattctctctctctaaaaatataaaaaaaaggagtctgcgcaccgagatctgccataaaaggtccaagccataacaagtgagaagctatacggctcaattctaacataattaccctaatatagctggctctttggggtatttgaatattctccaagaattgtggtgcatttaccgttattgcttctgtaaacatagtagctaaataatcccaacgt

SEQ ID NO: 29150 - DNA, 2423 bp, Oryza sativa
  unsure (1)..(2423): unsure at all n locations
nnnnnnnnnnnnnnnnnnnnnnnnnnnnnnnnnnnatggacttgtcgatattgtaggggatgaaatgcttgacgagcactgcgatactgatccagtgtggtttccagaaatgtttaaggattggtagaggccaaatttcttgtaaatttatttcaaccctaaattccggttttatgcaatttaatggaaatacttcataatgatcaatcattcaggttaaaatctatctaaaccaatccattttttctatatacatacgacatgccaacggttaaacaacttattagaaacgcaagacagccaatacgaaatgctaaaacatcggccgcgcttaagggatgtactcatcgtcgaggaacatgtgctagggtgtatgtgcgactcgttcggatcatgggttcaaacaaataagacaatttttgaagtatccatgatcggtaccaatgaataggatagagcttctctatcctagatttctacggtatatggaatttctggtttcctttggtgcaaatccaatcatctagattggaaataagaagcaattcccccattggtagcaaacggctattcattaagcggaggaaatagtaataaaaagataaaggcttatgctcctttatcttaaaaaaacggactaagagggtcagctacttagccaactttcataattaaatgccgtcactgtatggataactcttattgtgaaaagagctatttactctataatggataggtagagccaaagaatgtgaactatacaagttcacaataccctttgatgaaatgaaagaaagggctccggtgtatagagagggcctcgccgtttaaaagggaaccatagaaacgatggaacccactattttttagtatcgtgcgaaataactgaagggagtagaagagaaaattgtggttgggaaggttatagtagcaaaagccattggaactaatattttatatatgggaataattcgttttgttattaatgggaaaaaggatggctaaaagaagagaaatcattagttattcattaaggttaatttgattcaatgaccagagttccgcgaggatatatagctcggagacgacgggcaaaaatgcgttcatttgcctcaaactttagaggggctcatttaagacttaatcgaatgattactcaacaggtaagaagagcgtttgtttcctctcatcgagatagagtcaggcaaaagagggattttcggcgtttgtggatcagtcggataaacgcagcaacgcggatacataaagtattcgataattatagtaaattaatacacaatctttacaagaaagaattgattcttaatcgtaaaatccttgcacaagtagctgtattaaattcaaataatctttacacgatttccaataaaataaagattatcaattaaagggataaaaaagtaatatacaggaataattaaaaaagaattcccggagaggtaactccgggaagatacaataaattaagattaagtggtaggaatcaacgagcatgttgcaataaataaaaaaactattttttcttccccattgttctttcttataacaaacccaagaatctaaattggattactttctttatatatagtctggccctttcgaataaaacatcaacaatcggaacttaagttccgattgttgtttcttaaagtctggttggagtttcttaagtttcgattggaattgaacttttgtgttaatggaggaatatgtctattttttctgggtctaggacctgtaattattgaaattgactgggcttgaaattgtttctcattctcatagttacgaaatggtaagaaagataaaatacgagcctgttttatagcaagagttattaatcgttgttgtttcaaggttaatctatttattcgtctcgataatatttttccttgttcactaataaatcgattaattaaactcatgtttctataatcaattcgatcccccgggccaatccgaggacgcctacgaaaaggttgtttgggtttgcgaaaaggttgtttgaatttacgaaaagtttgcttggatttacgaaaagtttgcttggatttatgaaaagtttgtttggatttatgaaagggttgtttagatgtatacatgatttattccttattttaaaattgaaaaaaaaattgatttgtttattttattaattttggatccagaagaaatagtctctctttggtccatatattagatgaataccctcgatacatatgaaataatatctaatggaaatcagacaagttgatttgtattttgtattctatctatgctctatatattaaataggaagttcttattctttttgatctttggaaagatcgaacacaagatgctcctatttctttatttcggcatgaatcgtatgcttacgacaataacgacaaaattttctt

SEQ ID NO: 29151 - DNA, 1350 bp, Oryza sativa
tgacttaacttaattcttctacttattcttttattcctctattttgagacccgagacgaagaagaaaatccattagaataaaaatttttggaaatttttcaattaagtaataaaaaatagagaaataattaaggaatacaatccttgtcaaattagcaaggattttgaagcaaaatcctttcattttagtagccaacccagcctctttctatgctctgatttctgaggcctgacttagcttggatactgcttttaattgaatttcttttttcaaaaatgagatttaccaaatttttcatgactctaaggtccaacccaatctatcttttctttctttttctttcctatactaaaaagggattgaaaagtgggaattttttatcatgtcacgaagaactctattcctcacatagcaacaactagaatgaaaaaaaggggaatgacaaagcatctggaaataaacgattaatttctatcaataaacctgctaaagccccaaaccatagagtacttagcacgggtgctacagagagatatgtttttatatcccgcattgaaaatcctccttccttattggaatacgtatatgatcagatattattgcccaagatcatttgtatttcttttgtttaggcgaaattccgaactaaaaacgaaaaagacaatcccttcctatagattaccaaggaatagtaatctttcttttataggtgaaattagattggatttagatatataccattccttgattatatgagaccaaaaagaagaaatgacacgaggattctctatagatagaaaaagacaagaaaattaggatgtggaaaacaagataggaattgtgtacaatgacattgtacaacaatttggaaaagggatgtagcgcagcttggtagcgcgtttgttttgggtacaaaatgtcacaggttcaaatcctgtcatccctacctattacttctttcttctttataggcagtagtgaggaggtcgattaaagcgggtataacttgaatttgtggatactatacgtacgtgagacacattaggagtagaaaaggatttgatttttgaaagcgctcttagttcagttcggtagaacgcgggtctccaaaacccgatgtcgtaggttcaaatcctacagagcgtgattccatctatcttatgtcgaagcagggcaaaataacttaacaaaacaaattgcaattccaatttgacctcctccagaccagagaggagggcaatcaaaaaagaaatattactcaatcaaagatccaactgatccccacgtctgtattgcaaatacgcagtcacgaataatcccgctaaagtaataggaattaggcctaagac

SEQ ID NO: 29152 - DNA, 8422 bp, Oryza sativa
caattccaatttgacctcctccagaccagagaggagggcaatcaaaaaagaaatattactcaatcaaagatccaactgatccccacgtctgtattgcaaatacgcagtcacgaataatcccgctaaagtaataggaattaggcctaagacgattccaaatagaaaaacttcaatcatttcgatttgttcgaggggataaaaaaaagaggtacgatttatccctaaatagtagtctaaattatccacgaatctcaatgaccaagaaaaaaagaattggtaattagtgcgtagaataccaggaatccaaaagagagattttttcttttctgccttattcattcaattcatttcaaataagacgtatcttgttcaagccaataaatagagctagggttagagttaaagcagccaatagaaaaccgaaataactagttatagtaagcatgaaagggttaaattccattttttttactacactacatatgttggtaaagcacttacctaagttatggaaaattcataattcatcggttattttagataatactaaaaaacaagatagagtgagatacagaagtgtaaaagaaaatggattcatcagatggggcatgagtccctaattccgaatcaagagatttgctgtgtaatctgtcaattgagtaaagtaaaaatattaagaactagatcagctaaccccagtgaaaaataaagaattgaatttgaaaaagttctttctattttggtctttttcaataggatgatttaaccttctttttggagcgaacagtcgaatattcccctattccttcttattttaattgattgtattccatatggaataagaggagaagaaaagcattccacgacccctcgagggtctcctaaaaaaaggaaatctttcctgaatttacttttttttaattcctttttcgaaccccaatcaaagtcgattcgaagcacttctttttccattacactatttcggaaacctaagaactggcaaagttccacgcttgcagtttggtcaagaaagttagtaaacaaggcaagggttgattacgaatcttgattcttcaaagaatgttttctctctttcataacagattatctactatttgattttctatttattagatattatattatgctaaccaattaaattctttaaggggaaaggttggattcgaagggatagctttcgcatctacttctctttgtattgtgtcagtataagaatatctttcctaaattctttatccaaacctgttgatcattaacttagattttcccaagatcttgagccctattccgaattattctactattccgaagccggtgaaaattaagtaggaccctcaaaattgaggttttctattgatgccttgaataccatatagcttaccctatagacaaggaacaaagaagagaaaaaaagaattctgtttcgagaccaagcgaaacaggattgctgtgccataggaaggatagctatactaatttggtatactcaaaatacacctttggtacaaaattgacaatctcacaaggatgaaatatcagtaattttctatttactggttgatcccatcttttacggaatcaattccttttttgaatgtacaaaaatttggggagctcagcatgtctggaagcacgggagaacgttcttttgctgatattattaccagtattcgatactgggttattcatagcattactataccttccctattcattgcgggttggttatttgtcagtacgggtttagcttatgacgtgtttggaagtcctcggccaaacgagtatttcacagaaagccgacaaggaattccgttaataaccgaccgttttgattctttagaacaactcgatgaatttagtagatccttttaggaggccctcaatgaccatagatcgaacctatcctatttttacagtgcgatggctggctgttcacggactagctgtacctactgtttttttcttgggatcaatatcagcaatgcagttcatccaacgataaaccaaattccaactatagaactatgacacaatcaaacccgaatgaacaaaatgttgaattgaatcgtaccagtctatactggggtttattactcatttttgtacttgctgttttattttccaattacttcttcaattgagagaaagaaagagagtagtaagaattctcttatccccatttggaaggataccatccttataactatccatgactgtttttgtctctagcatgaccacttgataaaatgtggaggaaagtaggggaaatggccgatactactggaagaattcctctttggctgataggtactgtaaccggtattgctgtgattggtttaataggtgttttcttttacggttcatattctggattgggttcatctctatagtaattggagggaccaggttgtaaacatgaaaaaataggaacttagcgggtccttacccccttttatctgattagagcggaaaggacccgcggaattcttactcttataacccgacttttttaatctattccataacctacaaacgggtttcctattttgatttgtaaaaataacaaagagaaagcctttgctctgatggtcagaatccctctatttattcgttttgtttgttaattttgtttgttaataatgttagtgaagtaatccatcagttgatttataaccccctcgccaatgaaattaattcacttttatgaagcgaggagaaagaaaggatcaatcgaggatccaatattttattccccggaggaagtctcttgtaaatcattgatttaatttagagtaataaactaataaaaccttaattaaaactactcaactagcctaaaaataaaaaacagccttcaatggaagagtatccgttttttttgcaaaatttctgtagttctaaattgaacttaattgaacaagtcaagcaattctatttggtcacaaaaaatttgtcccacgccatattttctttccctctttttgtccactacatcgcctgaacctaagcaaaagaggttcaagagacagacccaaataaagaagaaatagtaatctttgccgaataggaagaaaaaagattcatatttcgatacaagaagaatcgacacaagaaaaaggcaaaaaagcctttttcttgtgcccaatagaggattaagaagaccagcaatccctcctaaaaggatttgttccttttattgttctcgcccttgccttgcattctcctcgttttgcatgagatgatagaaataaggaattgcagacaagacatctcgcaaacaaaaaatagtctaaacaaaaaaaagatttccaaaatggatcatagagaattctagcaatcgccaataaatcgcggctttttaccaacttgatggtaagaaatcccgggacctagaaattcatttcgtacaattgaaccttttcaaactgtttctttttgagaaccaaaaaaacttgtgccaaaataacggatgcgaagaagaacaaaaggccttgaacgcgtaatggatcctgaagcactatttctgcatccccctgaccaaaccctcccacattaggattacttgttaatggttgatcaagcttgatcgattccccctctgaaacaagaagttctggaccgggaggtataagatcaatcacttggcgtccatccgatgcatcgactatggatatttcatatccccccttttctttacgcagtatttttcttactacacctgttgacgttgcattatagaccgtattgttactcttgctaccatcaggatagatctgtccccttcctcggtttccccccacatatatgggatattttaagaaatgaacgtctttcttcatagcagggtcgggggaaagaatgggaaagacgatttcactatatttcttaccgggaacagggcctatcacaagaatattttttttattgggacgataactctgaaaagagagatttcctatcttttctttcaactcaggagaaatacggtcgggcggcgctaattcgaatccctcgggcaaaataagaacagcacccacattcaaccctccctttttcccattagcaagaacttgtttcagttgcatatcataaggaattcgaagaactgcttcaaatacagtatcgggaagcactgcttggggaacttcaatatccacaggcttattcgctaaatggcaattggcacatacaattcgtccagttgcttctcgtgggttttcataaccttgctgcgcaaaaatgggatatgcatttgaaatagatgtccgagttattacgtatatcatgatcgatacagaaatcgatcgagtcatctgttcctttacccaagaaaaagtatttctattttccatgtccaatcacagatcccggaatttctacaataaattagataggtagctaagctaatctagttccctatacacgaatctgttgtcattctactgcaacagttgtactggaatgatgaataccttgagcaggtagaaatagaaaaaaagaattttgctaaaatggaaaaaggctttctttctaaaggaaaaaggatgctaattttgattaatatcaggagatcaaatgagtttatgcttcactaattgaatgataaatgactacaagcgaaggagataggcggtttaaacaaaaaaagacccaaaatttcaaacatgtatctagaatcacaggaaaactacaaacaaaaatagtgaaaattagctcgttaggaacccatccaagatcgttatagacccaacgaattagtagttcccaaccgcgggtggagtgaaatccaacaaaaaaatcagtaactaaaagaataaaaaaagcttttactgagtcatttaagttatagaagaattcctgaacccaagaattcaaaataacaagttcctctttacccagaaaaaaagaaccacttagaatagccaaacagattatatttgtcgagaaatgcaaaatgatatggagatgaccctcattatctattttggccaattgtattatttccttgcgtattcctataggggggttttgtacatgtgtattcggtttctcttttatcatttcgtccaagataaaaaggtcttctaattccatgaatctttctagaactcttttctcttgaatagcagttaagagagtttgggattgcctggtattccaccaattcttaatccaaagttccagacatttgttaaaagagaaagagactccccaaggcaaaagtacgataaatacaagatataggaaagaaggcaatgctttcttttttttcatttttgatctgtaaattgagttgttaatgaatccgctttattcgctgactctatatgatatttctttttctttgaaggaaaaattctataacaaggtttgagaccttgtatctattcctcttttttctatactagtagaatttcattgcattgagttctttcttagatctagatggagtggaatagagaaatagaaaaaagtcctttcggatgaaaatggaagaatattacgccatatatcccacttggacaaattagaagcaattttctcttatcctcatttgttccttcctttagataaatactcaaaatccccttacaataatgcaatttcgaagggaccttttccctcgtgttgagaaaacttttcttcttccaattcttcttcattcaattcatttcaaaaaattcaattggtactcaaaatacttccattggtatgcgcaagaaataagccaattcggcagctttttgttcaatttctcgtggagtaaaaaacttctcatcagtacgagtcaagggaatggccccctggccccggatttccatataaaggatacgacgaggaaaaagaccttctttaacctgaattctaattgattggatatcccgcataaggaatcgaaggaagacgcgacgttttattccagggaatccccaacgaaaaatgcacactactccctcttttctatcgaatcggtcataaccactgcctacattccacaaaatagtgcaccacaagtaagcgctaatgaataggcctgcgattccgtagaaagacatcacgaccccctgtggaaaaaaaagaatttgttgagatggaagtacagatataatattcttaccaagataactggaagccccaaccgctaagaatcctagtgaacctagaaaaagaatacaggcccagaaaaaattacctctttttcgagaaccttttagaagttctatccatatgtgttctgatcgccaattcatattagatatactaacagcggtcgattgaaattgagagaataagctaaatgattttgactttactttttttgattctgaaatcgccttcgccaactagatactcctgtaaaataattggttagatacattgactttctattcaaaaagtatttgttgatccacttaaaaaaactcgctatacccggttccgcatatgcatgcatttatgctcgtagcctatatccgcatccataatccccatccatagcgggtttgcatttgtgtgtagaaagagccacataacataccatattatattacttacactacaaaagatccgtattatgatcctgtgtggaaatacattgagaaaattcggtcccgtcggttctagacaatcttatttttctgcacataaagaaataaagaagccattgcaattgccggaaatactaagcctactaaaggcacgaaaatagagggtaagttaaaatccatcatagaataggtgtctccattcaaatttactatttctatctattcgatttgatctattcaaaaaatatcttaagattcttatgatataattaagtatatctattataacgaatattgactattgtatttttgagtttgcaaaaaaagattttttatagaatactttttttttagaatactttagtattctaaaaaaaaagtattctaaaaaaaaagaatcgaatggattatataaataataagaaaatagcaaaaaaggagaagcaattaaaaagatttgatttttcttttccgatcctcgcggcctttctatccttctaatcgaacttgaaattggattcaaagtacgacttagtcgaatgcgcctatttcgaatccaaaatctttttcgtctacttccttccacatgcaatacttattcaaccactctcggaccccacaaatccgctgtaaggattgatacataggacttttagttgattgatattgccgtaaagttgaaacttttttaggcttttttattaaactgtaatttcctctctgcatacgtgctcttctagaagcatatacaataatgcgcggtaaaggagggaaaatagcatactcaatcaagggacaaattcttttacctactacagatctcatactaccccttagactttgtaaggccatataccacccccaaagggtatgaaaataccggatgaccttagcttttcgacgaatcctcgtctcgtgcagcgaagtcctgttagtaagaccccgcgcaaaaatggattatataagaatataattccgaatattcctccgggtgcgtatagtagcattgcgattccgaatcttttttctttgtgaatagaaaaaattcattgtatcgttgggtcggaggtttgctccagaaaaattcggaacaaaacgtctaccgcgttgaagcccatagccccatggagttccgcgaaagtatgattcttatcatcaggagccttttgaacgtctctacgatgggtccagattctatagcagtccaatctgaaatgaaagacttctcgctcttgatcggagtcgtaaactaaaactacctcttcatcaaggttatagaaaacttcgtcatctagttctaccattttgaaaatcaattctcttttcttacgagcatttcgagtcacttgttgactcacgattgtgcctgttaaaagtttcaaaatgtcctcttttttgaaagagagtcttagaaaggggtctaacttccaaactctgtcttttttcattcattctcctttagtttttttctctatctagaagtggaatagaataacccggttaaagggtaatgatcatacgtctgtaatgcattgtatgtcattgattctttcccaataaatgaaaactttttctgtaaatactgcgtatttgattccattatcatatgataatactctatttgtatttatttattgtattatacctttatatcttctaaatatatagaatagaggaatcccgatttgtcaagtctcatgatcgtatcaaaatctatttaaactcggctcaatcttttttcagattgagccgagtttaattgcaatcaattagaagaaaaaagaagaattactgcattttcgtaactgatttttgatctttctatttctcttcttttttatttagaccttttt

SEQ ID NO: 29153 - DNA, 3623 bp, Oryza sativa
  unsure (1)..(3623): unsure at all n locations
ggcatatgccaaacatgaataccccctgaagccaccggtatacacacctggcatggatacccagtcctgagtgaaaaagataccgcgagcacgatctttttcaataaaatcatcgcgcaataaatcaacaaaacctaaagtcatttcgcgttccccttctaacttacctactactgtaccagcgtggatatgatctcccccagacatacgcaatgctttagctaatacacggaaatgcataccatgatttttctgtctatcaataactgcatgcattgctcggtgaatgtgaagaagtaggccgttgtcgcggcaataatgagccaaactagtatttgcggtgaaccccccggttaagtagtcatgcattacaataggaacccctaattccctcgcaaatacagctcttttaatcatttcttcgcatgtacctgcagtcgcattcaagtaatgccccttaatttcaccggtttcggcctgtgatttataaatagcttcggcacaaaagacaaaacggtccctccaacgcataaatggttgtgagtttacgttttcatcatctttggtaaaatcaagtccaccgcgtagacactcataacatgctctaccataattttttgcagataatcccaattttggtttaatagtacatcccaataaaggacgaccgtatttgttcaacttatccctttcaacttggataccatgaggcggaccttggaaaagttttgaattagtagggggaattcgcagatccttcagacgtagagcgcgtagggctttgaaaccaaatacgttacccacaatggaagtaaacatgttagtaacagaaccctcttcaaataggtctaatggataagctacataagcgatatattgattatcctccccaacaacgggctcgatgtgatagcatcggcctttgtaacgatcaagactggtaagtccatcagtccaaacagttgtccatgtaccagtagaagattcggcagctactgcagcccctgcttcttcgggcggaacccccggctgaggagttactcggaatgctgccaagatatcagtgtccttggtttcgtactccggggtgtagtaagtcaatttataatccttaacaccagctttaaatccaacacttgctttagtttctgtttgtggtgacatacgtccctccctacaactcatgaattaagaattctcacaacgacagggtctactcgatatggattaggcgtaaatgaaacctttgcaaaaatcttaaaaaaaagatattcaattaatatcaactcattaaagaaaatggggggcatgcttaagttaatgaatatgtttcattcatataatatgtttcattcatatataatgggtacaccctgtgtacattctatgctataggaattctactataggaattcgataagaattgagttgttgttatggtaagttaacatgcttcgttattaaaccatggatttgattcaccaaatccatctttattgtatactctttaatagatatagcgcaaccccaaatcaacttctaatccttattaagttcttaatagacccccttttcttattttgagtggaaatacctaaatactacgaaaattctctgttgacagcaatctatgcttcacagtagtatatattttgtatatcgaagtcctagataagaaagtagagtaggcacaaatcgtttacaaaaggcaaaatgtatatgaaaaaaagattgattgaactttccgacgggctcattccatgagtaaacgattgaatgggattcgtttgggcaacgaaatcaagtgctggtccccttttctctcttattgaattaactaattcatttccttttgacttttggatttttggatatttttttggtgttgatttggcattattcaacaagaaaaaaatcaaaatttcgataaattccttttttttgaaaattatgtgataattatgagaaccaatcctactacttctcgtcccggggtttctacaattgaagaaaaaagtacagggcgtatcgatcaaattattggacccgtgctggatgtcacttttcccccgggcaagttaccttatatttataatgctttggtagtcaagagtcgagacactgacggtaagcaaattaatgtaacttgtgaggtacaacaattattaggaaataatcgagttagagctgtagctatgagtgctacagatgggttgatgagaggaatggaagtgattgacacgggagctcctctcagtgttcctgtcggtggagctactcttggacgaattttcaacgttcttggggagcctgttgacaatttgggtcctgtagatactagtgcaacattccctattcatagatccgcgcccgcctttatcgagttagatacgaaattatccatctttgaaactggtattaaggtggtcgatcttttagctccttatcggcgtggaggaaaaatcggactatttgggggagctggagtaggtaaaacagtactcatcatggaattaatcaacaatattgctaaagctcacgggggcgtatccgtatttggcggagtaggggaacggactcgtgaaggaaatgatctttatatggaaatgaaggaatctggagtaattaatgaaaaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgaccgaccctgctcctgctacaacatttgcacatttggatgctactaccgtactttccagaggattagcttccaaagggatttatcctgcagtagatcctttagattcaacctcaactatgttacaacctcggatcgttggcaacgaacattatgaaactgcgcaaagagttaagcaaactttacaacgttacaaagaacttcaggacattatcgcaattcttgggttggatgaattatcggaggaggatcgtttaactgtagcaagagcacgaaaaattgnnnnnnnnnnnnnnnnnnnnnnnnnnnnnnnnnnnnnnnnnnnnnnnnnnnnnnnaaagtatgttggtcttgcagaaactattaggggatttcaactaatcctttccggagaattagacggcctacccgaacaggctttttatttggtgggtaacatcgatgaagctagcacgaaagctataaacttagaagaggagaacaaattgaagaaatgaaattaaatctttatgtaatgaatcctaagcgaattatttgggattgtgaagtgaaagaaatcattttatctagtaatagtggccaaattggcgtattaccaaaccacgnnnnnnnnnnnnnnnnnnnnnnnnnnnnnnnnnnnnnnnnnnnnnnnnnnnnnnnnn

SEQ ID NO: 29154 - DNA, 1659 bp, Oryza sativa
agtatcgacgtaatttcatagagtcattcgatctgaatgctacatgaagaacataagccagatgacggaacgcggagacctaggatgtagaagatcataacatgagcgattcggcagatttggattcctttcctatatatccactcatgtggtacttcatcatacgattcatataagatccatctgtctagagatcgtcatatacatctagaaagccgtatgctttggaagaagcttgtacagtttgggaaggggttttttgagagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaggatgcggaactgggtagtgacattgatccggaagaagctcaacaggcacttgaaatagccgaagctaacgtgagtagagctgagggtacgaaagaattggttgaagcgaaggtagctctcagacgagctaggatacgagtcgaggctgttaattggattcccccatctaattgaagacaacccaacggtttagttgatacaaagaaaaagggaagaggggtagaaaaaattattagatagcgaagcgaagtagggccaatgctatctagtaatttttctacctacctacctactattggatttgaaccaatgactcccgccgtatgaaagcaatactctaaccactgagttaagtaggcaatttatcaccacaaaggaagaccctttacttcgatcgattatagatcgaatcctttttataagcaaataccgcttcgttattggtatgttattatagtaaacagatcaaaggatatcctctactattagagaatattcatcttgacaagaaattctctatatattaagatatctctgacaagggctatagctcagttcggtagagcaactcgtttacacgtgcgccaatgcttttcaagggagcttattatgcaatgaacatagtggatcttcttgcaaaatcaatgtcttacttcatggattcgagagaataggagaacagtcgcctgacaa

SEQ ID NO: 29155 - DNA, 1180 bp, Oryza sativa
ggctgggtggttgggcggtatccaaccctttttattcattagttcccgaccctataaggccaaattgagcaggttgcgaagtaacttgctaccacaagaggaactctcaaggccccctccctaccttgcagaaaagaaaaaataaatgaaagaaaggcacagtctatctcccttccctttaaaagctgtttgctggttgtttgtttcggtgaatccccggtttagggaaccctgttgccgagttcgattcccgccgctgtagtgctctttttttgagtggggtgcaaagggggttaagatagtaaaggggtacggtactagactaacacctattactttaataaaagtagactaaattttttatcatagtaccttactaaattaagctggcgagcggcgggaatcgaacccgtatcttctccttggcaaggagatgttttaccattgaactacgctcgctacgtcctatattttatagggtatatccgcctgggtcgaccgtctatgtctgggtcgaccgtttcattttctatttgagttttctttttattaatttaattgtctgtcaatcaattcggggcgcaaattgcattttaatgcgtctcacaatccgaataaacggcccttttttattttgtatcgggctactaaatactaaacacatttaagaaatgagagaatttagaatagctaccagaaagaccagtccaatccataatgatgtaccggaaaatacaacgtttttattgtttgaccaaccatcaggagaagcaaatacaaggggtacactaatgactaagactgaggaagtcacaattaatgcaaaaacagctaattggaaagcaatagtcatatttctaatcctccaagttaccatcaaataaagttgactacatattatatttgatccctcacttaatcaaaattgtaataaaatacaagaagtaggaggggtttaatcatgaatccattgattcttctctttaaaacttattactcaccactttttttatttggatatggggttgagggggttttatgctttatttcacaagcggatatagcggatcctgtatacatggatacagtatacagaaatatatcgaaaagggatttgtatttgagatgtttctagaggttagtgagtcatttcgtatggctatgttctatttgtaggaat

SEQ ID NO: 29156 - DNA, 688 bp, Oryza sativa
ccatgagattcatagttgcattacttatagcttccttattcgtagacaaagcggattcggaattgtctttccttccaaggataacttgtatccatgcgcttcaaattattagcctgagttcgccaccagcagtatagccaaccctaccctatcacgtcaatcccacaagcctcttatccattcccgttcgatcgtggcggggggagtaagtcaaaatagaaaaaactcacattgggtttagggataatcaggctcgaactgatgacttccaccacgtcaaggtgacactctaccgctgagttatatcccttccccgtcccctcgagaaagagaattaacgaatcctaaggcaaaggggcgagaaactcaaggccacccttcctccgggctttctttccacactattatggatagtcaaataatgggaaaaattggattcaattgtcaaccggtcctatcgaaaataggattgactatggattcgagccatagcacatggtttcataaaatctgtacgattttcccgatctaaatcgagcaggtttccatgaagaagatcttgttcagcatgttctattcgatactggtaggagaagaacccgactcggtattcttaaaaaaagaggggaagcagaaccaagtcaagatgatatgggtcgccccttcttcttgcgccaaagatcttacc

SEQ ID NO: 29157 - DNA, 9012 bp, Oryza sativa
cctcgagaaagagaattaacgaatcctaaggcaaaggggcgagaaactcaaggccacccttcctccgggctttctttccacactattatggatagtcaaataatgggaaaaattggattcaattgtcaaccggtcctatcgaaaataggattgactatggattcgagccatagcacatggtttcataaaatctgtacgattttcccgatctaaatcgagcaggtttccatgaagaagatcttgttcagcatgttctattcgatactggtaggagaagaacccgactcggtattcttaaaaaaagaggggaagcagaaccaagtcaagatgatatgggtcgccccttcttcttgcgccaaagatcttaccatttccgaaggaactggggctacatttcttttcaatttccattcaagagtttctatctgtttccacgcccttttttgagacctcgaaacatgaaatggacaaattccttctcttaggaacacatacaagaaaaaggataatggtagccctcccattaactacttcattttcatttatgaatttcatagtaatagaaatccatgtcctaccgagacagaatttcgaacttgctatcctcttgcctaataggcaaagattgacctctgtagaaagactgattcattcggatcgatatgaggacccaactacgttgcattgccagaatccatgttccatatttgaagagggttgacctctgtgcttctctcatggtacaatcctcttcctgctgagccccctttctcctcggtccacagagaaaaaatggaggactggtgccgacagttcatcacggaagaaagaactcacagagccgggatcgctaactaatagaatagtactactaactaatactaatatatagaaatagatatctagaaatagaaacgaactaatatatagataatcgaaattgaaaagaactgtcttttctgtatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatagattcatacagaggaaaaggttctctattgatgcaaacgctgtacctagaggatagggatagaggaagagggaaaaatcgaaatgaaataaataaagaataaagcaaaaaaaaaataagtcgaagatagaagagcccagattccaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacaggaagggtgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggagccctagatgctgtcgcagtaaagaatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactcttatatgtccaaggtcaatatggaaattctttcaggggttttcccttactttgtccgtgtcaacaaacaattcgaaatacctcgactttttcagaacaggtccgagtcaaatagcaatgattcgaagcacttctttttccattacactatttcggaaacctaaggacttgatggtatggatatggaaaatacaggatttccgatcctagcgggaaaaggagggaaacggatactcaattttaagtgagtaaactgaattccatactcgatctcatagatccctatagaattctgtggaaagccgtattcgatgaaagttgtatgtacggcttggagggagatctttcctatctttcgagatccaccctacaatatggggtcaaaaagccaaaaaaataagtgattcgtttttagcccttataaaaagaaaacggattcttgaacctctttcacgctcatgtcacgtcgaggtactgcagaaaaaagaactgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggggtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattcatgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggagtgtggttcgttcgacaaattcctacctctatatctatctctgaggtgtttgggttttgcaaaactccatagatatgcagaagagaaatgctatccccactccgaccaagacagaacttttaccaaaagtttattgtgatctttttgttcaaataacaattaaggtgaagcagggtcaggaacaacgaatctctttatgataaacagatccattttgcaagctcgttattacgggtagttcctacaaagaatcggactaatgacgtatacaatgcttgaattatcgacgtagatgctacatagtgggttctcatccttcagagactacgagtgtaataggagcatccgttgacaaaaggatcaccctaagatgatcatctcatggctattgggaacgaatcaaatcagatggttctatttctcaacctttctgacttgctcctacggaaccaaggtcgaaaggattgaaaaagtcagtcattcacaaccactgatgaaggattcctcgaaaagttaaggattagtagttctttttcgaaatcgatttcgaaaaagaatggattcggtcttatacatacgcgaggaaggtaatcaaaaaagaaagaagacaagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggtaatgaacttataatcatggaatcgactcgatcatcagattataagttcattccataccggaccagaccgtgcacattcttattatgagaaggggtcattcgagcctatggaaataggatactctgtttacatagaaatccccacgtccttacattctatttaggattaggaataggtgtaatcagacctgcttttgacatatctatcctatccttatttgggtaccatatgcacctctttgggcttctattgaatcgagaaattggattgtacatctttttgattttgatacatataaggtgtcctacggataatgcaaatcgaagctatttgatgtctgactcaggcctatatgaccgatcgatcgaaatactccaagactccacctttgtcatatattccatatatcacattagatagatatcatattcatggaatacgattcactttcaagatatcacattagatagatatcatattcatggaatatgattcactttcaagatgccttgatggtgaaatggtagacacgcgagactcaaaatctcgtgctaaagagcgtggaggttcgagtcctcttcaaggcataatacggagaatgcgcattcaatgagcattccccgtagaagtattccggaaatctgcgcctggcgctctactctatcttctgaggtccttaaccacttccctgagaaaaggagacagtaaaagccaaaatagactaaatatagcctgaacgatcctaaaaatccctcgaaggagataatataataaagaacccaaagcagacggtatcctactgcaagggtggtcttaagaatccaaaagaggttgctcagaagagatagatgtatcccaacctctattgctctcgcgtaaagccttttttttacgcgacaggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaatcactactatgccagcccaaatcatgatcttcaccaacttggatttggttctctcgcgaaaatcgcgagttgcagagatgagaaccatgaaaagcaagatcccgaataagaaaacagaaaccgaggaaaccacaagagtgaagactagtagagtctcgtcttttgtcattctttgctcctttttcactcaatgattcattcgaatttcccgaccaaaaattctatatgtctattcatagggcctcgttgctaagtgctacaagatctagtgcactggaactcgtggttatggacccgaatcctttagtatggaacattgtcttttccaagtaaaaacccccagtatatgaaagaatgaaaaggtgctttcgttcttttcttgtggaataagaagccctcgtaccttaatgaaaggaaaataggaatttttcattaggtatttgaccaaataggatcgtccagttcctatagaacctatcactaaaatacccgatagggctaagcggaacgaaaaggattttccctgagatggtaaatgaaaacgattagccccatacgaggtttgggaataagtgatgagcaaggaatatacgtctttctgctaaagaggatctattaaactcataattcattagatccttgttatcaatgtcaactaggtatcataagtaaacggatcccggttgttcaatcctttgataaccaaggtcattctttgctaaagagaaatgatcactatgagtcagactcaatagaattggatccattccaaatagcgagaattaggattctggatccctctcaatctctctttcaattcgaggatccagagaggtgttttcatagtcatctccgaatatttgccatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaaccggaacgttccataagtctattggaactggctctctatccatggaatctcatccatcatccatacataacgaattggtatggtatattcataccataacataagaacaataagaactcgaattcttatcgatactggaactcagagcatagcagggaaagtcgatttatggatggaatcaaatacgcagtatttacagaaaaaagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggccctattctaggacatacaatgcattacagacgtatgatcattacccttcaaccgggttattctattccacttctagatagagaaaaaaactaaaggagaatacttaataatacggcgaaacatttatacaaaacacctatcccgagcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaaggggatcctctagagtcgacctgcaggcacagaaccggaagcgccccttgtttcaaagagaggaggacgggttattcacattta

SEQ ID NO: 29158 - DNA, 8893 bp, Oryza sativa
ctatggcaacagaaagtttcagaagaaatgctatttcttgtcttcaagattcagatggaaaccaaatttttgatcacgaggggaaagctgatattttctagaatgtttttaaggaaagaatgggagtttctatgaaaccttctatggtctttgatctcaatgagctgattgaacataagggggacctttctactctgtgtgcactaattctaaccaaagagattgatggtgtcttgaggaaaatgcctggtgacaaaaccccaggtcctgatgggtttaatgggtgtttttacaaatcaagttggccaatcatagctcaggacttctataggctttgctcagatttttggggaaattcggtggatttgtcttctatcaatttttcctatatcactttggtcccaaagaaaccaagtcctcaaacccccagtgattatagaccaatctcattgatgaacttctctgttaaaatcctgtgcaaggtttttgctgacaggttacaatcgttgatgccaagtttggttcatcaaaatcaatatgggtttataaaaggtaaatcaattcaagactgcatagcttgggcctttgaatacattcatcagtgcaagcagtcaaaaagagagattgttttattaaaacttgattttgagaaagcctttgatacaattgaacatggtgccatccttcaagtgatgttagctatgggcttcccggatgaatggaatgtttggatgagtaacatcttttcttctgcttctacaaaagtgctcttaaatggagtcccaggaaagttttttaagtgtaaaagaggtgttcggcagggagatcctctctctcctctcctttttgcgttgggtgctgatttactacaagccataattaacaaagctcatctcagggggatactctctctgccaattccagtttcaggagataataactttcctattattcaatatgccgatgatacgcttattttcctagaagcttcggcccctcagctttttgctctcaaagctctgctaaactcatttgccatatcttctggtttgaaagtaaattattcaaagtcctgtatgattcctttaaatgttgaggatgacaaagctcacttgctagctgccacttttggttgtgccattggaactctccctttcacttatcttggtctgccgctgggaaccactagaccaaaggtgattgattttgccccattgacagatagaattgaaagaagattaacagtcagttcttcttttctctcctatggtgatagattgacgttggttaactcagtactctcctccttaccaacgtattacatgtgttcgctttctctgccattttcagtcattgagaatattgatagagccagaaggcattgcttatggaggggtaatgacctaattccaccaaaaagtctctggcagcttggggcaaggtgtgcaagccaaagaataaagggggcttgggagtcattgatcttagaattcaaaacagagctctcctcatgaaacatctgcacaaattttataataaggataatgtgccttgggtgaatttaatctggtcttcatattactcaaatataatcccccaagtggctaattcttgtggttctttttggtggaaagatgtctttcagtttgatgtcttgtttagaggtattgcaaagcccattttgagatctggcaagacagtcctgttttgggaggatttgtggcatgataatataagatctgtcaaatatcccaggcttttttcctttgctaagcataagggggattcagttgctcaggatcttcaaagaaatccacaggaccaattcattttacctctttctcagcaagcttttcaagaatataactccctcctagctgaagtgcaagatctcactctctctaatgaaccagattcttggttttacatttggggatctcatatttatacatctcagcgattttataagctctccttttggtccttatctcccccttgttcatttaattggatctggcaaagtaagctcaacatgaaaatcaaagtctttggatggctactgttgatggatagagtgaataccaagtatcttcttgacaggaaacattgtattcctttgaatgccactgcctattgtttgacatgtgggattaatgcaagagagacaagggatcatctcttctttcaatgtcagttcagcaagtcatgttggagaaagttgggctgggtttggaactcctcattagaataccatcaaatgctgaaggttcaaagaaattccttttctcagtatagttttatggaactatttctactggcagcctggaatatatggaaagaaagaaatggccttatttttcaaggtattcagccatcagttcacaattggaggaagggtttgaaggaggatttgagcctacatttaattaggttcagagaagttcatagacccacggttcaatcatggattgacaatctgtaatctttgctttcttcttttgtttctttgtgtgtattattttttccttctttaatataatttaaccgtgggggcttcccccctgtctttgagtaaaaaaaacaatggtctataataaaggcaataggtcattcccacccggtgacattaaaaaataaatgcaatagttgaatagaaattaaatgggaataacgtgatcaaagagtgattgggatctgtgtgacatgccttgctgcccttcaaactcatcagactcttctcctgcacagacagactctccgggaacatcggaatctaaacataaaagaacaaaatcaatcaaaaatagagacttgaaccaactaaatccgatctacggtgaattagttattaatttttgaagtttaaaccgaattaaattatttatagagattttaattgaattataacgcaataaaaaattattttaaaaagaaaaggagatttattgcgtcagcaggcttgggttcatggtgtaccgggtgcaccgaaacggtccaccacgtggcacgggcgaggcggggatgcggtcgacgtggcactgacgcggcgctggcgtggcgatgacatcacaacaacattaccaccggtggcggcggcggcggctcaggacctgacggttagcggcgaacgacaacgaggcggcgcaattggagggcaccggcgggtagagcgcgacgcggaaaactcaccagtggctcggatgacggcgaactgtcgaaacatgaattcggcaataataaaagggggtagcgcacgaggcctaaaagtggatggatgcggagacaaggatttagacaggtttaggccctctcaatgagaggtaatactctactcctgttttgggatttgaatccgccaagtacattgtagatctgacgatatggttgtgtgtcatgccccctagagggcctcctgcccaccttatataggatggggggcaggattacaagatagaaaccttaaccaatacggtatcggttccctaaatctactttacaatcttatcaaaccaggactttaggccgttccataatatacagggaaacgtaatacccaagtcatgatccgttacatattccatagatataagttatcccctataaccagtcggataactatgccgtgtgggtatggggtacccataatctctacagagcccctgagaccttcatagtcgaaaagataatcttctctcgaaccagattactccaaagccaagttcttcaatcatctttgccatggtctcccgagtacttttaccaaatatgaagactatggagggctgaaaaataaagtcaggtgcatcgactagatgcacctaataggtgtagccctcgactatgtggttagctgaacaaactaagcatatagtcaaggaataaataatccaaccaaccgagtggttttgataattgtaatcaaccaaatgacttgatatcaatatatagcatatgcggtgtgaatcccccaaataacatgatccaagtgatataccgactgctttgtaaaatatgatgagtgcaacctaaagttgactacatcattgaaaataaaacagctataaagaagcttatatgctgtgaataaaaaatttccaaagtattgggcacacaccatgcgcacactgctttaacagatgtgcttaagtccctaaaagacacatggtttcaccacacctggaaatatatggcatatgtggtatgaaatccgagtaaataaactcaaaaatgatttaccaaccgcttggaaaatgaccacaatatataatcagcctaagccataatattagtaaataaaaatgcacacttacgtggcaaaaagcaacgatattgtatccaatcaattgcttaaaaactcaaacatcaccttgacttatataaaaaagtcagcggggcagctatataaagctttactgtttgacaccttttaagatgcattgtaccaactcctaaaaagttgagtaattgcggtataaaaggattttaaggtattgggcactggatcacgcgcactttggcctaagcaaaaagtgcctaagtccctaaaagaacgtgacaggccacatctcataatatgggctgcagacatattaggcctaggccaaaaaatatgccttcgacaccctttaaaggatgacgcatagaacacgccaaataatatgatcccaagtgataaatatcctgggtgatgtagatcaagcgtaattgtccctcatggagaataccaaagtaaatgtgataattgaatcccgactggtgcaagcactcagctgatggccctcatgggaaataatgaatagtccagtcgttgagcataagaaatcgactcatgaccataaattcatgttgaatgtatccggaacaagtccaaattgaagatataatcctcgtgtttgagttcataagcccctgagcatatataacttgtccttctgccatagtcaaaattatccattggcaatagctgatgtagtcgacatgaaggcaagatgacgaacatggggatgatatcgccagtcagaggtgacgaaaatgttggtgatgataaaaacaatgacaccaatcaaaggtgatgaagtcgcatagccattggtggcgaagaaaccagtcgacagcagacaagtcagccagcagtgaagacgaaggcgcccaacaacggcgacaaagttgtgcagccacgacagcaaaataatcagtcgataacagacgaggcgcccggtgaagaagacgaagacgcccatcagtagaggcataataaaccagctatgaaagcgaagacaccatgaatggcggcggaggcaagccggtggtgaagacgtaaacgctcatcaatggcaatggcgaaatccaccaatcatgaagatgaagaaaatagtcgacgatggcaaatgcaaccgacggtaatgatgattagcatcaatagagatgatcgactatgatgacaaagttgtgcatcaacgacagtagagtagacatagccgaagaggtatggtaggatgttgatgaagacgatgatatcattgatccagtcaatagcggtgtagcagtcaatgataacgatgaggtctccatcgccagttgtgtagtagaccaaccgtgaagacgaaataacaagtcggcgatgcaagtcggtgatgacaaaagcaaccgacagcgaggacgtagtcaccccttagcaatggcggagacgtcagggccgatgaagtagaggtgttggtgatgatgtcaatgataataatccatcaaactcccagacatgtaaattacatctcaaacttgatacttgagaaatttggagtatattgtggcagcatggagaagccaaaattgccggtgaaataattggagtttctcaagtagaacgccaactcttaagtgaagacgaaactgatgactcccgaagtagattccatagaactcgttggctgattgattgctttgtcttgacataaagcttgtcgaattttgagtcttgtatttgtgtagcccccgactctttggttagttgagaaacaactgaacatagagtcgcgaactgtagcttcttgtcatcgagtagccatcacttgagtgaagatatgcattggggatgtccgagtagaaatattgaagattggaaaaccacttgtagtagtaaaataacacggcatcatatttggtcacgcatgctgagatgtcgaagctcttgtagacgttgtggttggtgaagtatgtcacgcccgaaatttctatccaaaattccaaacgcttacatgtgtgtaaattctcgtccaggaatcagccgaggcacataataacaaattgataatagagtgcaattattactctaattaataagggaatataaagtcattacagaggcaattattactccaaacaataaaaatctaagcagcggaaaataagataaacagcgcaggcgactccatcccacaagcagcttgacaagggctacgcctaatcctccacaccttcagcatcactgtagaactcctcctctgatgaatgattgcaaggtgagtatatgacatactcaacaagccacacaacaaatatgcaaatgcaagggataacaaaggatggcataatatagtctcatttgcataaatggcatttaataaatacttcagaatttaataaaacagtaaagtatttaattacacaatattaatccaacgctatacaacatacccgttgcataggcccaaccattcttaacaaccattcccagcggcacagttctatctccaaaccaggaatataccattccaaaccaggagctaaacaagttattaccaattacagtatcatttattatggtgagatgtatgaaactaatcacgaatgacattgttagacccgcccataacagcgggcacggctattcgaatagttttactctggccagaggtgtaccactgtacccacaagacacaacctcaacatcatgtcaaccatgcgtcgcgatacttaacaagtacccgaatagagattgtgacaatacccttcgcataacacaattcaaagcagtgcacccttcctggatcataatcacccccttataaacaaggcatggactccccagcgacccctgtgggcttatctccgccacttcacagtctggtgctctacaatgaaccatactatacaaaaagtaaagccgttgcccacgctggcttgtggttggcacggttaatgtttcacaaccgaaaatcgtgaactggtccttaattgtcatgagcacgaccatcaaaaccatgtgctcacaacccaccattatcaagttttagttggcaaattaattaattaaccaatcacgattaaccatcgtgagctatcattaagccatcattaaataatagtgaatcataagttatcccatttatatgagctaatgtctctaagcatggctaagcatcctaagcactttagctaaaaccatataatgttctagctaatccaattattaaccaaatgacaaagaataggtaatcaataacaaaaagactataacaaggcaataggttattcccacccggtgacattcaaaaataaatgcgatagttgaatagaaacaatagctttaaacgggatcaacatgctcaaagggttttttgggatctgtgtgacttgccttactggccttggaactcttcaaaatcttctcctgcaaaatcggactctccgggaacgtcggaatctaagcataaaagaacaaaatcaccaaaacagtacataaacaatcataaacagcacatgtggatatttttaacatgtagatctcaattttagaaaaatttagagacttgaaccaactaaatccaagctaagatgaattagttatgaatttttaaagattaaattggattaaatcatttatatagattttaattgaattatgacggaataaagaactatttttgaaaaggaaaaaggatttattgcgtcatcggctcgggttcacggtggaccgggtgcacagggacggtctacggaacgaacggccgagatctaatctaaacaaaacggacggccgagatcgattcgatccaccgcgggtctacggatgacgcggcgctgacgttagcgatgacgtcatcaccggcgacggctcggcacctcgggctcgccggcgaacgacggcgcggaggcgcaaacggagggcatctacgggtagagggcgacgcggtgaactcaccgaaggctcggacgacggcggacgtcaatggacggcaacggcggtgaggtcgaagcggcggcggcgttcgggtcgacaacgacggcgatgctccggcggtctttggcggaaacggaggacgggacgaggacggcgacgacttggcgatcccaacgacgaccttcccgagcgacgacgacgaacggagcggcggcggcgcacggctggactcccttcgggagcggcggtgcacgggctctagtggctagggcgctacgagcggtggcgagctaaagcgagggtggcgacgaagagaggaggtcccgggggtccttatataggggctagagggcggcgatggaggcccacggcaaccggcgacggcgatggaaggtttagggttagaggagagaaaacgaatccgaattgagctcgaatccaacaatttccaaacgaaattagatgaagtttctataggagaaaagatagaggagatcaaggggatcatttcccctctaccaatttgaccggatcgggaaaggggcgatgtaatttggaagggggcggcggcggctggcgcgctagggcgtggctgcggcgtgaggaggaagacgacggccctgacaggtgggcccacctgtcggtgggagagaggagggagagcgggcggcgcggctcggcgggctagatgggccaggcgctagcaggccgcggaga

SEQ ID NO: 29159 - DNA, 6396 bp, Oryza sativa
gggttagaggagagaaaacgaatccgaattgagctcgaatccaacaatttccaagcgaaattagatgtcgattctataggagaaaagatagaggagatcaaggggatcatttcccctctaccaatttgaccggatcgggaaaggggcgatgtaatttggaagggggcggcggcggctggcgcgctagggcgtggctgcggcgtgaggaggaagacgacggccctgacaggtgggcccacctgtcggtgggagagaggagggagagcgggcggcgcggctcggcgggctagatgggccaggcgctagcaggccgcggagagagagggagtgaattgggccgactttcggcccaaagccaaaagaggattttaaaacctttttctttttaaattattcatgaaatgcaattccatttattaaaaatacgtccttggctcaaataaatcccagaaaaatctagtaactatcgaattaagagaagtatttaataaaattttatctagcccacttttatattggaatttattatttaaaattagatcttttcttctaggcttttaaaatcatttctaataattccatttaaacaacaattcataaatttaggattttcagggtgtgacaaagtagcaaatcttgcaaagtagaggcaatagagtttgccaatgtcgaaaataatgaaggtgaagtcgctccacatggtgacaaagttgcatagccgtgatgacgtgaacacaagttggcagcaacagaagaaaaccggtggcgaagatgtgtagtcgtgaagatagatactccggtcagctccagaaaaaaaaatagtcgatgtcaaacaaggcggccagcaatgaagacgatgacatccctcagtagtggttgcggtataaaccagccgtagaggcgagggcactagtcagcagcagacgagacgactggcgatgaagacgataaggccaatcaacactagcagaaccatgcagccatggaagtgaagaaaccagtcggcatcatacgtagacagcttgcgttgaagatgatgatgcctattagcggtggcggcgacgtggccggtcggtgaagacgtagacgcccaacaacggcggcataataggccagccgtgcaggcggagacaccagtcggcggcggtgaaggcaagcctgtcggtgaagacgaagacgcccaacaacggtggcagaataggctagccgtgcaggcggagacaccagtcggcgacggcgaaggcaagccggtcggtgaagacgaagacgcccaacaatggtggcagaataggctagctgtgcaggcagagacaccagtcggcggcggcgaaggcaagccggtcggtgaagaagaagacgcccaacaacagcggcagaataggccagccgtgcaggcgaagacactagtcgacggcagcgaaggcaagccggtcggtgaagatgatgatgcccaacaacggcggcagaaaaggccagccgtgcaggcggagacaccagtcggcggcagcaaaggcaagccggtcggtgaagacgtaaacgccctacaacggcagcataataggccagccgtgcaggcggagacaccagttggcggcacgaaggcaagccggttggtgaagacgtagacgcccaacgacggcggcataataggctagccgtgcaggcggagacaccagtcggcagcggcgaaggcaagccggtggtgatgttctgactgatccaatcctgaagcgtaggagataagcttaaagccatgaatcccttttatgcatatctggatctggatcctacagaacaagcatataggatgagtagtatctgatgtatatataatattcaagtattttaaaatatttataaatatatatttctcctctactcaatttcgatttccccgagcagatgactctgtacgtttaaacactctgtccgactagtcatagcccccaagcatcgggagtcggtctaggcacttcccaaacatgcatatgagtgacatgagttcgtcattaatggaacaaagttttacgaatcataatttactactcgggtacttttgcaattgtaaagagcagaaattaaatttatcttatctctatgcttttgatttattccgaataatacttagcaccttgcgttactcgctccatccaacgagccctcgggtgctaggaatcagcccaaaggcaactatccatcgacaaaccaaacggaaagcataggaagatagaactccataactcgataggcacttttgtactcagattatgtcgcaagcaatcaagataaatattatgatatttgttaaaaaaatatgatataacgtctgtagcccctgattcgctagtcaacggcgaaccagttgacatagtgagacagaggaaaaggaaaatatcatataaagaaaaaaaataatgacttagctttgtaatattcctcttgatgacggcagaggtggctgatgtgggagcaaagttgtccatcaataacaatgaagacaccgggcaacggcggtgaaggcaagccggtggtgtagatgacaaggcccatcaatggcggcggagtccgccaactgtataggcgaaaacaccagtcgacagcgacaaaggcaaaccggcagtgtaagcgaagacgcccatcaacggtggtgtgaccaaccaaccgtataatctaggatactagtcggcggcaggcgaggctgggcagcaatgaagtcatagacgtccaacaacgccagccgtgtaggcggagacaacagtcggcgacggcgaaggtgagccggtcggtgaagacatggacgcctaacaacggtggtgtgaccaaccaaccgtgtaggcgaggacatcagtcggcggcgacgcaggcaggccggcggtggagtcgtagacacccaacaacggcggcataataggtgagccgtgtaggcagagacaccagtcggcggcggcgaaggccagccggtcggtgaagacgtagacgcccatcaacggcggcataggccgtgcagacggaaacaccagtcggcagcggcaaagcaagccaacagtgcagacgtagacgcctagcaacggcgtcataataggccagccgtgcaggcgaggacaccagtcggcggcagacgaggcggccggcggtgaagacgtagacgcccaaaaacggcggcataataggccggccgtgcaggcgaggacaccagtcggcggcagacgagggggccggcggtgaagatgtggatgcccagcagcggcgacagagacaattggcatgggtacatgcaaaataaatcaactaacagattaatctgttcagtaccacataaaataaatacaggtataaagaagcttgtgtatatacgtttgcatttatcaatgcgtatatgcagctcgcatatattgattggccaattaatctcctgtagcatgaacgcttgatatgcatccacacatcgcctgaccaatccatgctcgtgcaatctagttgggaagcttgtcttcttatgaatcggactcaaccgttcattagacatgcaaaaatatatatcacaaattaacttgtgattagtgaaaaataataattaattaattaatataatcgccgtaaccggccagatgatcggttgagaactcgacacggcagtaagcgatgctatccgaaatctcattatagatctctattagatcagccattgaatattggccgacttcagccaaatcgcagggcaagatcggacgcagaagctctccgccaacgccgagccatggtgcatatggttatccggaggcgatcagcagatctcatcagccgccagtgcatgcacacaaacaaagcgtctcacagaagagcaatccatgattagaagaatcaatctaataacaatatattgaaacgacaaaccagtagacgtttggagtggtcgaaattgttgagattaatctcaaccctgcttttggaattgattccatcacacttctttgataggaactcgacgtacccctacctggagcgccaactgtcgaaacatgaattcagcaataataaaaggggtagcgcacgagacctaaaagtggatggatgcggagacaaggatttagacaggttcaggccctctcaatgagaggtaataccctactcctgtttggggatttgaatccgccaagtgcattgtagatctgacgatctggttgtgtgtcatgccccatatagagcctcctgcccaccttatataggatggggggcaggactacaagatagaaaccttaatcaatacggtatcggtttcctaaatctactttacaatcttatcaaactaggactttaggccgttccataatatacagggaaacgtaatacccaagtcatgatccgttacatattccatagatataagttatctcctataaccagtctaataaccatgccgtgtgggtatggggtacccataatctccacacgaacgatgacagatggcgacggtggcgaggtcgaggtggcgatggtcttcgggtcaacggcgatggtcttcgggtcgaggtggcggtggcgacgacggcggtccagcggtcttcggtgaaaacggagggtgggacgatgacggcgatgaccttgccgctccggcgacggcaaccccgagcgacgacggcgactagagtggtggcgcggcacggttggacacgcggcaacggcggcggcgcacgagctagggcggaggcggctctaccagctacggcaagccaaggcgaggatggtggcgaatggacgaggtcccgggggtcattttatagcggcaaagcgcggcggctaggcccacggcgagcccggcgagatggaagatttagggttagaggggaagaatcgaattcgaatccgggctatttccatagaaatttgcgatagttccaaaaaggaaaaggaagaggagatccgggggatcatttcccctcaaacaatttggccggagatggaaaggggtggccggatttggaaggggcagcggcagcttgcggcgcgggtatggcggctggaggttgaagacgactgacaggtgggccccacctatcagcggaaaagagagaggagggaggggtgcggcggtctgggccggcatgggccaagcgcgcgcaagccggggagagagagaaaggccaaacccaaaagagagattttaaaactttttctatttaaattattcatgaaatgcaattctatttattaaaaatacttccttggctcaaataaatcccagaaaaatttaggaactatagaaacaatagaagtgttttaaaaaattatctagcctactgttatattggagtttattaacttaaaattagatctcttgttttaggcttttaaaattatttctaaaggcggcgaaagtggtttgtcccgaccacaaattcggccgaaccgccccagcttccacatgtaagctcatcttggtcgccccagcagttacctccttaaaatatggtataatttatcaaagatattaaaagttcaaataatattaataatgtggactagtgttaagagatggtctcctattaaaaatctaaaaagatagattgaaggttgtagagttataaagaaatgtgatatgtcttatggattcaacggatatcaaatagtgttgttcaccggatatacatattattatccgtgtctgttagaaaccccgataccatattcgtattcgcattcggaaagattagccgtgtccggacttttcgagaattatccgcttcaaaaggaatccgtatttatttttctccacagcgaatagaaactatccgctccgttttaatccctagctagggcgggcttgcatctgtccatctaacttgcttgacattttcggtctgttcatctatatctcgggttggtacgtggtactagttactactagatcagcatcgtagaatatctggtgggagtacgcgtaggagattggaaggacagtgtgatccataagggtacaatatctgccaagcacgtgctttccctgagctaactaaattaatgcatctaactagtactgtacttgataagatcgggtcagcaaaggtggacaatatatactacttcctccatatttaaatgtatgacgtcattgacttttcgattgactttttgactgacgtttgaccattcgttttattcaaaatttttgtgtaaataggaaaatatttatgtcatgctttaaaaacatttgatgaagaatcaagtcataataaaataaataataattacataaatttttttaaataaaatgaatagtcaaacgttaaacaaaaagtcaacagcgtcatacattaaaatgtggaggtagtactttattagactccaagtcccaaccatatgcatatagctcagattggtatagctctcgccgtggct

SEQ ID NO: 29160 - DNA, 21741 bp, Oryza sativa
agcgccgcgccggcttcgtggcgcgccccggcgacgtcgtgctcgcgacgctgcccaaggccgggaccacgtggctcaaggccctcgcgttcgccaccatggcgcgcggcttgttcccgccggcgagccccgaccacccgctccgccgcctcaactcgcacgactgcgtgcctaccgtggagagtggcctgttcgcgtgtgggcgggagggtgtgctggacaagctgccgtcgccgaggctcttgaacacgcacctgccactctcgctgctgccttcttcaataaccgacaatgatgattgtaagatcgtatatgtttgcaggtaccttctttttcctactccctccagttttggatttgtttacactgcacaaataatcatcagtgcccgttccaaagacctcaaccaattggtcagcacctatgtccagggtgcataggtgccggatctggaaccggcacctatagttttcaccgaataaaaaaaatcccggccaccgccaccccacacctcaccaccttcaccaccgtagccactgccgttggctttctccatcattggcgctgttgtcggatggagagaagaaggcagcagagaggagaggagatgaaaagctgttgccgttggtgcgtctagaggaggagaaggcccggaggaggatctggaggaggtgaaggctgggaggagaaaacccaccatcacctcgccgctcctcaaggtgacgagaaccacccaacggtgttgagaagcgaagaagacggagaggagcggcatacttgagagagagatagacggagaggggataaggttgtgacttgcagtgcgtcagtggacttttttttaataggtgccattttttaaaagaacaggcgcctatagtgctggttttaaaagaaccggcatctatactagtataggtatcggttcttttaaaaaaacacctatagtattggtatcggttgttttctagaaccaatacctataatataagtatagatgccggtttatctagaaaccaacatatacagtattggtatcggatttttccttgaaccgacacctatagtgtttaaaggtacaggttatatttttttcattgcgcgcagggtggaaaaggggggcataggtgccggttttaaataaatcggcacctatatgccagtccttattagggtttttgcagcaatgttactcttcttcaatttggtaaaattcatagaaaaatatagcaacattttcaacatagaataaatacaatgtctgatgtttctcatatcatgtcattaacttttgttataacatttgaccattcgtgttatttaaaaatttactgtaaatatatgctaaactataagtcaaaccaaaagtttctttgataataaaacaaatcacatcaaaataaataacatgtatataattttttaaataagacaaatagtcaaatatcatgctaaaagtcgacggtattatctattaaaaatatcttatgaaagccacctagaaagatgttgggatgcatgtcattgacaagccaaaaacttgtaccggtccacatgtcaatagcccgcgataaaatattttcgagatggaacattggtatatttcgaaaaaaatatttaacatatatatattagtttctactaaatatttaatatattaaacaagatactataatacaaagcaaaagtttatccctaattacatactacttgtcataccctgggcatatgataaaaaaaagactaactaattagttgctgcataatctctttgcctctagagccaacgtttatggccgacccctgtcggagcacactctagggcccggtcagccggtgccatggcgctagtggtcggcccataccagagtgcgtgcttggggaatggggacgaccgggtcctcatgtgaggactctggctgcaccttctcctccacctctacaggtgcctcctcctcccagctggttgatgccctagacttcacctcatgcgatggccccacgactagtcgattacccatctcatacaaggaagatgaacaagacatgacataggtggacacaggggcggagctacatacagctaggaggtgcctagaaacccggttcaaaaatttttttacttatagtttatctattttcaccatataaatactctattagttcaaagttaggcacccgtattaagctaaatttgattcaaaccagggtaaagcaagcaagaggaaccctcctttattttattttgtgctagctccgaccctaggtgggcgtgggcatttaacggcacaacctgaaaaattgcatgatatgagcagggtattaactgcatcacacatgtaaataaaccaatgttttcataggtagagttataagacagttgcctgaaaaaaacatgttaccttgggagggcgcttaaggtagtcgcccatggtattttgtttacataacggtcgtggacctcccctaccatggtaaacataaagcaggtgattcgtatcttcgtccacctctggaattaaggtaggggacatgcaaaaattattttcctactagtgcgatccaacgttcatgatttttggatgacgtggatcaatgcatgccgtgcttttggttttcactattagaaaagtttaagagttaattgcatctcttgaattaaaatttgttgctgacatgctaatttgcagagatgagaaggacagagcagtctccacatggcacttcatcaagcgtatcaaacgtattggatcagatgtgccattctccgaggtgtacaagtctatctgcgagggcacttctgcctgtgggcctgtctgggatcacatcctcggctactggaacgcaagcaaaaaagagccaagtagggtactcttcctaacatatgaacagatgctccaagatccgatgggcacaattaggcaattagcagagttccttgggcagccgatttctgatgccgaagaagaaacgggtgttgttgcagagatcgtagagctttgcagcctagagagcatgaagaaacaaaagatcaacagggaaggataccagggtgtcggcattacgttctcgaacgatgcctacttcagaaagggagtggcaggagattggctgaaccatatgaccctcgagatgggacaacacctggactcaatccttaacgagaagtttgatgggtcagggttcactatttgatgctttctctatgtttcttgagaggttgtttgaataatctgcttcgggaaaacatctagttttcctataagccacctttagcatgctatgtggtaatgtggaatttctcgtgtggactttcaacaaagaataagcgtataaggagaaccagttctcactgtatggagaattatgtaacactagtcgttgttgacccttgcattgcacgggtatcattatttacattgtagacatatgttaaacctttaaattgaaattgcaggagtggctgaaaagttagttgaaattttaaagatggtattttgactaatttgtatggctgtggcatcgcccatgtccctcgtgcgccattgccaccgctctcggaggcaaggcataatgcatgtcatgccctgaagttttcctttttctggtcttaattcatttaataaatcgctaaaagaaattgtttaagtttaaccttgagctaaccctaattaataattttatttaataaatggaaatagcttggtgggatttttcttgagttccctatgctttaatacaccaattgaatttttagtggaattttttggcaagaagacaatcacgattaggatacctaaagccttgcggtggtatggagtcgctaaccaccccaacctagcaaaaaaactagatcaagatgggtttcgatatattaaccggccagcggagtcgatttagatggaactaaagatgaatacatgtttcatgggcgaatagaaggtctatgggacaaacctgcaaagatatttcgcactctcacagcgaatgcggacgattcataacgcaaatagataaagatggacaaaactaagctaaactaggcgaaaagtagatgcaatatcgaaaaaaatgattcaattggctatattgtgttgaaagtagattgcttccaatagaaccggccttggcccttatatagaggttggtcggatcaagcctcacccgttacatcgtatggtaaagcctagtctgaaattttgtgattttcacaaaaagtagagggcttttatataagtactaagaatggggcacatctcacgttccaatgagattacatctcttgaaaagttaattactatccaactccctccattaaaaaaataaggtccaactatatttttaaatttttttataatataagacgtgcatacatgagtgtaattaactagcacctcttctttactaaggccccctttgatttaaaggaaattcataggaattttagaggattttattcctgtaggaatttttcctatatagccctgtgaatcaagggaatggatcttatggaattctatgaaattcgtatagaatgcataataccatgcaaattttggaggaattctaacataaggtagaaccttgtggaaactttcctttcagtttttatctctcctctaattcctgcgttttacccgtggtccaatcaaatggttatttctatgttttgcaatcctctattttacacttacatttctatcaaaatcctacatttttcctattcctatgttttctcaattttacgattcaagggggcccttaaaattattatttacttcactttcaaaatctctaattatattggttgcatgcattgtatcttttaaggtgttccaaatgaggaggtgttccaaatgaggaggcgataattgttgttcttttatttgggttaaaggtggttgtggcttatattttggattagaaggagtattgtataagttgtgacaaatctctaattttattttttctcataagagcggcgtgggtggagggaaggggcggtgctggaggagggcgtcggcggcggcacggccggaggggaggtgcggcttccctccctctccctcagatctactctccctccgctgctggccgcgacgacaacgccgatgacgacgccgcttggatccggggaggggaggggaggcagcagcgagaggagctgaggcggcagcggcgacggcgtggctcccctccctctcctctccctccgcggccagccgcaatgacattcgctgcgacgacgacgatgacaatgactccacctagatctgggaaggggaggggagctttggcggtggcgcgcggccagaggggaggtgcggctccccctccctctcctctcccgcagctctactccttcgtgcccggccgtgacaacgacgactaccgcgactacgacgataacaacaacgacgacgccgccgttgccgcctggatcctgggaggggaggggaggctggcggcgccgccgacgggttagggtggtggcggcggatttttttttattcgctaaaaatattttcgcaggagggtggttctactgcctgcgaaaatagatgcagcctgcaaaaatggttttcgctgggccgcctgtgaaaatcatctattttcacatgcctttgcgtgtaggtggtcctttttccgtttggaaaagcgattttctagcggtgtgtgtttcagtgttttaaaagattgaaacattttcgatttagttggtgaaacattttttttaattagtgaaacagcacgctatttttgacaaactaatcggtgcccgatttataggtgctccgaaaaggaccggcccttaggagaaatacagttgtacaacttctgatcttccgacgaacatacaggcacgtacgcacgcaggccagccggtggcgacacgtcgccgtggtcatcatcggccggccggagcggtatgtaaaacaaaagcggcgcgccggcgatcgctagctcacggcatggcggcggcagggacgaagggaagcaggcccttgtcctggaggctgacgacggtgtcgtacaggcactggctcgccggcatgacggcgacaccgagctccgccagcttgcggctgctgaaccggcacccctcggccgtctcgccggcgtcgcccttgcacctggtgggcaccgggtaccccgggaagagggcggccaggatgcggcacacctcgccgcggtgcagcgtgcggccggcgcagaggtagcggccgcgcgcggcgggggactcgtaggcgcgcgcgtgcgcgtccgcgacgtcgcggacgtgcacgtacgcctgcgccgcgtcggcgtaggtgcgcgccgagccgtccaggtacttgagcacgtgccacgtgctggcgttcaccccgcgctgcagcagcgggccgagcaccagcgacgggttgacgacgacgaggtccagccgccgctccttggcgagctcccacgccgcctgctccgccaccgtcttggcgtagcagtaccagtttccggtgtccctgcagtggtcgaggtcgctccagcacgtctcgtccacctcctcgccgccgccgccgcccatgtacacggcgccgatcgacgacgtcatcaccacgcggcggacgccgcccgcgtccgccgccgcggtgatcacgttcctcgccccgctcaccgccggctcgatcatcttctcctgcgagcatatgcattccggtcagtctctcttagactgtcgaacacgtacggcgacgtcgtctcgtcgtcgccggcggccggctggtgcaggtgatgagtcacgtaccgggtcgtcggtgatgggggaggcggtgtggaagacgccctcgcagccggcgaacgcggcggcgaggctctccttgtcgagcagctccgcccggacgagggtcagccgctccgcggcaccggccagcgccatgagatgcgcgttcttggcagcgtcatctgcagcaattaattagaagtaattcattagttaatgagttagctaaagaaactagaattaattagctagcgctgactaatcacatcattagtgattaattttgctaccctttctgttgctaccagggttctcgatcgagcgcggtgtgtcagccagccatatgggccggccgtgttcttcgctaattacttaattataagattaatcgatcgagggtcaaacggttgagatatattaatatcgggatttgcaaaattaggagattgtgatagttgatcgttgcctctttatttctcagcatccccgatatattgctgcaacggcatgtgtatgtacgctgttttgctcataagatctggagtatgtttttttatcatgtgtttcaacatgaaggtcctgttcgacatatcctgatctaagattttcagagttggatatttataactctacaaatccaaatacataattatattggtaacatttgaataaattattttaatctcattttaaataaaatataatttttaaaccactatgatttaacataaaaaaattaaacccagctagcgtggatctggaacaccaaacaaactgcaaaaatacttttatataatacacacataattacgtattaatctacatggatttcttaaaaactaccgataacaatatatatacataccagggttccgaacggtgccgcggacggcgtagcccttctcgaggaggagcttgacgagccacgacgcgatgaacccgccggcgccggtgacgcagacggtgcgccctccgccggagaccgccgcggcgccactgccgccgttcgccgtcgtcttctcgacacccatgctagctagaacctagtgttaattataatttgctaggaagaagagaaagctagagcttattagcgctgcaaattaagctactaactatatactatatgtctctctttgcaacaagttcagtgtgtgctgaagtagtgaagtgatcgaaacaaacgatgagagagggggtataaatagtgctggccgggggtatatggcggatgcacgcgtgatggccgcccgggggtttggtgtggccacatgcgtgtcacgttgtggcgtcttcttggggttaacatggcgcagatagcgtgtatctatgagagaatctcttcttcgctaatattctatgctggttttccttgtactatttgtttttgttttgaccataacttgggaatcatctgttaactggaaacttcgttttagggtgtgcattcctcgtttatgtcctgccttacttctcgaagaggaaaggcgtgtttaatttgctgttcaggggaatctgcagtttttagttttcctaaaaggaggcattgaaagttgttcagcttctggataacaactcgcaagtcgcctgtacttttacatggacggtgcataagtgtaattttgtaaacattctttatttgatgtagtgtataataagaagaagtattttaaatggagaaatgaaaacttttagttctatcatgatattagagtctctcggccacagtgccgtctctcttcgtgtgacactggtgattggcacatgagctgtctctctttctctccctagaccccgatccccgcttcccactcgcacattctctctctctcttcacgcgccaatgtcatcatggctattcactcactctctcagaaagatgagaacttcttgcgagatgcgtagaggtgagatccgcgtgcaacaacttctctggcactcgtaatgttggtgtcggtggtggcgctagctatagggtgggccgttgggctcacaacacatgccatgacaagagcgacatgcagctacgcggtgaggtgatgttacagccgtgttaggccctacaccatggatgggatgcgatagacctcttgctcaccctcaccgttggtgcacttctctcccctatactaagaagctggcgagatctcctactgtagcccatgagataaggctgttggggaggatagagccgtggaggatgtcattgaacccattggtcctaagatggaggagggcagatgagggctcatgtcactttgtcatccctctctcaccctgatggctcgtccccacttcattagagctagatttgggctcccaaggcttgctcgtgacccagggcagtggcttgtgggagggcgaagatggcggcagtttgcggcgggcaaaaatgcattttttcttccaaattcttttctcttccttttttgaaacttgcacgatgttgtttggatttttcttttcattttactctcaagtaattccgtacttttctttgattgaagaacaagaagaaattgaaaggggatttatcttcagattacaatgggacatatagttgggaagcatctagaatttaacttattattttctggatttcatttatatttttatccccttatttgattttatcaggtaatgctacaggtgtcttcaaccttttttatcattagtttagctttaatattgttttgtttactcctaggtcacttggatcaaaccaaatttgaaggctctatatttctctagattttaattttttattcttttccatgagcttgaagtattttgagtgatgactcctaaaagcaacacgcgtcaacaatttatatattgagcatccctataaaccaattcaacttgcagcaatcctgccagctttagatggtataagataccctacattctcccacaggcgtattatgtttcagccatgtgtgaacggcgtccatgataatttcaacctgtgtacgtacacgggatttgccacacattttccacgaacacttgcaaggccaatgcaagtggactaaattcaaagaccaagcaacaatgtgaactgaatctcatgcatcaaattagaacattaattgtggccggcgacgatcgagtcaaacataaggcacgtatataattaatatgtacggagtattaggtatcaaatgaacgtctcttttttttaaaaaaaaaattagtactcctcgcagctaattaataaggccccagagattattaatcttaatattctaatcgtcttcacacatgcaccttccctaacatgcactgttactctgcattgatgatatccatgtgaatattaagatcactgcattgaggaataggacgacgtgagagaatagattaattaataagattccgagttcaatctatttgttaaatttgcagattaattaattttaagtggtttcacatcagatgacctgagtcatgtatgaatatcgatcgtatgtcatgcaagcggtagttgcatttgcagctaattaatagcctaatagcactactaaaaaccctagtcactcagaaccggcacatattagcctttcccatcccccgacctctaggcggctttaaaacccgcatatatgatgcagtactgatttattgaaaaaacgataccaataataataatataggtgtcaattttttttaaaaaatgtgacactgatatgtaataaaaccaaagtgtagtagttttgaaaaaacaacacttttaggatggagccaaaccgaggccgagcatgtagtgggaaaaatagaaaaagaaagccactaaggtctgatttagttccccaatttttttcccaaaaacgttacatcgaatctttgacacatgtatggagcattaaatatagataaaaataaaaactaattgcacagtttgcatggaaaatcgcgagacaaatcttttgagccaaattagtccatgattagccataagtgctacaataatccacttgtgctaatgacggcttaattaggctcaaaagattcatctcgtggttttcaggcgagttatgaaattagttttttcattcatgtccgaaaaccccttccaacatccggtcaaacatcggatgtgatacctaaaaattttcttttcgcgaactaaacacatcctaataagtcccccgtccattgtttcctccgcttcttatcctttcccaatctctctcatcttccatctccccctccggtcccaatctctcgtcaccttttcctatcttcccacccacacctggttagtggcacaacaaggcctttcttctccctgccatgacggccatcagatccagccgatgggatgagcagaaggagtctcctaggctgctccacttcttcctcttcactgtcgttgttccgcctctattacttcccccacgtgtgcaatgttgatgagatctgctcaggagggaccgagggagggaaaggtggaagagcatggagatacggtcaccacgtgcttggggctctagaacagcaaggtcaggttgctccatgcactaatacaaaagacattttctcaaacggtcaaaatcaatttttccacgccgttgagccagccgtttgcatcaaaaggtctttaaaattagcgatttttccatgcgggtgtttatgcggaccgcatgcaaagataaaaaatcacaaaaaaaaaacaaaccctagcgcccccctctcccgccatcactcgctcattcgtctgcatcggccaagcccaccgttgctgctcccgccatcgccggcgccagatccgctgccgcagcgcctccctctctagatctgccgacgcaatggggagcggagcagccaccggatccggccgcccttgtgttgatagaaaacacgaggcctgggagatctgcttaactccagtgcaggtccaaaactcgtctttggatgtatgagcgtgtcagttgatttgatcctgcaatcaacaagaaacaaagacaaagaaaccgtgattaaattcataaatgatagccgatcggctagatgccgatgacatatcatttatctttgagccgatgtcatgtgtaaatcgatcggcaattgtttaagtaaacaaatcagaactaaatctactcgatcggctgtagatatcaatgatatataatccttatatcgatatatacttgaatcaagtgattgggatagatcgatcaccttgccgagacagtataaatcacctagatcgaaatatatattaataatgagattatatatatattcatagcatagccgatcagatagatctagcgtgtatcggctaatactgcgatactactttatattaagatattaaagcaaatagaatatactaaacagaaatctaatatacttaaatgcaacaagatcttaacataaagggcagatctaacatgttaattgagcatgtagaacaaaagcaattggatcagataagatcggctgaaactccgatactaccctaatcggcaaccagtaggtaggctagagattgaaattctaagcacgacttaatagatcaaactcaactgatacagcattaagtataaaaagaagaacaatatctagacaatcaagccgctggatgtttcatagagtggtggatatctcatataatctaagccaacgtcgttatttaacctaatcggctgccttctggtagcagatgttagccgattgtaggttaaatgacgatattgtcaaggattatgcaagatatatgataacttgacagattacataaacaagattagagtatcataaagatggaagcgctaatctcgagaacacaagccgccataacaagttttacctcttgttgaagatcgaaactgatgcagctcaacccgaaagcaataactcatcgaaataaaacgaaagcaaaaagggtggcgatgcgccgaaattgtattgaacgtgtgtatgtttttattacatagggctcggggtctatttatacccgagaaatacaagatatgtccatattggacacgactcttatctctaacaaactctaagataccataagtctttgcggcagacttttgcccacattttatctctaaggaatttacataaaatatcctaattaatagatacaattgccttcccaggactctatccatgcgtgacaatcatcttgaagcacatcaactcgaacccaatgttgcacacgggtcgtattgtcggaatcggctgtatcacttaaccagtccaactcagacttagccgatcccagtcgtagccgatccggactccagccgattcttactctgtttccgaaaaaacccttatcttcgattccgcttcgatttcatcttcatctccgatgctgatattaccaaatttggtcgtaacacatgccccccaagtccgggatatttggtaatgttccggatttaccgtgtatagactccgagcaagtttcgcactctgccgttttcccgattgttactctagtgcttcaaatactaaccgttatccctgagaaatctcacaccgtgacttccgttttccccgcttaagcgaaactttaccctctctctctccggcgattcctccgacgcgcaaggcgatccccaggcgacttcatctccggccagatctccgcctgcgacgatgtcgacctccgccagcccatctgccgcaccatcagccgaatacgctgaggtaagttaccatcggctagatcccctttttcatcattggatcggttttctctcgcctcatactgctttcttttctcggttactctgaacttgtagcatctctccaatttagtcgcaattccaagcttgtcgcatgaaaaccactactttctcggcccaatcggcaaccccgaccccactgagttcatcatcggtgagaccaataggattccttttagactgtccaatccagatctaggtcattggaagaacacctttaaatcttggccgtctctagaaaaaacatcacccgagaaaagttggattacatggttcaagcgcatgtcggctagcaaaagagttcactgggatgaaatcggaatcggccaagcacttgacctaaccatagcaaactcagccaaggatgaacctctaatggcagctgcctcttacttctggtccaacaccatcaacgccttcttattcaaccaaggaccgatgaccctaactctcatagacatcattatgatcatgggtctggatgtcacctcaacggctaaccccatgaatctgaacatgaagaaccaatacgacttcaaaaccaagagtatacgaggttggttaggctatgtagcagcatacatgagccagggttctgtcaccctcgagaacatgtggcctttttgctaatgtggctagaaaaattcctcttttatggatcaagctgtggccctacaaccaactggcagttcatagccgaagccttggaagcaaagaaacaatttcctttaggcaaaatcctcctcggctacttgtaccaaatgctgaataatgcttcggctaagttagctgtcggctcagtagttggagcaggtggaccatggtggctgctgcagacttggttgaatctaatagtcatgaaagtcgttaatcggccatccgtcacagaagctgaatttccgagattagagccgattatagaagatgacgaagaacgcactcatcgccgatgtatgtcatatagagtatacgcatccacaccggccgatgctggagcaaagttatcagccgatctgctcaaagattggttctgcagtttctatgaaggctttcaaaaagatgctcgagtttggtttccctatgaagattcagcagacctcgagctcccatcagatttcagattcaaagacattaatcatgaaagattccaaacatccagagaagtcttcatagctgcaatcagtccatgcattcttccagtcggcatccatcaaggaagaaacatccaagcctcttatgaattctatcacccaatgagttcagctagacagcttggaatgggccaactcccaatcggcttattctttgctgacaagatccaatgccgaggagaaatttcatcaaccttgatgatggatcggctgctcagccttccaggaccccctctgggcagcattgaaaacatagagctagcaatgttcaggagcaaaaactttgatagatggtggggtgaatggaagttgcatctattctaccaactagcttcaatgtacatgacaaacctctttccagatgttgtccctcaggtaagtctttgactttacttgatttcatttgaataactgcttagccgatttaccttaactaatctcttctttgatttgtagacaacagaatcctccctcctcgtcaaagcaacaggggcagggacatcacctacaccccaggcttaattcctaatgaggtgggccatctcctcctgtcatcggctatgatgcccccaagacttcagctcttcttcaagagctatcagagaaccagccgatgcccgccagaaaagggaaaccagatcatcagctgtagatacttcagccctggcttccaagaagaagatcaaaaagaaagctaaaccagctgatgatctgcctgccctagatccatccattgaacaagctctggataaagaagaaatcggagaagatgttgatcaagccgcagccgaagtaagcgatactgaaagaacaccatcggcttcacctaagcagacccctccaactccttctgctccaactccttttacaagagtaagcaaccttctctaaccacttttgtaatcatcttactttatagccgattgctcacatacctggtaattgcagaaaaggaaggctgctgtgaagaagaaatcggctccaatggcatctaaaccagctccaccggtacaatagccttaattctttcattagttaatctcagccgattttatataacacttgtctattttcagcctccttcctctccttctcctcctattcaacaatcatcaagcgatcggaccccatcggctgtagggagtcattacatagaagaagaagttcaactaactgctccgactatcccagtaaatttcttataaccaacatatgcagatcgggtatgcctatttgatctctaactctctttaaatcatcactgcaggtcttaagccgatcttttctcttttgatatcagagattatcttgatgaagagacagaggttgacactactagcaaagctctagctcctttctctgatgacgtaaagaaaactcttgaagacatctctcatcagctagagacatcgtcactagacagctaagtagtcgactgtggatcaattaggactcatcttcatgaggtccaaactcaaatcctagatgagttagccgatatccttactccagctgtttatcttgaacaacatcaatttaagctggaaaaggccaagctgagattagccgaacatcgagagcgcaaagacattgaagcaacaatccaggctaatcggcaacttgttcatgaagaaaaagccaaactcgatcaattatctgaagtcccgatcaaatccaatattgaccggcttgaagctcgcaagattgaactcttagcataacttcaagaatgcaatgccaaactggatttagagcacaagaagttagccgatctcccacaatctatcgaagaacaaagagcaaagttaaaatcggctatcaagaatgttgctgatatgaccaaatctctgaaggtcattcctggaaccgatgctcaagatgcccaagccatagaagaagtacaacaaattaggcagagagctatatcggctatccagcaatacttatctcaattttgccgattaatatgacatataagctttgctcaaaaatttttgcaaaaaatttttttgcactgtattgtcttctgtattgtgatagacatatatgcccccccagttttacaatgtcaagaacattgataaaaatatgaaacaactaagggcaatataacaatatcggccattgtacatcggcaactctcaaccgattacaacaaaacaactaagggcgatataacaatatcggccatctcaaggcgatgcaaacgcaccggctatcatgtatcagcaatattagccgatcatgcatcaacccaaacacttgggtaatatttcttcaaatacttgccattaagcgctcgcccaaaaacttctccatcgagtccttgcaacaggtatgctcctttagacacaaccttatggatttggaacggcccttcccaatttggtgaccacttgctgaatttgcaatcccgagttccaatcggcaaaaccaatttccacacaagctcaccgtccgaaaaagtcttaggtaccactttcttattataatgccgagcaacacgttccttatccctagtaactcttgcaagtgctcataattgcgactgaaccaagtcctccggttcatcggccataagattatagtactcttcggctgtcaaatcattttgcaactctgttcttcttgagccgatttgaacttcccatggtaaaacagtttcatgtccataaacaagcttataaggaggaacttggattgatccatgacaagccatccgataagaccacaatgcttcggctaaacgggtatgccactgctgaggataatcagaaattttccttttaatcaacctgatcaaacttttgttagatgcctcggcttgcccattagcttgtgcataatacggtgaaaaattcaataatttgatacccatactatcggcaaactgaacaaactcataagacacaaagattgaaccttgatcagttgtaatagtctgaggaataccaaatcggtagattatatgttcttggacaaactgtattgcatctccagaatcagccttcttcaaaggaatcgcctctacccatttggtgaaataatcagttgccactaatataaacatatgccctttactcgatggtggattaatcatgccgattatatcaatgccccatcctctgaatggccatggtttaatgataggattcatagccgacgctggcactctctgaattgcaccaaatttctgacaatcttgacagcccctataatatctgaaacaatcttctaacatcgttggccaaaaataccccgtacgccaaagtaaccacttcatcttatgagccgattgatgagtaccacaaattccctcatgaacttcgccgattgcaactttagcttgatcagcgctcaaacacttaagcaatactccatcaatcgttcgataataaagctcatcattcaataaaacatatttcaacgccttatatcttaacttcctagaagccgactgagatggatttcgtaaatattgatgcacatcatatctctaatcatcggccgttatggcagcaacttcaatctgaacatctttgatcatcggcttatatcctgatgccccttgagctagatcattggcctcaatattctgctctcgagatacatgcttcaaagtcactagccgaaacttcttcatcagttcttggcacttctcattataaactatcaacgtatcattcttgcactcatattctcctgccaactgactgataaccaacaaagaatctcccatgatttcaatagcatcggcttcgacctccttgagcaatgcaaccctttaagaactgcttcatactcagcttgattcgtcgcataaggtttaatactataagcaaactcaaagcatgccccccgaggcgaaattataactaagccgataccacaaccatgagcacaaaccgatccatcaaaaaataaagtctagggcacaatctcaactgagccgatcgaatcatcatgatagtcaactatgaaatcggctatagcttgccctttgactgccttcggcgactcataccgaagattgaattcagttaaagaaaatatccattttccaacccttcctttcaaaattggagccgacaacatgtacttaacaacatcggtcttacatatgatagtgcattcattggacaacaggtaatgccttaaccttgtacatgaaaaatataggcacaaacataaattttccacagaagaatacctagtctctgcatccaagagcctacgacttaaataaaacacaactctttcttttccttcaagctcttgaatcaaaaccgagccgattgacttctcaccggccgacaaatataaccgaaaaggtactcctttctgtggagaaatcaaaactggaggagaactcaaatattccttaatattatccaaagctttttgctgctctgccccccaagtaaactgctgatcggcctttaattgtaataatcgcgtaaaaggctttaatcttccagataaattagaaataaaccttctaacgaaattaatcttgccgatcatctcttgcaattctgttttatcctccggaggcttaatcttcttgatcgcactgatacttctttgggtaatctcaattcccctctcatgaacaagaaatcccaagaactgaccagccgacacaccaaaagcacattttgtcggattcatcttcaagccatacttcctggttctctcaaaaaccttcctcaaatcggctatgtggtcctctatctctttagacttaacaaccacatcatcaatgtagacctcaaccaaccagccgattaaatcatggtatatataattcatagctctttgatacattgctccagcacttttcaagccgaaagtcattacaacccactcaaacaatccgattgcaccgggacacctaaaagctgtcttatgaatgtcttcttcagtcataaaaatttgattgtatccagcatttccatccataaaactcaaaatcttatgccctgatgcagcatcaaccagttgatcgactactggcattggatattcgtcctttggggtagctttattcaaatctctaaaatcaatgcataccctaaccttgccgtttttcttggtaacaggaactatactagaaatccactaagcatatcggcaaggacgaataaaaccagcatcatataagcgttgaatctcagccttaacaggttcaagcatatcggctttgcatcttctcggcggttgctgatgtggtctaaccccgggtttgataggtagccgatgttcaacaatcgatcggctgagtcctggcatttcataatattcccaagcaaagcaatctctaaattcttttaagagctctatcaacttagttctgaattctacacataaatttttactaataaatgtcggtcttggccgatcgcctggacctatatcaatttcctccagatcatcggccgacataaaaccttgaccttgtttgtcatcaagatcatctactgtatccttggtgtagacgttcgaaccctctacgacgccctcaaaataatagcttgggttctccatcttcaattggctgtatatcagaatcatatacttttaaaaaatctccatcccagacctttccagataaaaaatcaaggccatccatctcccaaagagctaaattagcactagcaacattgactgacttgtcagccggcacgatctctaccttgtcgccttgccattgaatcaagcattggtgcatggttgaaggaatacaacaattagcatgaatccaatcccttccaagcaacaagctataagaacccttcccatcgatgacaaagaatgttatagggattgttttactgccgactgtcagctccacgttcaaaacccctttggtttctgatggattgccaccaaagtctttaagcaccatgttcgttttaatgaggtcttcagcgttcctacccaatttcctgaacgtagcataaggcatcaagtttactgcagccccaccatcgataatcatcttagacatcggcttcccattgacataaccgtttatatacaatggtttaagatgccgattctctgtcccctcaggctttttgaacattgctcgctccggtgacaaaaccaacttagccgattcctattctacatggtctacatcggcctgatcaatcccgaattcggctggcaatgtaaagaccatgttaattggtgccgttacaatactcttcccttttgccaacctttttgcctcttcggctacaacatcatcggctataggaacctgattcttaacacgtcattcctgtcttggctttgctttctttagccgatagttaatttcctgttcaacctcttgaagacgctccctgttcctcaacctttgaacccttctcttctgattcttcgtgaaaataccagaaggacaccattgatttgtcctaactatctcatcctcctgaccatgaccttgattcactgggcccaatctttgatgaacagacactctttcctgcctcagccgattactcctattatatgaccggcttgagctcccaatgatatcactacacccagggcagttttcaatggacggtaacctcatcccttcattccagcagaatctaaagaactcacaaccccaatgaggatcaaaaccatcatcgtgttcttcataatgcttctcctgctgcttgtcatacttcctctgatatttgttgattatcttagccgaactcacttgaaaaccctttgcacagaccctatcggctgattggccagctgtatgtaccatattaatagaaaaaggattaccatcgaccttcattggtttcttcgaatcatcaaacttgatttttcctccctcaatagccgtttggatttgctgcctgaagaccttgcagtcattagtcgtatgagacccagaattatgccacttacaatacttcttcttgcccaactcttcagccgatggaactttcctcttttcctgaggtctttacccattggcatggtataacctttttgctcctgacccactcggctgccgctatttcggaatcatcatcctcatcatccgatcttctgtgtaagatgtgacaagctttcgaaatcttcagatgagaatttttccctgatc

SEQ ID NO: 29161 - DNA, 25849 bp, Oryza sativa
cctcatttccctgaacctttgaatatactcatgcaccggctcatcatgcttttgcttgattgacgtgagatcagacagcttcatcacgtgaatcccactatagaaataactatgaaactgcttctctaaatcggcgcaactgttaatcaacccatgtggcagagaagaaaaccaagtaaaagccgacccagctaatgacaaccggagtaacctaaccctcaaagcatctactgtcgatgcctcaccacactgagctaagaatcggctgatgtgttcataagtcgatgtagtatcctgtcctaagaactttgagaagtctagtactttaaaccggttaggtaaaggaactctttcaaaccattcaggataaggttgtcggtacaaattcccagtctcatttggtttaagcccaaattgctccctcattacatcagctatcacatcggcccatggtcgctgctgaggtgatccttgaggttgttgtggtgtaggctcaaactggttgtagaactaaggctgaaccgatcctgcctgttggtactgaacttggggtgatggaggctgatattgataactcaaattgccccctggtaattatgaaggttcggccgaataccacgcgccaaatgctcaggaataacttgaggcaccaccgaaccatccggttgcacatgatgaaccaagtgttccgggaccacctgatttgcagggtactgcacaggctgaccaccaggcattgcaaacctagccgacgcattcattggggcttgttgctgaatcggctgaacgacctgctgtctcaacggtgtctactgaattggctgtaaagccggttgccttggtggcgtctgctgaactggttgcacggcctgctgaattggggatgcttgttgaataggctacacaacctgttgcctggacggtttttgttgaatcggctgctgctgagccgaattaatagcattttgaggaggtagaaacatagatgcaacctggtcttgtgttaactgagtcacattcggtccaggatgctgtgattgctctcttaccaataattggggattgattaattgacctggagccgatgacggtgctgcaggtgctggagccgatgctggtaccgtcgattgagctggaggagttccccgggtaagtggatgaacatcggtaatcaaagtccgataatttggaaaagtacccccttgcaaatagactgggcctgcagcctgatgttcagctattgaaccatcggctaccgatttcatcatatttgacaaagtattagttaatactccagattgattgatcaaagcaatatacacagcatagtcgacccgatcttgaaagttattgaaaaaatcttggaatgcattgtcattctgattaagattccccccttgcaatccctgagtgccgtcaccttgaactccatgtactccatgagagtagtcaccctggctctcctgagtcgacccatctgtaacacttttgtcactcggctgggctgatccatctggaacttgtttcttttctccctctttagacgaaccgatcccaagatcctcaggaaccaccttcaccttgtacttctgaacaaatgtgtcgttgcgagtttgcatgaacgagcttaaaaattgatcccgtgcttgctgcatcattgcattgaagtctttcttctgttcgggagtgagcttctctggatcaatgggcacaacgtttccttcatggacgtcagtcaaaccgaacttctgagtcttttccttaactttacccgggctgcccgacgacggagacagtggtggtttctcagccatgaaggaggctgccttctgacttctaatcggtcccaccaggcgtgccaaaagcatgttgatagaaaacatgaggcctgggagatctgcttaactccagtgcaggtccaaaactcgcctttggatgtatgagcgtgccagttgatttgatcctgcaaacaacaagaaacaaagacagagaaaccatgattaaattcataaatgatagccgatcggctagatgacgatgacatatcatttatctttgagccgatgtcatgtgtaaatcgatcggcaattgttaagtaaacaaatcagaactaaatctactcaatcggctgtagatatcaatgatatataatccttatatcgatatatacttgaatcaagtgattgggatagatcggtcaccttgccgagacagtataaatcacctagatcgaaatatatattaataatgagattatatatatatattcatagcatagccgatcagatagatgtagcgtgtatcggctaatactgcgatactactttatattaagatattaaagcaaatagaatatactaaacaaaaatctaatatacttaaatgcaacaagatcttaacaagatggaagcgctaatctcgagaacacaagccgccataacaagttttacctcttgttgaagatcgaagccgatgcagctcaacctgaaagcaataactcgtcgagataaaatgaaagcaaaaagggtggcgatgcgccgaaattgtattgaacgtgtgtatgtttttattacatagggctcggggtctatttatacccgagaaatacaagatatgtccatattggacacgactcttatctctaacaaactctaagataccataagtctttgcggcagacttttgcccacattttatctctaaggaatttagataaaatatcctaattaatggatacaattgccttctcaggactctatccatgcgtggcaatcatcttgaagcacatcaactcgaacccaatgtcacacacgggtcgtattgtcggaatcggctgtatcacttaaccagtccaactcagacttagccgatcccagtcgtagccgatccaaactccagccgattcttactctgtttccgaaaatacccttatcttctattccgctttgatttcatcttcatctccgatgctgatattaccaaatttggttgttaacaccttgccactcaccgtcgcagacgacgcagctgcacccgagatggatctggtcgtcccgaggatggcaccgccggatctaccgcccttgtcgtgcgcccaccgcgacacccaagggacacctcctcgtcggcggcgccacctgtcatcagaggagaggagatgagagagagaggagaggagagaaacagagaaaggagagaaaaatatagagggagagaaagaaggttgaaaaaaattaaagtggtgagggaaagagagaggaggggataaaaaatgaggagttatttttgcatgcaaatcacataagaggagctatccattatctcttaactttacgattcaataacatgcatgtctagattaatctaggataaaagtactgcgaatttggataccatgtctaaatatgtagtcttagaacatatggtgtgtcagggttacggataaggtataccctctacccttagatatacgtcatgtatcgatatggtatatctgcgtgtatacggacgttctctgtacacgctaaggaaattcatcacggagtccatagatgggaggattcctactcggatagaactgggtcatcactgtattatgtagggtccgatgtctccaagtcctacttggaggccaactgacctgcggtataaaagggaccccccgggaggacccaaggcatcgaatcgtaccgccaacacatcgaccacagcctacatgagccaaatcgcctggtgatctagtcgaaccaactcgactatgatctcgtcggtatcatcgagttccactattccctttgtaatatgtgatttatgtcatataatctcatatcaactagattagggctattacctaccaaggggcctgaaccagtataatccctgtttttgttgcttgatatcgtattacgtagatcctcgtaccagcgtaccccaataccctctatatccggtctacgggtatcccccgttgacagtggcgcgccaggtaggggcctttggtgctcaaggttctactactatgtcatcaagcttcgtcgacaacagcgtcaaccctggcttcaaccaaggagtttctacttcaacaatgctggtgtggactcaagtcggtgaaatcgtcttcccggtttacacctcggtgccgatctcgactggtccatcaatggccggaagtgagaacgccgtggttacaaccctggacgactccatgtcgaaggatcctcccgctgaagtagagaacggaacgtcgacaacatccaagcccgagaaggatcctagtgcggccaaaatcttgtccttccgacaagaatcacgagccgacaaggacaacttccgaggtgacagggtcctagtgtcctatccacaaaaccaggaaacacaccttgcaagcttgctgggtttttctcaacgtacaagctgagattcgtgcctgcaaagagcgtgggattcagcgtacttcttcaacccgtgatgtctattgtcctattcacaagacaaagaatcacgacctctcaagctgcaaggtccttctcagcgccatgaagacgtcgcctcctaaggtccagcagttacaaatctctcttagggatgaggacaaggaataaggagcgacgcttgtctcagatcgattcgttggggtaatcgacattgatccccatgagccgtcagtcctacacttgctcgaagaatagggctcatcgtcaacgagtacaccacgcgatgtatttgctatcgatgggaccagcacgtcagcgcgtgctaatgtagaagcggagaatcaagtggttacgccggcccagcatatcagggccatcaacacaatactgagggaaaccccttatgatcccgttctgaacgatgatcttgcacagtggacagaatgactacacgaatcagtggccaacctcagcaacgcgttcgaggaggccgctgccagagcacagctagaacaaccgacagctggcggcgccgatggcgaaccacctgagcagcggacatcacctcaatgagccactcctccacctcgtggtaccggcaatctaaatgaccatctgaatggtcgccgagaagcacgacgcgtgcaagacaacgagaaccgttcccgacatcgcatctcttcacgatgtcacgagaacgaagagcgaggagacgctcgggcgaataccgagaccgtgataactgccacgatcacgatgatcacgaacagcagatgccgggcgatactggttgaggacgtcgccataacgatgacgacggtggagatcggtgccgggacaataacggggggcgacgacaggattctcgagatcccgaacttcatcctcgtaatcgtacaccggaaccaagtgactcatcatcatcgtcatcatcctcttcatcctcatcgtcagatagacatccacgaaggacatacgatcgctgacaacccaccgcccccagcgtcgggtgtagagctttcagtcgttcgctgcgtgatgtccgatggcctgagagattctaaccgggagcagaagtacgatgggagtaccgacccagaagaattccttcaggtctactccatggtactctacgctgccggagcagacgacaacgtgttggcgaattatttgccgactgcattgaaaggttctgcgcgttcatggctgatacacctctcgccctactcgatttcttcatgggcagatctgtggtagcagttcgttgctaacttcctagtaacttacaagcgccacgcgatcgaagacgacctacacgcgttgacacagaacccgggcgaatccttgagggactatgttcggtgctttaatgagtgcagaaatacaatccctgaaatcaccgacgcttctgtgatccgcgctttcaagtccggtgtcagagatcgctatactacccaggagttggcaacaaggcgcatcacaactactcgaagaatatttgagattgtcgatcgatgcgctcacgtggacgacgcactaagacgcaagaacgacaagccgaaggcagggggagagaagaaaccagccaaggaagcacctgaatcaagcaagaagaaaagtcacaagagtgggaaaaggaaagcccaagcggaagtcctcgcgtcagaatacgcgacaacgaggcatggacaatggcgttcgacggcacactcaacagccaaggagcaggggcaggattcatcttgacatcaccttcgggagatcagggcaaccaacaacttcagggcaaccaaccaacaccttcaggagatcaggggcacgcaattcaccttaacttcagggcaaccaacaacactgccgaatacgaaggactactcgctgggataagagcagcagccgcacctggagtcaagcgtttgatcgtaaaaggggattccaaactagttgcaaaccaggtgcacaaagactacaagtgttctaaccccgagttgtccaagtatctcgcagaagtcaggaagttggaaaaatgatttgatgggatcgaggtccgacacatataccgcaaggacaacatcgaaccagatgatctagcacggcgtgcgtccagatgggagccactcgaacccggcacctttctagacgtcctgacaaagccatcagtgaaacaggcaaacgacgaagatagcccagtcatccccgacgtcagctcgggggctatagaggcagagcgcgccgtcgccgacatcgagaccacggacgactagcggaccccactcattaaattcataagcagcgacgagttgcccgaggacgatgcagaagccgagaaaataacccgtcaagcaaaaatctactgtatgatcggcgacgatctatataagaaggcgccaagcggggtacttctcaaatgtgtctcgtccgacgacggcaaacatctcctccttgacatacatgaagggatctgcgggtcacacgccgccagtcgcacattggtcggaaaagctttttgacaagggtttttttgggcgaccgcccttaaagatgtttgcgaaatggttcagcggtgtgaagcctgtcaatttcacagtaaacacacaaagctaccagcacaagcgcagaccatccctcttacttggccgttctcgtgctgggggctcgacatactcggaccattcccatgaggacagggcggctacaggttcctattcgtggcaatcgacaaattcactaagtggattgaagcgacacccacgggggaaatcaaggccgacaacgtcatcaaattcatcaaagggatattctacagatatggattgcctcaccgcatcataacggacaacggctcccagttcatcagtatcgacttccaggattactgcatcaggctgggagtcaagatctgcttcgcctcggtttcttcccctcagagcaatagactggtcgagagggcaaacggcatatcactacaaggaatcaagacccgtgtctacgacaggctcatgtcacacggcaagaagtgggttgaagaactcccctcggtactatactatgggccgtacgtactacactgacaacgtccaacaaggagacacatttcttcctcgtgtacggctcagaggccatgctccccaccgagctacgacatcagagtacacgactacagaagtactccgatgaggatcaggaggagcagcgaaacgatgatgtcaatctactcgaagaacatcgagaacgagttgccgtcagagcagctagctaccaacaggcccttcaccgataccccgagaagcgcatcagagcacgcacgctttcaatcggtgactacgtcctccgacgggttcaaagccaagcagggcgaaacaaactctcacccaaatgggaaggaccgtacacgatcacgcaagtcttgcggccaggtgcattcaagattgtagacagcgatggtcgcgagttggtaaattcttggaacattgatcaattacgtaaattctatgtataaatcaatagtattcatacttgtaagacatcttacagcttctataaagtttattttcaggtaaagattacaatcaaagtgttccttcctgacgatcccttaccacgatgacacctagcgttgaaacctatcctactgtccctttacgccgtcttgacaaggcctccgaggaacctaagggaacttcggctggggacgcccagagccgataaagccttgtcggatcctgtagagacaaaagaccatgtaagatctggtcgtgtaagagttctcaccgtgcgtattaaccaagccgtgtaatcggaaattaggttttccaacttcacggctgggggctaggatcagtgcttgttcaaccaaggcaggtcaaaggtccaagagccttatcttctaggggctagggagagtgtatgactcaagtgagaagacactcgtacacaccgcatccagagtaaggaaacttagtaagatatatttcttttcaatttcacaagtacttcttacagttcgtaaaaattccaaaatatattacatgcctccctgagatatttgtcacaggatataaagactaccaggaaggccagcaccagtccatggactgaaagactttctccgcaagcggcgccatcgactttgccaggttatctatctctgcgagagtcctccgagaacgtgaaaaccctccgtggaggaactcgagatgcagctgcggacggcgatctcgcatacaagccagcacatgccctcaagcatatcggctcgatcgacggcactcctgcttcagggcctcgtcgatacgcttgccgatgccttcgagctgagcgcaggccctattcaaccacgagatatatccggctgccgactcctcgggatccccgcgaggtactcggagttccctgtagactccggccatggccgtgcaacagctcctgaggtacgagttgaaccacacttcgcgacctcggagtgcttccacggaccggtccttcttcacttccaccatagtcctctcgagttcggccacctcgaacttcgtcctccagtattggatgcgacgatctcggtcggccagtgcactctcgaggtctgctcagcatggaaacgactaagtcaagctgttcttctctctcgagaacacagcaaattaagtcaatcccgacagaagagcaaaggagatgaaaacaaaaaaaaaaaaccaacctaaggaagtcgtcgccatgcccgctttcatgggcaagttctaatctatgtcgacctgcagcacatatggctcgagcgcaagtgccggaacgattacaaacaactcaggctgtctgcgctgctggacatcctcgacatcgacatctctacaacgacaataaagtactcgggatcaaaatgctaaagaaaacgaaggtgatgactgcacacacaaaggcagttggaaccaacaagagttttacaagcacgactaattaaggagtacaggggaactgaaatcctactcttcaaaaaggggaagaacagactcccccagatcaccgacttcttccatcacgcccttacgcgcgtcattagcagccccctgatccaagataatctagaggtcaagttcagggtgcgccaaccttacgcattcgaggacgtggcacgccccggtgtagatcccgttggacgtctcctccccgatcctggccacatgcttggaggggatctcctccatcgccgtcaccagttccgcgagcgaagtcgtcagcgaaaactcatcgggattcaccgggatggtggtcgtaacaccgcactccccgacgagctggtgcaggccggtgtaggtaatccgcagggagccacggatctccgacaagttgttctcgagctccgacatgcagtgctcgagcccctgccgctgccgctcgttgccgaccaccagctctctcatcttctggaggtcctcacggacctccgccaggtcacgcgccagcttgtcggcgcgttcgttcaccgacgacgccgctgccgccttcgcctcctcaatctcgcgccctatgccgcgagcaccggcctggaggatgcgctccatctcgatttggagctccccccagatgaggatgtcagcgggcgggcctcgagcgggcacaaggccgcctgcagggccgctgggcgtcacctcacgactcttgggcacgaccatgacctttgtcgaagccgctgcaggagacgcactggagttctctccagacccgtcttgcgccgccttcgcccgtgccgccctgtgaaggattgccgtaattgccatcaagacgggctgccagagttcgatgaattaaaaaacctcaaatttgtctacttacttctcgccaagtgtcaccagcctctaccgtcgctgaggcgggggagacgcatccgaggcctgagtaaaacgagtacggtgtgaggacaatatcttccgactacacaataaatgaccaaaggtgcttaccgatggggtgggcgccttccgacggttcttcggaatgttgccgccactggtcatggcagcggcagcagcagtagcaacatcgaatgcctcctgggcgacgccctccttcaacgaagctgccgcctagtggtccacgagcagcccgaagatgtcagtcagagggagagcctacactacatgaagtcacaatgcgatcctagaagaaaaagataaaagggtcgtcaaatacactcacgttgattgcagtttcacgctcggctgtccctttctcgcaaagggggacatggacgttgctcgccgttgtggggccgctgatcatcacttgaccgacgcggctctccacggtttcgctgttcaaacctgtagatcgagaaccagaattcgataagtcaagaggaacatgcacataaggaatggaatccgaaatacaagaaaaataccccgaggagaaacccgggtcgcgtcctccggcctagaataatcaaaggctggatgggctcgagcctggagcggctggatccgcctaccaatgaagtcggcagtgacttcataccccgacaaccctcacactcggaggtcatcgatgatatcgatgaaggactgaagggagggggttaaggcgggtttgacggtccaagacgaaatcttgtctggttgttcctcagggacaacaaagactggatccgaattctctatctgaaaatagaaccacctcgcccgccatttgctatgagaaaaggggcactaaaaggggatgtatcgcgacttcaggccatcccgaagtcggaaaccgacacatccggacacctttttaggttccatccagcgcaactcgtagtagaaacgaaagagatcaagaaacggctctaccccaatgtaggcctcacaaagatgggaaaaaatactgaggaaggcgatggaattggggttcaaatggagcaaagaaagaccgtagaaattcaagacgagaagaagaaactcggaaggcggaggaagaaaaccacaaagaatatagtcctaaaccgcaaccatgcggcccaagacaggttcgggttcaaccatactaggacaggtatatacctcctagttctctctccatggtcccgcgaccggggagagcgtcgtcctcctgcagcttcttcagggacgcgccggtggaagtggacttgtcgagatccatagccgccggagatcgctgaagaagggactgagatgagcaagctagggtttttgcgggagcggagaagacgaggagcgcttggaggctggaaagtttttcacaacaggcggacttcaaaatggatcctcaaaactcccttaaatagacgcactaccgacagtatgaattccaaggaaaggagagagatggccgccggaaatttctagccccgttacgcgtggcagttttcggacttcaatttaaattcacttatgaccgttgaacttcgcacggggttgtcgattactccatgtctctacggttctcacaccgagatcgaccagtagagaacgacaataaccccgacatcagaagtcgcgatcggtcacatgagttcatttaagcagaagtcgggggctactgtcagggttacggataaggtataccctctacccttggatatacgtcatgtatcgatatggtatatctgcgtgtatacggacgttctctgtacacgctaaggaaattcatcacggagtccacagatgggaggattcctactcagatagaactgggtcatcactgtatcgtgtagggtccgatgtctccaagtcctacttggagaccaactgacctgcggtataaaagggatcccccgggaggacctaaggcatcgaatcctaccgccaacacatcgaccacagcctatgaaaccggagcctacaggagccaaatcgctgggtgatctagtcgaaccaactcgactacgatctcgtcggtatcatcaagttccactattccctttgtaatatgtgatttctgtcatataattccatatcaactggattagggctattaactactaaggggcctgaaccagtataatccctgtttttgttgcttgatgtcgtattacgtagattctcgtactagcgtaccttaataccctctatatccggtctacgggtatcccccgtcgacatggtgtatattatggaggcacctacaaatccctattttcttttgcaaaaatcgggcactgtttcaccaagtagatcggaattgtttcactaagtagatcgaaaatttttaatattttaaaaaaactgaaacacaaccaaatcaccttgtgaaacattttgctacaacgtacgaaacaatggttttcaaaaaaaatcgggcgttgtttcaccctatataaaaataatatttcagcaaatagtgaaagaatgtttccattcactgcaacatttgatctatacatagtgaaatattacgagtatacttgctgaaacattactagatgaacaaaaaataaaacggatttccttaatacaacgtttccgtaatatgcggatgatttgttgtaacggcgtgtgtggtggggtgcgcgtgtgtgtgtgggagggggggggacagcgcaaatgcgcgggcggcggcgggcgcccgatcgctgccgttttcagtatattatctcatattaggttaaatatatagtattatctaatttctacatgccatctaagatctgagagacagacttaattaaaattagaataatgcattaacaatgttagtgtatgtaccgagttgcgtccacttgtacgtgccaacccatcgtgtcttgcactttggaatgcaggaatttcacaggaaatagttcggttcgtccaaattaaatttccctgaaattaatttctccaatccgaatatatagggcctaattatatatgctgaacgagatgaaccggccggtaatggcgctggtcagcagtaacagattggtaagatctgttggaatgcgcagcccatcaatctctgcgatttttttttccttctccagcttctcacgtggccgatcgacgatgacgtacgcgtatacgcctgcatacaatgcatgacgagattttcaccagaaggagagcctagcttagctagcagctagatagctagattatcgatctactggagtagctaggacggcgacggccggccaccatgtgcgtacgtgcgttgtgtctcccgcggacagaccggtaaaaacgacggtagagtgagtgatgagtgatcgttgaggttgacgagccgagtggggtcgtaagtacattttacccactccaatcatttatttaagagtaaattttactttggaccatatttattgaccaaaattttacattgggttagggctagactcatgttttcgcttaacaccacgtataattaccgttctttgaactttggacctgattttatagttaccatcacacgagttgttatctaggtgcttagcattttacaagaaacaatgatatggaaatttttgccatgcaaatatgcttagcacaagaacaatgatgtaacatgttacaggatatcctatcagattaatgggacttcattactactacatatgaacattcacaacccttatactatagacaaaattggagaaatattgagtttaagaactatttttttagaaaagatattacatgttttacaaacccaactgtagtgttagtacaaattgttgaattctaagttttctaacacaaaaaagaaatgagatcagctctacgatcattatactatgtgtaatttgtgaaacccggtccaaagtgcaaatgatggtaactatatatggtgttaagtgaaaatataagtctaattctagtccaatgtgaaaatttggtaaataaaggttgaccaaagtgaaatttactctttatttaaagagagaatatcttatataccactagtctaatcccttttatgccattaaaaattagcttttcccctatataccattgttcaaaatttgcacatcctctcatgccactcccgtatgttgaccgttaactctaagtaaaaaagatacatttgcccttctgaatataggatatgtctaacaactcagaagggcaaatacgtttttcttacttgagagttaacggtcaacacacggaaatggcatgagaaggtgcgtaaattttcagtgacatataggagaagagctaatttttagtggcatccctaatcccaatatatcataaatcttttactcctaaactgtaggaaacagtacaacttagatcccatggcagtatatacccccattttctcctattttcgctaactaggaaggtagcccgcgcatacgcgcgggcatgcaccgtacgtaggataaatttgagaaacttataaaggcggtataccagcgaattaatatctgcaatgttttaaaattatgtttttttcccatgaattttcttcgttagaattgcatgacgaatttaattgttatttataaaattatctattggagattaggattggtatcttacggtataaaaaatggtacctaagacatatgactcttgaggttccacagggaaagagagaaaacttaagttataaaagacattacatatacaaccatatataattaatggctctacccattttttagaaaaaaatgataattaatttattatttgacggcaaacattgattggtcatagctatggataattcctcataggaaattgtgattccatagtgaaagagaaaaaacttaagttataaaagacattacatacacaaaccatatataattaatggctctactgatttatatagaaaaattggtaattaatttattaaacataatatatgaccctcgagtttagaccattatttgtaaccattggatatgtagaagatctaacatattgtgtagagtccaactaagcaaattattcgtcttccctcaccatggatggtagacatgttaattcgtgtctccggcagcatgctcacatcatcatacttagaagaaaaaaaagtgcccttcatgtatatacatgtaactacctcatgcccctcttttcattaaagaaaaaaagttctatacccatgcatgcacaccgggatgcaccggttagccctccaatttgttcactccatggacggtatgttcctttgttctagtgattagataatttaataagtacaaataagtatttgaaatcaatttttattagtaaaatatccataaggactgatctgtagacaccctctgttcttcttcttttcttggtgtattagttggatttaagcaacgtgatataggtattttgggatataagttaatgtccaacttccaaaggattaaggtttcccaaccctcagcaccgaacacagcataagatcgtacatttatccttaaaagaagatcatatattttatcagggcattggaattaagtaaatagcatccacatatatgtcgagagatataattaagttggttgtgagtcaataggtccattgatgctataattaaggttaaggttagcggtttataagttattttgattttattaaaaaactaagttggatattttgatttgtaatgagaacatttaggattttttgcgtatggatgtgggtccaaaatataataattttattagcaattaaatatggttggtatagatattaaactattgatttaattaaaaaaacacaatggaattaaatatggttggtatagatattaaactattgatttaattaaaaaaacacaatggttcaaacagatcataaattgaatatataatttaaaatttacagctattgaagattctttatttatttataaaacataccaagatcaatatgtatgagatatattatttatacctatatttgcaagtgtatgcaatctttgaaagtatgataaaattaacttactaatatagaagatattatatacccttaagccttaacttaattaccatcgaaaaaagggaggcgagcaaggaaaaaatcacacagactcttatcatgcgtatggatggaagcatgtatatgtgttgggcggactcgtaccgccagattgatattaagttttttactaaagataaatctaatggtatctgatggtaaaaaaaatattaggtccatcagattaaataaaaccaatggttagatgttctcctttttccatagattttctacgaattaattagagcgttaggtgtcatctttgcactgtttcttggaatctcacgtggcagtttaggagctttttaggatgtttaatggacttttatataatagatagatatatctacgtgggtttgtgaaatttactccataatatatatttccatttttaatattttgtttttatttggttgcattgcaaagaaaaatagtatatattcaaagttaggaaagcgtttttcttatataaagatttgataggttcaccggtttaaaccatctatatacctaaatctaatggttttaatgtttgtttatatttggttttcatgcaaagcacaacgttctatggtaaaatttagggaagtgtttcttttatatatagattaatgggttcaccggtttaaataatcgttaaaatatttttttagggacaatggttaaaatagttggttcaccgaaaggttagatgttttattataatattttttcatgttaaaattttcatctagaaataggaagagaaggattggaagaggggagaaagcatggcattgtattacgtacatacatacttactgaggagagaaggggtgggttgtgggatatttttttttataaagataaatataatagttgaaaatagtgagtctagcaatttattaaacaaatagcggatccaccgatttattagaacgccacgtagcggtttagaaacgttttgtaggatgccacatggtaatttaggagcgttcgtaggaagtttaatgaacttttagtatataatagaagatttttctttctaactaataaagcgtaaaaaatatgagaaggaagagttaatctaggaagagggtggtgtaataataataataatacatgaggtatattattattattttcatatatagtaggtagttgtatatgagatataagtacgtacgctgggtggggttaggtttgggtggttaactttttctataagataaatttaatggttgtaaataatgggtccatcaaatataatgaaatcaacggttatatattggagtggcatgtggcggcttaagagcgtttctaggatgccacgtggcgacttaggagtgttcatagaaagttttatggacttttagttaatatacagatctaataacgacgtaaaataatgtgtccatcgattctagtgaaaaccaatggttggacgtttctctaatttaagagtggcacacaacggttagaaacatttatatgatatttaatggattttaacgcgtttgatgtctatttgtgggggtattcttttctataaagataggttcaattttaattaggattggaaaaagaaaagaaaggaacaaacgaaaaaaaaaagtactaaacagaggtggtggggccggtgggaggtttttggtttttaaaatagatctaacgatgtaaaataatgggtccaccgatttaaatgaaaattgatggtcagatttctctattatattagagtgccacgtggcaatatgagagcgttttgagggagccacatggcagcttgagagcgtttatagggagtttaatggacttttagtatataatagatagatagatagatagataatagatagatgaggcatatgtacgggtccacttatcagcatgatgagtcaccaatgccattctggatgaacaacgcgtggacagcccagcgatcgaacggctccaggagcaacgtaacgagaatgcgagctcggctccaagcgcagaaacggggctcccgtaggcttaatttgaatcgcgtcggcttgcatcttcctcctctccggtgtatgcacagatacgcgatactggtatgacgatacagggatacggaaatttgcaaaatcatgaatttgtcgatacggtgagtatatatattttgcaaaaatagattatgttttagaaaaaaaaagtaagccatatagtcaatgttttagacaggtttcaaagaccaaacctttctatacttctcaaacatgaattctacagtagttgaaggatggagtatgctgccatggtaagcttggatcatttcatcataaaatcaccataagatctgaaaaaaataactgagtgaaagactaaaaaggtggacggcaacaatgctacagcagtaggcagctccaggccagtggctctcgagaagggactatatattaaaagaaaagagaaaatccatgaaatgccattgacaagcaccctaatcctaaaaatacatcgataaaggcaacttccaaaaatgccattacacaaccctctttctcctaaaaataccatcaccgtcaactccacaccgtcataaccgttatttttttaataataaccattttgcccacagtgcaaaatatacctagttttcactgtcaaagaaagaaaatgaaatttctaaccctaaccctactgctaccaatcccgatccctatccagcgctctccccagcgccgtctcggcgacggcggctcggcggcggtccccggcggtagccctggcaccgctatgccggcggtccacgggggcggcgcggcagggcgcggcgaggaggtccacggcagcggcagtgcggcagggcgcggcgaggaggtccacgatggcgtggcagtcacaggatgcggcgcgggggccgtagacgccggcgaggagagacttgcaggtgtcggcgaggaggtcgaggagaggcccgcagctgctgaggttgtcgtggaggaagatactgcagtcctagcaggtggcgcaactctctgatgttgatttttttcccttttgcttgatttcatttgaagactttgtgttacattatgtgaatcaaattcagttggtggctttgtagatggattgaactagggtgaaggggagcatgaacatgggttgtgatggtaagtactgggaaccctttgttttgtgaaaattcatgttgatcacaattggtactttgtgtgttgattgccctgatgttttagctcagattgatagcaaaaatttctgaaattattggtagtcctgggtgtggtggtctctctgctctgtctcggcactgaaatttgatttcagtgaatttaattatgtaatttgattgatagcaaaataatgatgttggtgaatttataagctaacagaaataaaaattgttctgagcaaacaatgcaaaatgatgttgtgtgagcaaatggttgcctaggggtaagattgtcttttcatgcaacttaacggaaagatgctaacaacagtttgacagtgatagcatttttgggagaaagaggcttgtacaatgacattttggtaagttgcctttgtcgatggcatttatgtgattagggtgcttgtcgatggcatttcatggattttctcattaaaaaaggccgcaagtttttaaggcaaaaactttcaaatctaactatatataattttaatttcattatatctatactataactataatataacttatatataagtattaaataatatatgcaactttatatctaacatatatagagattataatgtagttacagtatagttaaactgtagttacaatataactatagtgtaattatatcgtagttccactacaactatactatagttccactgaaaggttcttttttccaaaaaattgcgacagttagggcttgtttgatagagctccaactcctaaatttagctccaggagttgggtctggaatggagttatggagctgcctaaacctagcttcatctctctagtttattttgtgaaagagcgccatccagcttcgctcccatttttaagtggagctgaaactgtttggctgagctccagctccagaagagatggagctagagctggagctgtgccaaacagtgccaaacagaccctcctctcggggatgcaagcagcggctcctgcgttacaggctgtggtgggcttcctaacgagggtttggttgcgcaccatatcgaacgaagtatcaatgctgtatcgaggccgtatcgctaatttttttattttattttcgctaaagaattagcgatacttcatcgataccatatcaaatgcgtatcccgcatatcgccgtatcggagatatagctgaaaactgcagtatatgtgcatcatgcaccacagcggatatgatgcgtcgagcctcaggctacggtggacaggtctgccagctcttgcttttgggcgtgggtgtggcgcggtcgggggcgctggagtcagtggtgatggcggtgtaggcggaagaaaattgctccctccgttattgacgtttttaatttgatcaaagtcaaacttaaaacagtttgactatgtttatagatagatatagtaatatttataatattaaattagttttatcaaatcaataattgaatatattttcataataaatttgtcttgggttgaaaatattactttttttctataaaattagtcaaacttaaacttaaagtagtttgactttgagcaaagtcaaaacgtgctgtaacctgaaacgaaggaagtacataagtcctgcacttatccgaaggacttcgtccccttatgtgacacgtgtccactacaaatctcaaagcacactgaccctctcttccctctaatctaatacccattgctcttcctccgctcggtgagaagtacgaacttcagagccggccatggaaatttttttatttttagacatttttttaatttattaatagaccattctcaaaagtattttcagatctgaaccttttagccacaccagcttgcctggcgtggccaaacaacgctgtgataaaccttgagctccactcgatacgctcaatggtattgtttgccccgatcttttggtgagttgagataactacaatgacgacccgactacaatcgtactagacgttgcgttgcgccttagcgaccgatacacctcttcgtgggttgttgatcttaccagcgcaaatcaatcttattcctgcaagcaaatcaaagaatcaagcaagaacaagataaaagcaatctgaattgcaaataggaattaggtacaaatgataatttggggttccgaagacaagcacatgaacggtctagctgacacgtgcactgcaagcaagtagcaatggctaaactttaatcaaataaaacccaagaaaccctgaaaggtacctgtgctatttatggaggtgggagggtgacctagtggtccctagggtcgtgctccatgtggtcaaggcacacccccacatggccccacttgggccggagtcccaaataaagttagaagcccaaagacctatggcaggtgatgcagcacattgtttctttatttgtggattactgggatagaatttggaactgaggctggatccgttggaaagaggactccgaaagctttccatcaaatactcatcagccggaaatggaggtcgtatgcagatttggcggccatttaaagtcagcagtatagcaggtggccgaatcggattccagtactaggaggactatcttgatattttcttcatccatgatgtgagcaacggtatccataatagccatggtcacatcacgctgccacgccaaaaggttcagttttcaaaaatactttttggattggtctattaataaaattaaaaaaatcttagaaaaaaattcctggccatgctagcttgttaaaaaaatacgaaaaagtacgaattaacccccccgaactatcgcggtcgtccgaattaccccctgaaccacaaaactggatattcttcacccccaactatgcaaaccggacgaattacccccctcgacccaatccgcggtggttttggcctacgtggcatacacgtggcactccagtcagcattttattttattcttaatggtgggacccacatgtcagacccatttctctcttcccctatctctttatttctctctcttcgtcggtcacgacggtcagcggcagcggcgcgcacgccggcggccgacacgcatggcgcagcgcggggaagggcgatgggcggcggcacgggggcgggttggcggtcggcgcgcggggaggtggaggggatgggggagaggcgggcgccggcgagtcgacgagctcggccggctcaggtggcagcggcagcggcagcgacagcgtccgcggcgggacgtggagcaaggcagcggcggcgacctctttccccaccgtcaggctggcgcggagctcggacacgccggcactacggtggccgcccccttgcccccgcgccaccgtccaccgcagttgccgcactgccgtcaacgcgtagctgatgaccccgtccaccgtggtgttgtaccgtagcccatgcgcccacaggacctcgtgcgctgcctccaccgcagttgccgccgccgccgctgccgctgccccgccccgacctgacgagcgggaacggcctcgtcctcctcttctcccccactcctcctctcccctctcctccctcctgacggcggtggagggctcggccaacagggcaaggtggattaggggcgcaactgtgcggatctgacggcagtggggaggtgcggtggctgtcgcccgtgcggatccgacgacggccgtccccccgtgtggcgctggcggatctggtcgtgggaacggcctcctcctccgccgtcgctgcctccctcttccgcctctcttgctcctcctccgccgtcgctgccttcctctcccccatcccctccacctccccgcgtgccgcttgcgcgccaaccgccggcccgccccgcgccgccgcccatcgcccttccccgcgccgcgccatgcgtgccggccgccggccgtgcgcgcgctgccgctgaccgtcgtgaccgacgaagagagagagaaagagagagaggaagagaaaacgaagggtctgacatgtgggtctcaccattaaaaataaaataaaatactgactggattgccacctgcacgccacataggccaaaaccaccgcggattgggtcgagagggttaagtcgtccggtttgcatagttgggggtaaagaatgttcggatttgtggttcaggggagtaattcggacgaccgcgatagttcgcggggagggggggtaattcgtatttttttaaaaaaaaaacatacgtaggtatctgggtttcgtgttctgttattttctgttaattagtactctccccagtttttgcattagagtctgtttgagtcagctcacgacttgcaagatgtgcggtcctgatcagcgttgtggagtacttcgtcgtgttcgttcttctctctcgcgtcctagctcgttcagtttgcaggtttcgctacagtacaatggctactttcgctaacaatgcctctctcggcgagctgccgagctcgtacaccaggtacatgtacccgctcatggcgcagaagccgtacttggagcttgacgatgttcccgtagcggacgcgcgtcagcaccagctcgttcaattctccaagctcttctcactgatgtcccagcagtcgccggtttactacacgtcgagccgcggcttaacggcgatagagcgccatggtttggaattttcgaaatttcggcccccaacagcaaggtcaaaatcttcctgaaattttcggtgtttgccaaacatttgtaaatttggttaaaatttgtttaaattctgtcaaaatatgttaaaagttaaaaaaattcagccaaaaaaaatccaaaattactgaaattttggtgattttgggtttttggtccccactagtagaaacacaagtttcaaaatcgcaaaccctgtagagcgcccgtcgatcggccagtacgttcggcgttgtacacgctcacgaagctcccttgccgatgcagaacgcgtcgttgaagtgctccggccgtgccgccagaatgtcgcgcatataaggagaacgtcatgtccttgctccatatcgaaacctgcaccgccatcgagctcccgcgcgctcgccgacatgcgacatctccgccttttctaacgacgacgaccgacggctcgatcgcctcgcttaccggggcaccacggatgcaaaccatagagaccatgtggtagcatgcagcagctccaacactaccgctgggctgctgcacgcggctgtcagaaggggaaggagctcgcgaggaggcggtgtgtagggatgaaagcaagctgatcgatccgcaaacctagtttaaataaatggtaatccgcgggtttctacatcttgacccggcttgccacacttagagatgcaagtaggtcaatccataaatctatttatagttcaaattaataggtaacctgcgatcaaatacgcgggttacccactaattttgtttataagcgggttctattaatagtgaaatttggtaagccccgaagtcattatcggtctagagtcagtatcggcttcagagttctagaatcggccgatggaaattattaagtcgccaatagtcggattcttactgtattcagttaagtaaattaatccattaaagaaggttaagtaaattaaacaattaaaggaagtttatccagaaaagaccgagttcaaggaggatgcagcatggtagtttatctattaattaggaagagtttgttagtttcctttttatctttaggaaagtatgtttagtgtccgataagaactttatgtttttcttttatctttaggaaaatttctttcttacccaacaaagctattgtgttcgtcgacttagttcgcgccaacacagtttcggcacaatcagccgagcactgattgttcatcaacatattcgcaagttgatccgcttacaccaactgacaggttgaggcatgtgtggaggggcaggggttggtagggggcaaagaggctgtcagcgtcgacgaggacctcgctgctcctacccaacttgccgtggttaccaacgagatagagaagaagagatgagagagagagaggggggtagagaaggatgttaatgacgtgtgtgcctcatatcacgtgacgtaggtaccacgtcaatcaaatccagcctcaatagtgctttaggatttcttttccaccagcattgcgagttgagaggtgaagatttttcattgcggtttagggatgacaattaaactcagcggaaaaatgaggatggcaactagacttcctttccttctcttgttgctagacatgtatgtatgcttgtgaaggcagaccagagaaatggaggcccacacccgagattgatggtagcaggcctgaagagctggcgtggattctcgactattatatctcggcccattctatcttggaccagaagagaaataacagattgtgttgcaaaatt

SEQ ID NO: 29162 - DNA, 39983 bp, Oryza sativa
  unsure (1)..(39983): unsure at all n locations
ggtaactaagctgcttatatctttgccgacatctgcagctccctcactcgcatggccggttttgctggattatggcccgaaaatggtgcggaatttggcaatgttggtcggtacgattcataaggaccatggcatagtataacaaggttgtacacgcactaatgtactatgtacctatacatttgtgcagttaatatgtacaactcattgtaatgaagctgcaggatgcgcggtcccctgttacccgatctgaacaagacatccttatatatatagctgcaaatatgggtggtagtaataagtggtggatgaatcgcatttgggatagtcatctccatttagggctcaattggaaaaaaaaaagaggaattatgaaggatttgtatcctatggaacattttcctattgagttctttggaacaaaggattcaggcctacaaatttccattgaaaatcctatggaatattgcaagaaaacaagcataaggtgttagctcgtactttcctttttccgatacctctaaggctcctttggacgtatgaattgaaaatcatacgaataagaaaaacataagaatagaaagtcacgatatatgcaattcatagcattgaaaatacatggaatatgtcaaacaggttgtttggatactccacatgaaattcacattttaggaaaaattccctatgaaaattcttttttttttagaattacacagaacaacgcagacactcacaacgcacgtgcactcacccctatgaacgcacgcacgcaaaccctatccctataagcatcttcgaagactaggccggcaaattcttgagagattaatgaagtcaccataagcgcctcgctgtcgacgggtacatcgcctaccacttaaattataatgccgttaaaatcctggaaaattcactcccatggggagtcgaacccaggacctcagatgctactgaggctcatgtaaccactacgttataggccctttcgccctatgaaaattctattgttccaacaaggagccctaagtacctatgctttttgcgtgtgtcatccaaacgacggttttataactaacctgtgttcctatttgctgcaggaattgaataatgggcatgtcatcctattaaattttccccaatattatggaattaacaatgacatttaggttcacgtacgttgtataggaaaactagatggaacgcgattccctcacgctgggtcacggtacgtattaaatagggtagaaacagcctctaccgtgacgattacaaagggataacaacatatggttacaagagataaggataaaaagataacaacagaaacaggataactaaacttatctatatttcaacaccccacctcaatcacaacttagcccaagttgagattgtgtctaaactgtgctaaactcggcgccggcagggatttagtgaaaccatcagctagcttatctgttgtagatataaatcgtatatcaagtagcttcttcgcaacttgctctctcacaaaatgataataaatctcaatgtgctttgtccttgcatgaaagactggattagctgataaataagtagctcccaaattatcacaccacaattgtgctaccgaaggtcttgcaattctcaattcatccaaaattttccttaaccacataacttctgccgtagcattagctaaggctttatactctgcttcagtactagatctagaaaccgtagcctgttttctagcactccaagaaattaagttaggacccaagaaaactgcaaaacctcctgtagatcttctatcatcagaacaaccagcccagtcagcatcagaaaaagcactaataagcatagaatcagacttaccaaatctaagtccaaattccacagtcccttttatataccttaaaattcgttttactgctgaccaatgcactgtagtaggactatgtagaaattgacagaccttgtttactgagaatgataagtctggtctagtcagagtgagatactgcaaagcccctacaatgcttctataatgactagcatcattttgtcccaagaaatctccatcttcaatagacaatttttcagtagtagataaaggtgtactagctggtttgcaaatagacattccagctctcttgagaatatcagaagcgtacctggcttgtgatagcacaagtccctgactcactttcttgacctcaattccaagaaagtagtgtagatctccaagatctttcaatgcaaaatccttctccaagtccttaagtaaggctgcaacagcttctgaagaagaactggcaacaatgatatcatcaacatacacaagaataaatatagtgcaaccacccttgttataaaagaacaaggaggtgtcagcctttgaagaaataaatccaagttcttgcaatttcgtacttaagcgagagtaccatgcccttggtgcctgtttcaagccatacaaggctttgtctaacttacacaaataattaggctggcctttgttctcaaaacctggaggttgtctcatatatacttcctcttctaaatatccatgcagaaagccattttgaacatcaagttgtctcaaactccaaccttttgagactgcaatagacagaattaggcgaaccgttgcagctttaacaactggactaaaagtgtcctcataatcaataccatacctctgcttgaacccttttgcaactaatctagccttatacatgtctattgacccatcagcttttcttttaatcttatacacccacttgcaatctattatatttttaccttgggttggtggaactagatgccaagttttattactcataagagcatagtattcttgttccatggcaagcctccaattactatttgccatagcctctcggagattttctggctcaccagtagttgtaagacatccatacctaacagtcccatctgtataccgcttgggtttagaaatacctttctgtagtctcgtgactggtctcgtctgatcacttgcctgtgttgtctgctgctccggttcagacagctctgacgctgctgatgatagcaatgtgacttggtcagcatgtgtgccatgcactgctccaccactcggtgcactagtactaggtgatgaagagattggtgcagcatcactgtctgactgcagctctactgacacgtcacgtagcactggtgaaccatcatcatttcctgcgccagctgcaccaatagaaaactgagactgcacaggaccatgcataaaatcatgtggcataaaatcatgcgtttcctccagtaaaatgctttcttctctgctggcgctacccggcgacccggtttctgcttcgctgcttccagtagctgaaccaccaatctgagcaactcctgttcttaaagaattctcaccaatttgattagaaaaattaggaggacaattaaccaacggttggtgcactatttcacccccatgatcagattgagtggtaggagagaaactatcgggaagaaggaggagttcaatacgaagcctagtgccagcattcggatgaagagtagcgaatggatacacagtttcatcgaacacaacatcgcgagagatataaacccgaccggaagcaacatccaagcatttaaaccccttatgaaggaggctatatccaaggaaaacacactgtttagatcgaaaggatagcttatgagcttgataaggacgaagattcggccagcaagcgcaaccaaaggtgcgaagggcagagtaatcaggtttgatgccaaagagatgttctaaaggtgtctcaaagttgattacccggctaggaactcggttaatgagataggcagctgtaacaaaggcttcatcccaaaacttgaggggcattgaggcatgggataggagagttaggcctatttcaatgatatgccggtgtttccgttcagctgagccgttctgttggtgtgtgtgtgggcaagagacaagatgtgctatgccaatctgagaaaagaagctattgagtctttgatattcaccaccccaatcggtttgcatagctttgattttagtattaaatgaatgttcaacaagggtctgaaattcacgaaatttggagaaaacttcagacttgtgtttgagcaaatagacccatgtaaacttactaaaatcatcaatgaaacttacataatagttcttattgcccacagaggagggagctggtccccaaacatccaaaaaaactagctctaaaggagctttagacacactaacagacttaggaaaaggtaattgatgacttttaccctgctaacaagcattacaaacttgattctgagtactctcagaagacacgggtaatttatttgagctaaggactcgatcaatgatagctgacgatgggtggccaagccaattatgccacaacgtcggggaaaccttgaaagcgccaaggacttgctgagcttgtttattgtgaagcgtagatgacggaagtgggcataggccggctctacatctgccgcggagcagcgacatctttgttgcctgatccttgatcaaaaagaaggtaggatgaagttcaatgaaggcatggttgtcaagcatcaagcgataggcagaaattagattttcctttgtattaggaacatgaagaacattattcaaataaagcttgcgagtgggagtgtgaataatggtgcgactaacatggttaatgtccatacctgagccgcttgtcgtgtgcacttgatcgttgccggcatatttgtccttcaccgtcagcttgtaaagttcactggtaatgtggtcagtggcacctgagttgatgtaccagtttgtgtcaaccccgtaggacaaggctgcgacattggcactcttgtcttccccagtgaaagaggcatcaaacctcttccagcttttgtgcacggtgtggccgatcttgctgcagagttggcatgtcggacgattgttgttgttgaaggagccaccgtcacctctgccactgccgcggccaccaccgccacggccgaaaccaccgcgaccaccgcggttggcatctccattgcgttcgccgcctctgccgccgccgccgcaccctcctcgcgacacagcattggcggaggactgagagcctccttgaaggagaccaagacgctgctcgaaactcagcagttgcgcatagacttcaccaaaggaaacagactcagtgcgtcccgtaatcgaggacacaacaggattataatcaaaatccaaatcagcaaggatatgggagatcagatcatcatcatcaagggcttttccagcagatgccatctcgtctgcaagccctttcatctttccaacatactcggcaatactatggttacctttcatagtagatgacagagccatgcgcgtgttgatgatacgtgcacgggactgcgagttgaagatctcctcgatggcatcccaaacgtctgctgcgttggtgaaggttgccacctgagcgaggatatcccttgacagagacgtcaacaagtagctgagaacttgttgttcttgcgcctgccattggagaagcgccggatttgccaccttctcggtggtctccttcccgccttgtccttcgtggcaaggatgattattgctggtggtggttggatcgagcgatccaggaaccccgccatctgcgctcctcgcagggtggcgagaacttgcgccttccaaagaacatggttggccttggtcagcttctcagtcaccgcctgaccatggagagagggagccgccaaggacgacgtcgccatggcgagatgagctagattgatctggagggagagggctctgataccatataagaaaactagatggaacgcgattccctcacgctgggtcgcggtacgtgttaaatagggtagaaacagcctctaccttggcgattacaaagggataacaacatatagttacaagagataaggataaagagataacaacagaaacatgataactaaacttatctatatttcaacacgttagtgcacaacaggttttaaatttgacaattaaattacattttatgatttttaagggccaagttagtaatgcacaacaagatatagagaccaggtaaaataatacctttctcaaaaaaataaaaaaagttagtaatgcatttgggagtaaatgatttttcgggaataaaagtatcatcatatatattttaggtaatccgttgtgaaacaaaccacaccatcacaaggcacactacccacttattctatcttactataaagttgatgtccactaagggtgtgtttagtccacgtcaaaattagaagtttgattgaaattggaacgatgtgacggaaaagttgaaagtttgtgtgtgtaggaaagttttgatatgatgaaaaagttggaagtttgaagaaaaaattaggaactaaaccagacctaactactaaagctcaacatgcaagtgtgtcacgtcatcaccaactagcaattattttctagagtattttaattcacatacaagtatgccacatcattacccactagcaattattatctagaatattttaaatatcatgcgagcatgacatataatttacaattttgttatattttgagaacttaatatgcaagcaatgtcaaaccattatctctacgtcattttcatattatttaaacatatatatctaccatttctataattaatatgtattcatccaaatatcccgcagcaaagcacgggatatcaactagtactaatgaaagctagatgaatacatttgactaaaacaatgtatttacgtgggttttacttttaacacaagaaaaataagaattccaattgtgtgattcaacttttaactcagtaatcaacttccaataaatgattttgacttttcaacaaagaaaaagaaagaatttcaattcaaagatatgtaacaagctatggtcgtggcaacaagccaattaattgcttctaggagcaagctcgctattgtacaggatcgaccagatgttattttgatttgatcttttattttgagtaatctattttttctattgattcagttggtatctgatgaaaattttctgctccaaatttgaaatttttactcctcaaaaccgtctagagtgaagtgcactgctaagttgtttttcttcttaaagtcacttttttggaaaattcttggtgtatatatttgttaactaaccatatgaaggtcaaaagatgataccgggttaggtatagaattttcgctgtttggcgaacacctctatgttagagcagctataaccagtttcaggggaagaccttgcgttgcgttgtggcaaatggcaagccgccataccttagtttctagcatggacaaccctgaacagtgacgacggagccaaggaggaagagagctccgctgtaaaactatcatttgactgccctgactacgagtataggacgtaggcatgtactagtgcattgcagttgccagtttagggccttttaactgactaggtagtctctgacgttaagccacaacgatcagtttccttccatttttctttggttctgaactttatggttaaactactagtctatttaatatgtacaagctaatatactaattaagtgctgttgactacatatgctgggtttctatttgaggatttgagcaaaagtatcattactgattttgagacagtagcagcaaactttttgagaatatattgagtgaatttcattttggacccctttttattaccctagttgcacaatggacaagggatttaacaaaattttcacttaacaccagctagacttgccaaaaacatagcagtagtttggaccagggtattgctctagctgctacggtgctagtgctaccatggctatttctataatccatgggaggaaacatttgcttaagttagggacggaggcatcgattgtttcgctttagttgcagttgcctgaaccatggctatttggctattaataatcatgtcatctgtttgtctatagttgggctggtgtgcgaggatcaaatcagagtagcacatcagattgcaggccaccgtcggtgagcttgagatcgagcatcaccatcctcccattccgtgcttgagaagttgagattgagacctgtacgtgtcggcccacacttgaacccaagcaccgtcgggcgctgactatctcagcctgaagaccaaccctttgcgttgcctccctctctgctgactatctcggcctaaagacccgccttttgcgttgcctccctactcgagctccatcaccagcacctctagtgctgttggctgttcgctcgagctcgagctccttcaatgctgtcgatccatgctcgctgctcctccctccatcgatgctgtcgatccatgctctgctggtcctccctccagattcgatgaccgtgaccggagttccgcgctgcttccgtactctttcctctaagattgggccgccggagttctggacgagacaatcgcccccctactcctgctccactttagatcatgtcacgggagcggtcaccacctcctctgacagcgaggcagatagggggagggacacttgcattggagatgggctgccggacttggagaagatgagggggtggtctagagtgaaaccaatggtagaaatatgtggtccaaagtaaaaaccattgctaggacctagtccaaattgcaacaatggtaaaaatatgtggtccaaactataatttactcgaatatattggaaaattaaaacattggtccagtggctcgccttcaacctccacctataatgatatattccaacaataccacttctctagttctcctaactagaaatcagtcatttctatcattttacttcataattggatagttagatgtgcgcattgcccctttttacatatacattatacattaatgttttttcatgtcattaatttttagatacatgtcacagtattggtgtattacgaatcggtatttgtgtctaataagttcacccacctataattttgtgctgggtcagccactgaccagttctattaactacttttcttataactcttgtagaacatgcagttgttattagccaagccaacagcatgtggtttgggaaaccaaacatggcatacccaacaactactctagactcatggatatgcatcatatgcaattaggatgttgtgcaaacatgcatgtgcctaacccctctctatcgatatcatcttttaactagaaatatgttttaaaaaaactctaaaaattaaagctgcagagtagaggcaagaaaaaaaaactaagtagttgtaaattttagatcactttcgtattaaatgtattttgttatgtattttcatgcttaagatgaaagtataaatctagtgtacatcctggcactacaacaaaaccactgttttaagacgtttcacttaagttattctattagtaaaattaaaatagggacgatgtttgagacgctttattagttgaggacatagtttaagacgctttacaggttagcataaaattaaatcgtttagagaggaatattgagacgttttgaaacgtctcgtgtgtagaaatgagttttgagacgtttttattatatccgtgtcatcattattagataatatataattatttatatagagaaagaagaaaataaacacattgttactaatcgtcatcatcaaataccattataaaaaattagagtatctgctacaggacgcttgtttgcagagttgcaatataaaaaaaactatttatttaccttcaagattgttcacgttaatgacttggttagtgcatgaactttgcaacctgcaggtgctgtgttcgagcccagatgaaagcattaatatcaaatatattaagatgtgcgtggctatataaaagcgtctctatattttgtagagatgcaatttatacgtctctagcaacgtcttaaataatataggtacgctttaaaaagcgtctccataattttgagatggtgtaaacagagacgatcctacgatgctttataaaagcgtctcagttatctgtgggagacgaaataaaatgtctctatcttacaaataaaatgtctccgttgggttgttttgttgtagtgtgggaactagattcacataagtatgagttaagaatatttgagatgttgtacatctttagccatttttgtcaaatctcctgaatgtgtaatatatctggtcgtcgccatcgagtggtttgacggccacatctcaggctaaagttgactggcagcctaaaggcccagcaaagtctccaatattcttctctcgaaacgtcggatatttcattatgtttgtttgatgacttgaattattcacttcatccctcaaatataatggaaggtcaatataaattaaattataaaattaaaattttaccagaataaatttcattatataaaaataaaaaaaattggttggggcttataaactgaatgtacacctatggaaaaattagaacgagactcaacgttctaaactaaagaatttagataaagttgaaaagaacaaagaaaacaattgaacaaacctttcgtcgtttttaactaaatactcactccatttttatgttacttctcattttaactttgtcctaagtcaaatattttctagatttgactatcaatttattaaaattcatatagtttaacaacatactccctccgttcaaaaaaaaaagacaaccctcctaggaggggacgaatggagtatttgtattttctaagtcttgcaaatgaagttaagtttggtcttttttttcataagggttttttttttgaactcaggattttggggtgctactcagatcactgcaaccacaacactaaatgccctttcacagttaagtttggtctagaaaataatgttgcatgagtaaatattatgtctagaaattgaagattttctttcccaaattgtttcttttccctcaaacaatatttcattgggttcatacttcggttaactaaactatgacttatcattggacagcatgtttggctaccaagaacataatttggattggtggttgttggtatttcttacgaccacagataaatccgcaagcgcacggaatatcgctgtaacacttcaccttcgggtgaccccaaaaggatatcgaactcagggaacgtgtgtaatctacctaaggctaagacaatccaaggacaacaattataggtaggctaggtaggctagagaggactttctatgtgttttaattatctatgctaagcaaggtaattccctatctgttgctttggacaccgacccctgctggtctgccagcgtggttccggctatagctctatgatgtatccgaacgtggaggattactaggacgggattcagggctgtcaccacctgccgcctacctctgacaaatccgtcggatatacaacaaacaaaggtaatctctaacctagacaccacgtctaagttattaattactactctaatacttgtacaggaacttccttctctatccagagtcctagtactagagcacttaatacgaatactaaacaatgaacccgcaaagatggaaatatatcttactcagactaagtaattaaataacataagaaaggaatatgaatgcttactttatagaagaagttctctgaacccggagcagagtgtaccgacagctccggtactcctccagaattcctcctaggaagctacactcgtcgagaaagaagtcggatgagcgtcaaacttccgggcactcctccagagcttcccctcactctctacctatttctaatgtacaaatgatacaatagagcctcttataattcaactcaaagttgtgtgtgttggaatgagagtgaagacctccatatataggctccaaatgacggttaggggtatgggaaatgaccaaaacaccctgcaaccgccataggggaggaatccaagctgtccacgttaagccagatggcgggaggcgctaggattggttcggccgaaccaaaaatccctcctcccagcctttcctttgcccggtatgtagcttattgggcccccaacatcttgcacaatgttttggcccaattctaagtggttttggttgacatatggtcctccaatccgtgtaaacgcgtcctgaatgcgcagagatgcattttgtcacatgacggatgtgttttctcctcaaaatacctgcatacacatatttcaccaacactagtggaaatgattagtaacaaaccctaccactaagttggataccatattttatttcattatatgcaagtattgacggtcaaatattatgatttaaggaccgtcaacagtggttatcggtgacaccatgttaacgaccaaatttggtaagatgtgaacgaggttcaacattaggatcgaggcggattcgatgaagagatcgattcgaagaacagagtatgcatcggctgtgaaggtatcagctggagtgtacatcagctgggatggatcgaacagaggatagccgatacagccgattacgatgaagacagtttcgaggcttcttttagaatcgttcaaagtgcttcacagggattgccatgatagagataaagctctcagtttgggcaattgtatctattaattaggatattttatgtaatttctttagagatatgttttggcaaaagtttgctgcaaagacttatggtatcttagagtttgttagagataagtgtcgtgtccggcaaggacatattttgtatctcgggtataaatagagcccgaactcatgtaatcaaacaacagacgttcaatacaatctcagcgcatcgccacccttttactttcgtttactttcgacaagttcttactttcgggttgagctgcatcggtttcgattttcaactagaggtaaagcttgttatggcggcttgtgttctcgggattagtgcttccatctttatgatactcttatcttgtttatgtaattcgtcaagttatcatatattctatataatctttgacaatatcgttatttaaccttcaatcggccagcatctatcatcagaaggcaaccgattaggttaattaccaatgctgatttagattatataggatatccaccaccctatgaaatattcaacggcttgattgtctagatattgtccttcttttcatacttatagctgcatcagttgagtttgaccttataagtcgtgattagaatctaaatctctagcctgcttttggttgctgattagggtttcatcggggtttcagccgatcttacctgatttaactattttatatctcatatgcttgattgatataattaaatctgccctttatgttaagattttgttgcgtttaggtatattaagcttcccgtttgatatatttttgcttgctttaatatctcaatatagagtgatatcggagtactagccgatacatgctagatctgtctgatcggctatgctatgaatgcttataatcttcttgttaatatatattttgatctaagtaatttatactaaaaaacgacatggcgaccgatctatcccaatcacttgatttaagtatatatcgacgaaagcattatataccattgatatctacaaccgattgaatagatttagttctttcttgcctatttatgactgtcgatcgactcaaacatgacatcagctcaaagataaatgatacgtcattggggactggccgatcggctatcgtttatagatttaaccgctattttcctgtctttatttcttgttgattgcaggatcaaatcaactggcacgctcacaaacctaaaggcaagattttttggacctgcgctggagttaagcagatctcccaggcctcgtgtttttcgcatcaacacaccaacaatttacagattgctgtgtaggatcgaatcacaacaactaagccaaccagagggggggtcaatggttggtatacccaaaaaccgaaacttttagcggaaataaaagttaccctcaaattcgacggatcgcggcctaaccgaagtgtatgcgccagtctgaccgcctgatgaacgtcggtctgaccgagattaaactccgatcgaaccgccgagatcgcctgccgctccctgtcgccaccgccggtctgaccgccgtgtgcccaccggtcggaccgccgcgatgccgccagtctgaccactagtgcgccgccggttagaccgtcgaaacccgatgaaacacaaatcgaagaactcttaaaatagatgacgactttattgattctctctgtgtttacaaagtgcaccaacaacactccttacaaaaatttcgactaaactcgaaaccctaactcaactatcaactcaattgctctcaaaagcgataccgggaagtctcacgctccctctctatttatacccaaggtaggcagcctaaagccacgaaccaaactcatactagaactcctaatcaccctaggaaaccctctagtaccagaaacaaactttacataaccaatcataccaaatttggactccttccaaattcaactccacatcacatacgcacacaatacctccatcgtatgccatatggaatcttcaccaaccacgtgtattaaactctagccttagtatcccgcatgatctctgaccatcatggacgtcgtcttatccccaagccgacttccggtccatcaccgcaaaaactctcccggtatctcgagtcacctacacatagaacaaacaaagaaaccatattccgagaccaagctatccccaaattgactcattgttagcaaacaacagtattacatacgcatagtatccatctagaagccataattatgaaacaattacggatatccaaacaaacaacccaaaaccgaaaccgacacagagtcggcatgtcagaccgcgggttgtaccggtctgaccgcgtgatacacgccggtctgaccggcagcacatgtccggtctgaccggtccaacaaacagttgtacctgtagatcacctgtgaaatccaatcatatccaaaaccacttcgcaaataaattctaaataacaaaaccaataatctccaatgctaattgttcatcacagaataataataacacttttgattttacatgctgctctggtagagaggttcgatcagctagtcgagtgcaagcttccttttgttcagctgtcgcgtttctaccttctttcttcttttttatgctttctctcgggtatctcgttcctgttatcgttgacaggcattttcaagctttattgtccaccatgttcgaggatcaaggttccattccttacttttctgcaagtagctggttagcatagcttggttaatcgctctggcaaacactaacttaatacttcgttcgttctccaataattgacaatgatactatttaagtttaagctttaatctcttgtctttttcttgaaaatttatagaacttgaaaatatgttatattggtaaaatgtgcaacgccataaatattactattatacaactatcatcatcataatataattatctaaatatttttgtcaaagtgaggaggtggacgtagtcaacagcgtcaattattcgataacggtgaagtactgtcaaaaaaacacaccaccttaatattataaaattggaagtctatttcacctcaattgttaattaaaactatacaacgcaagggtttgagccaattttacattggtcactcagttttcaaaaaaaaaaaaaaaaacattggtcactccatcactgtagagagatgtacaaagaatgaaccgtacgtgtactacagtagggttatgtggcgaccgaatggtgcattagagagcggtgaatcttagaacatcaaccatttgcgtgatgatactttataaccagtggactccactgtatctctacgtgactacgtgggtcaaaccatttcctctaaaatatgtacctgtggtctttaaggccttgtaatcatttaatttagtttgttgcttatatgatgatttattttgggtctgcacccatctcaccgtctcaattcattcttctcttatccttactcaagtttgtaacaaatgttccatctgtaccatttatatacaatttgacttcaacctcaacttgttttgggataaaaagaaacacattattttactttcataaaactcacacagtaaagcctggcctcaatacaatcatttgtactattcattatacttatattatttaccatatttctttcgatagttactctcaatgtgtatgcccgcatacgggtgagagagggtgagcacccccccaaaaaaaaagttaggtgcctattttttaaagaaaaaaaatcaagatataacatgttttaggactttctcttattttcagccataagttttatattttctccaattctcctcctattatttagttggaatgagcttgtttttgtctgctccaattgtttgattataattatggtcatatttaaaaaactgtacctcaatttagatctgatttgttatgtactttggttaatattgatagtctaaagtgaaattcattcttctctctctttttattttctaaaaatgtgaggcctcactatttttttagcacatattaggtgggctctgtgtattaggtttgagttttaaatttatacctacagatgaaaattaaagggtacatcataaaattttcccggacttctttaatgctgatttggtccctaaaacagcaggactgcacgtgtaaggaggatttgacgtacgtaacgcgtcgccgatacagaggtagtatggtacttgtatatgtagcgttttgtttctagttaggtgagaatccactataggatatactactatgccaaaataaaataaaaaaaaagctctaactacgaatcaagacatatatatatatatacagcagttcaagtttttagttataattgaattttttttaacagagagggtatatcattatgtagttaattatgttgttagttggtatatattactaatacttcctctgggagtactttctctgtcccacttttaagtctagtcgtggatttttgtgttcaatatttaaccgtccgtcttatttgaaatatttataaaaaaaattaaaaaatagtcacatataaaataatatttatattttatcatctaataacaataaaaaatactaatcatattttttaaaataaaatggacgatcaaacatatggcacaaacaacgtaaaactgtattcattttgggacagagtagtatatacagtgtataaaacgcgttagcaacactggtcattaggcttgacttcctccgagatcgatccatatatttattcctccataattaatccataacatatccggtcttacttggcagcacatgtgcatgtgtttacttttttttatgagttggcagcagtctgttattttttttccccttctgcgtaatgcttatagacatgagtatgagctgggcttggaccgggccgggccaggccggtctagggtgacaaaaatcccagtgaagcctatcggaccgatgacttttatatgagaaaaacaacaaaaataaatatattataagtagcggttggttttattcggtttgatttggtgctgcatgcttagccagtgttcgataggaaagtaactcattaatgcatgattaagtaattattagcttaaaaactttaaaaataatgtaacatgatttttttaaagtattttttatttttaattttgcaaaaacacaacatttagaaagtaagaaagcgtgcatgtaaaaaacgaagtagtagaagttatattatttatccattcttctaagatataatttgtcaaaaaactttctttgactatattttacttacttagatcacttattataaattactcccttcatcccaaaatataaccattttagcatagtgacaagtcaaacaattttaactttaactattaatagaaaaaattttaaaagatcaatcatgtaaaattgatgttactagatttattattaaaaaaaactatcataatatgcaaccctttttatttaaaacatcttacttttatatagatattattggttaaagttgcatctcagagaccatgtcagagtccaaaaatgcttatattttgagatagagggagtaacattattatgtttataacatataatatttattctctataatcaagtggatagttcatcaacttttatcctcaaataattaaaaatagtgatactttaatttagtgctgccacaaagcaaagaaccggaaaataacattagactttgttccgcactacactttcttaacttctactctctcatttttccatgtgtacacttttcaaaccactaaatggtgcgtttttcataaagtttttctatagaaaagttatttttgaaatttatcttaatttattttttattttatctaataattaattaatcatccactaatttactactctattttgcgtgctgtttaccaaccccaaatgaactcatctttaggttctcattgatgtaagtggcacatgccacatattttagctagtctacacattatgctatacgagattatctaattcaataataaatgcgatgacaccgtgtagagattctctttatgttttttttgttgttttcctaataatgaaaaaaatagagcatgttcacttgtgcactcatttttgcttttgtgaaaaaaaaaggatgtttgtggtcgacataattatatgttgtgtctttcagatagatagtgagtttgtttctcttgttgtttacgttctctcatacggtacacaaggagaacaaagttacaatcatatccacaaaaggatgatgacgcatcatttcccccgttgttatttagtgtagaaacatggttgcgtacactgttttgggtatagagggttggattttaatccattttctaaataaatatttttatgagtccttttggaacatagcattaagtatttattaaacgatttggttcaaaatagaataaaaatactagttggtccaaaataaaagattcattgaaacaagtatttttaaaaatacactcatgtcctatttggggtgaatatgactaaaatacttgtagctggttgtcagtataagcccattatttatacatagaaagtacttgctaaaattaattttagggtaacattcgatataaaccctctattataaaaatggatagataagatcaaatatagtcactaactcgcattaatagtaccggtagcattatcaacaatatccatccaaaacatgaaaggaggatagtgatatagttcttcctatttggtttcctacccagcaaaaacggaagcagatcctctgacttaactgcacatgcagttgaggcactgacatgtgggtcccactttactatggcccacatgtcagtgactcaaccgcacagtagttaaatcagaggaaccctttccagcaaaaacatactcactcccccatcagcaccacaccactgctcaaactactccacttgctcctgcacactggccagccatacttgtgcagttgtgcccacaaaaaaaaaccctttgcaacactgctccactccatcactagtgctgcaccaccaccatcatcataaccaccaaacccccatatttcctagatccacattcaatcctttccccagcatttcctcccttttgttttttgatgcaaattcccctccttttcttttaaaccaaaatccctcttctcttttcttttttaagcaaaatccacctcctcttttttttaagcatcataaccaccaaacccatatttcctatatccacattcaatccttcccccagcatttcctcccttttgttttggatgcaaattcccctcctctttttttttaaaaaaaaagaaaagcaaaatccctctcctcttttcttttttaagcaaaatctccctcctctttttattttatatttgaaacaaaatccctctcctcctccccaatttactcccctatttactccctccacctccctccatttatgacttttcttccctccacctcctcctcctcctctcttctcccctttcacactctagccatactctctccaccgcattagctcgccattgccaaccagaggagagagagaggtggtgggcagcggccacttgcctcttccgagctgtctcccatgacaccaccgccgccgccggtgtcgcttgctccgtgccaacaaccggtcgagcagctggtgggtggttcttgctagcacgcgcggcgcgagcgccaagatctcaccgtacgcgtgcagcgccgcggcgggcggccatgggtgctcgggtggtgctgttcttggccgtggccgtggtggcggcggtggcgcaggagccgaacacggacgcctacttcgtgtcgaggttcttcgccaagatggggcgggcggcgccggcgtcgggcgcggcggtgtgcgggtggcccggggtggcgtgcgacggcgaggggcgggtggtggagttctcggccgccgggatggggctggagggcgccgtcccggaggacaccgtcgggaagctggcgcggctgcggtcgcttgacctcagcggcaaccgcctcgccgcgctccccaacgacctgtgggaggtgggcgcctcgctgctggagctcaacctctcccgcaacgccatccgcggggacctcccgaacaacatcgtcaacttcgccgccctccaggtgctcgacgtctcccacaacgccttctccggcgcgctgcccccggcgctcggctccatcgccgcgctccgggtgctcgacgccagccacaacctgttccagggccagctcctcggcaccgtcatctctggctggaccaacctctcctccatggatctctccggcaatgcgctggacggcgacttgccggacctctcgccgctactgtcactgtcctacctcaacctgtccgggaacaggctccggggctccgtcatcggagcgttccatgagcagatgaaggtgatagacctcagcaacaacagcttctcggggctaaactttagcagtggatatgcaggctcatctttggcatacctcgatttatcaggcaatgagcttaccggggaattcagtgttggcaacaggtttcagaacctgaagcatttgaatcttgcattcaaccagttgtccgtggcaaatttgctggtgtccatgggtgagatctctggattggagtttgtcaatttgtcgagcaccgggttgcatgggcaaattcctagggagttgtcttcccaattgtctagattgaaggtgctcgatttgtcgcggaacaatatcagtggagtagtgccagacttgagctcgattcgcctgcaggtgctggacttgtcggtgaacaacctcactggggagatccctgtggcattagtgaagaagttggtgtccatggagcggttcaacttctcatacaacaacctcaccgtttgcgcctccgagctctctcccgaggcgtttgccgctgcctttgctaggtccaggaatgattgtccgattgccgtgaatcctgaccgtatccagagaagtgggggcaaacgcaaggggatgaagttggcgttggccattgtgctttcgctcttcttctcggttcttggtctgctctgcgtggcagttgcatgtcggcggcggaggaagaggggtgatgtgctgcctgctgtcaagcaggtgtcattcaaggaggaaccagggatttcaggcccatttgcattccagaccgactcgacaacatgggttgccgatgtgaaggtcgcaacatctgtcccagttgtcatctttgagaagcccttgctgagtttcactttcgccgatctcttggcggcgacgtcaaattttgataggggaactctgctggcagaggggagatttgggccggtgtacaggggatttctccctggtggaattcaggttgctgtgaaggtgttggtccatggttcggcaatggctgaccaagatgctgcaagagagcttgagcggctgggacggatcaaacatcctaatttggttcctttgactggttactgcttagcaggggagcagagaatcgccatctacgagtacatggagaacggcaatctgcacaacctacttcatgacttgcctctaggagtccagaccactgaggattggagcactgacacatgggaagacaacaatggcggtgttgccaccgaaaacatcacaccagagggtaccgcgacatggatgttccggcacaagattgcattaggcgccgcgagggcactggcattcctgcaccatggctgcatccctcagatcgtccaccgtgacgtgaaggcgagcagcatctacttcgactgtgggatggagcctaggctgtctgacttcgggctgtcaatgatcgccgggaccagcacggacaacaacctgctgcaccattccccgggctacgccccaccggagttctccgactcggagaacgccatggcgacagcaaagtccgatgtctacagcttcggcgtcgtgctgttcgagctgatcactggcaagaagccactgggggacgactaccccggccagaaggaagccagcctggtgaactgggctagggcgatggtgaaggcaaacctcgggccgggcatcatcgacccaaagatccgcgacaccgggctggagaggcagatggaggaggccctgaggatcgcctacctctgcaccgccgagctcccctccaagaggccggccatgcagcagatcgttggcctgctcaaggacattgagcctaaggtagcagagcaggactgaaataatattactagtgtttttggggtattgaaaagcaagtgtaggcagtgagctccttagttgttttggcatagtggagcttcactgcattgccatgccctgctctcctctgctgggatatatctttttcttcttttttgtttcttttttgttcttccacttgttgagatgttgcaatacagctttgctacacctgctccttactaacaatgttactactaccattgagtcatgacacatggaagatagctctctctcatcaatgtgcttgttttgcaagagaaatggcaattaagcagcagcagcagtcctggtactttgctgtctctgcccactgttattgaacaatgtagtatacttaagcaaacatggaacacctttaatactgcttcctagtactacatgttcaaataagctgtcaaaaattaacaaaaagaaagacagcaatactactccctcattcattgacatgattgcagctgcaaaaccctgcactgtcctgaaagtgtgctaataatcacctgtttagaagattaaagtgtgttccataccatcattatgttccaacttttttccagtttttatcacccctgctgcacctgcactgccattgcatggcagatggctcttctttactcagctcctttgctagtagtgcttttttttcaccttttttatttttttttcttaataattttggctcttcttctccgggttacgctatctctaagtattaattatgctctcggccatgcctggctgccagtgtgatagccttttgagaggccatcactgaagagaaaattaaaaaaaaaaatcacacacaaatcaaatcgctttcttgaccaaccctgcatcgaaatcgctatcaagcatgcgctccactcctgatcattgtgctttttctgcttgtgtagagcacaagtgagtgactgatccaggcacaaacccacaacttttcagctaaaattcggacaaatttagtgccggaaattgctcgaaaatctcgtctgatgtggtctgaccggtgttgtactagtgttacctggctacaagcaaggagattagggttttttttttttttgcaacaaaaggaagagtaaccgcgtggctgatctcctgtcaacatcataaacctaggcattttgcgcggattagcgtcgtgatttatggggagatgtagtgtccgtccatcctaattaagtgcaatcatgggaagagtatgactagaacagtagtaaaagggcaattatccttaaaaaaagttagtaaaagggcaggcaggaaggcaggaactggccaaattgtgattagttaagccatcaggatcagatcaaagctactcttcgctgggtatagagttgttcaattaattaaaagtggtctcagtagtgtgcttttgtggccaactaaccagtactagtacatatggtacattgcatgttttttgtatcatactacctgtttggcacaacttgcaaattgtttttctttttctttcaccatgagaggtgagagctacttccaacacaatgtgctttcgtgtccaagctgttttggcacaccgcttgtccgtatttgtcactgtcaaccatgaattaattactgttatttatactagtcttgcctttgattattatgacaagaatggatcaaagtggttaggtaactagctaggtactaatccttgtttacaatttccccaggtaccataatccagggagagttgttcaaaaatttctggtggcctaggaactgaacttaatattttggacgtgttcaagccaattgttttaaattttcctttgtccgattcatttttaattacatggagaagatgcgtacacacaacacccggccgccaactcgaagcagccacgagggtaggatggacattttacagtcactttatctgtttaccaaaaagtaattattatagtattaatggatatgattatagtgtagtaatactaatggatatgatgttccattacaaatttgacagatcaggactgtactcctagggtaaataacggaccttgatggtcctttatggctaatgacaaccttgatctctgtcactgacaaactaattaattctacccttaattaattaatttcaaatttcaaattcggagtcattgtcactacgcaaaatgtacgtatactcacaaggtatctggagagcaaggttgtacatggtccagttgttagaatctctgcccctcaggatcccaacatctcaaatcatggcctcctgctacactccaaacatgtcaagacaaaacatgagaataacaagacgatcaaaaggaattaagcatgtctatgtgccggccaaaatctccacagaatttaattaattcaaaaggcaacactggtaaccaccaaattgaaatgtctagttcatagcaaatgagatatgcgtggccattaatttgattctcaactaacccctaggacgcatttcaaatcaatccatatagatagtaatgataatttcattgtactattatctgtacttacaaacgcatctaaccgtgaatataattcgttcctacattgccgcaacgactacggattcattaataaattaggtaatagtaggagatgataggtagacctggtccatacggtagtacaaattatttagttattaattcagatctacaaaagtgactgcttggatagatgttactacaagaaatgaattggtagatgaagctaattcacatacaggttaggtctatttacaatgtatatatttactacttgagtttcattaaattacagctcaaattctgaataaattgtaaaattctagcatcaaacatggacatccaactcctacctctctgatatatgattttttttcttttttaaaaaaataaaaacacagcacaaatacaggcgcttatacccactcttttttatgagcacattttaaagacagaccggtatactttaaaaatgacaaatgctcacttcgcctcatctatgatcactaggctaaggtcaaaaccaactcacttgtgtttttaccaaacataaacttaacgtgtactcatacatattcttttcttttctacttttgcaaatcgatactttacttgattatgctttggcacacacccaagtgcatcagtaatcataccaatgggacaatataattccttgattaacaacactaacaaacttgatggctacacatgctattatgaaagcgggacaaaaggtgtaaatagatttgtactcactagccagtatgaattttttgtgtgcaaatatgttgatataatgtgcactttataaagtaatggcgtgcattgcatatccgttctcagtgattagcctaagatgaaaaaaaaataggaggcacctttagtgtctttttttacttaaatttggttaaaaatatattggagtggtgggaatttttttatgtcatatgggaattaaattgatttattactgtgctcgattattgtttattttcgccatgcgtcgcctccctggcacagtcctcatgtgggcaggctcgagctgcatgcaccgtgcactgccatgtgtcacctcctgagaagtccttgcatgcgtagaccttagctgccccgcgcacgatcacattttggattctaagcgtcctcataatcggcccttagccgcgagcctgcagcccatagccaagcttttagtcccaagcaatccagaattccaggacgattagtgttttccagctaatcccttcatcccataatataaaaggttttagctaaacaatccgtcctttctacatggttcttgttatgtggaactccgtagcagagaggaatgggctggcgccttgtgtctcctagcctaggtgtaattttataagggtattggagcatgtacactatatctgtgaggttgacacctatgttccaaattagccttgttatacaagtgcccgataataaaaattgttgatgaacgtgaggatcacccgtagtaactagccacagaggatgagtccgaaccgacaccgtgctaggccttgacatgcaggtcagcagctccattaatctaaatggcgcttacaagggtaagaaaatggctgtgaccatagcataataagggggcaaaaaaaatactatagcatttgtgggggggaacatttgatggtgcaatggcgcggatgagtaatttatgcctgtccggctcggttggtgtgaatgtctgaaatctttgacctgctgctccttgagtgggcacgtctgcaggactgacaatttgctgccaaaacagagataatgcgtgactattctttcctcgtacggatgattattttctcctgtaagcagcgtatatttaggatctgtttggcttggacacgtttggaatgcaattttatggctatggtttgtaagttgagaacacgtaacccatggaaaaaaactaattttgagacgggactttatttttcgttttacttacaccctgtttagtttccaaacaaaacttttcatcttgtcacatcaaatgtttgggcacatgcataaagtattaaatataaaaaaaatttaattatccagattgcgtgtaaattgcgagacgaatcattatgcctaattgcgccatgatttgacaatgtggtgctacagtaaacatttgctaatgacgaattaattaggcttaataaattcgtctcgcggtttacaggcggaatctgtaatttgttttgttattagactacgtttaaactttaaatgtatgtctgtatatccgatgtgacacgtagaaacttttcacccctgaactaaacatggccttaagtgaattgcagtttctactactctcttcatcctaaaatattttttaagataatctttatcataaaatatagctaattgaaatttaaatgttatctcaaatatatatctagggtatataaaaggtgattttactccactgctaccatagggcccatcacctcaccgaccctcaacaccagcaacccctcccatacattaataagtattttattctcatcggtaccctctaccatgcattaataagtattttagacatttctttccaatccttaatatctctaaaatgcccctctgctatatttgggatagagagagtgcctttattactaaagctttatttgaaccatcctttaatatatatatatccactttatactatgtaagattattttttttgtactttagattatcctattcttttttctagtcatatctacactctcctctagcaaaaggtggcctatgcataagaggaggaagattgctgttgtatgagcatgtgctcgagaaaagatccagtatggtcaaaagtacaacaaatgaaaaataacctattccaatatgaaaaaaaaaatagctaaaagtgtagttcaagatgaaattttggtaataaaatgtaaagaaaatacaattaactcattttacttttgatattcctaataagccaacagtaacaacaataaaagaaaagagtgaatcgcatattgggccacatcttattaccagagtgtcaagttgggttaggggtaagccaatattgtcactttgcactaggtatttttgcacaagttttatattggagtggtgtttcctaattctcttctttatttgcttcattgagttgaggccgatatctattagctcgagcgtggtgcaccaatgccactgatattgtcccatgctcgagagtgatcagatagcatcagcgatgggctgtttgatttgggggaagacgagagggtggtgtaaggtgaaacaaatggcaatattatgtggtccaaagtgaaaaccttggctaagacctagtccaacccacgacaatggtcaaaatatatggcctaaactgtaatttactcaaaattatgttccctgaaactcaaagttggttgagcattataagcagtagctcaaacaagtaagtttacctatataaagtttgatatagtttaaagatttactcatagtgtttttacagtgagttaattataaatttttcacgacatgtttaacagcaatccaagtattgtgtcaaatactttgtacttacagaaaagaattatccatgcacataaatcacgtcctcaaatactttagaagctagataggttgttagggacttagggttaaggtttagttgaagctgtccataaagggagtattttatctcttatatacggcattatggctgagtcaatgaattatacctttttttctaaaatataagtatttttaaagatacatcaaaagaaggtagtggtggcgcggtattgaatcagccaccctacctacttccattataaatttcacaagttaccccttcaactttttaatattaaaaaaatatcaaacgtaaatgggtagccacatataaaattagattaagatgaatattcgctataaaaaagggtaacacattaatatattttttttatccatagcaaagagaagatatttaactagtagtcagaaaagaaatatttatagtttacagtagagggagtacataaaatccatgcatgtttatttaggaaccaaccgaaggtaaaaatttaaaatttaagcttaaatttctagctgatttatggggttttatcgtagtttatttgcattttcttttaaactacgaataatgctaatacaaaagttttactcataaatgattcttagttactttgtatttttatggcttatcagtcgtagtagtagtaccaatcagacacatgagattgcctatatatataggtttacctagccagttgtgagctatgcacaacaagttgaagtgcttatattgaaaaggaaaaagtacgaattacccctctaactatcgcggtcgtccaattcacccccctaaactcgagaaccggatatttaacaccccaaactcttaagaccggacaaattacccccctaacatggttcgaagcggttttcagtctacgtggcacacacgtggcgatacagtcagcaaaaacaaataaaaaaacagtggggcccacttgtcagctttttttctctcctccttctctgcctctctctcagtgagcagagagagcacgcggctacggcgaacacaacgcgctctgccttcgcctccaccgccgaccgcgcgaactcgctgcctccatcgccggtcgcccgagcttgctctgcgttcgctagcggacgtggttggacggccacgatgccgacgaccaggacgacggaccgttcgccgcctccaccgcgtcaacgagagaagcagagaagggaagggggaaacttgccggcttccccgacgacctctgcctcaccggctcacatggcgtgttgtgcgacgacgacgacgacgcgtcccacgtcatcggcatctcgctcggctacgtttccgacttctccgtcaacccgagcagcgtagcgccctccgcctccgcctccgccacgctcctcacgtccggcctcctcccgcctccttcccgcgcctacacagcctcttcgtctacgcgcggccgctcccgccgctcaagtggcggctccctcccacgctccaggacctcgtgctcgtcaacaaccccgcgctctccggccgcctcgccatctccgtcgcctgcctcccgctcctctgcaaacgtggtggtggagggcggagcttggtggcgagtggcggtgcgcatggctaggtcactccggccggcggcgagtagcggtgggcgcgatggccggggagggatgtgtggctccggttgaccgcgatgacggtcgatggggacgacgtggatgggtagcgaactcgtcaccgtagcgcaccacctccaatgccctcctcagcgccgcccaccatgccctccgtgccacgtgcgccgcttggctgcctgcctgagaaagagagagagagagagggggggaggccgtggatcccgttgacctctctccgccgcctccaacaccctcctggcctccttagcgccgcccgttgctgccgcgccctccccgcgttccgccgccggcccacgcgcgccaaccgcctatccgccccagcacaccgccgcccgccgcccatcgccggcccccgcgcgacaactgcccatccacccccgagcgtcgccgctcgccgtgcatatatgctctgagcccgagagagagagaggaaaaggaagaggaagaggggaagataagatatgacaggtgggtcccactatttttaaaaaataaaatgctgactggattgccacgtgtacgccacgtaggacaaaaccgctctagattcggttgagggggggtaatttgtccggtattgaaagttcagggtgagcaatgtttggttttcgagtttaggggcgtaaatcggacgaccatgatagttcaggggggtagttcgtactttttcctattgaaaatgaatatagttataacattgtaaggtttacatttttagcctggtctgatctgtttggatgtgtgctcaaggatgcactgatgagcttttcgcatgcttgtgtgatgcagtgtgtacagtatgtgcatatcttctggtttgttaaaaaaagaagtgctggtgaccacataattgggtgtttaatatagtccaaattttactgcttaaccaataaaactagatcccaacatatcagttataattttgtcaaaaagtagaatgtgattaagcagaaacaaccagacaagcactgaaattattttttctggaacactgttgaagcaacagatatatattaatttgtcatatcttttctccatcaaattagttgcgaaaatcaacagaacttttaggtttgacaatgcaacaattaattgtggtgaagattatcccatgcatgaagccatgaagggaaaacaatgtaatagagcacctaaattatgtgttattagcaatagctgccggtagatttccaggtaattaataattaaataaaaccaggctactaactctatatgataaaaataaggtagagctgtgcacatggcaagtactaataaagttgtactgacaaggatttggtgctacgaaatctagctggaggtgctacttaaaatagtaccacaccagatctcagctccttttgttattcgtataaacatttaatagcacaaataacacaaggaaatgcaacaactatgtgaccccttttggatcattgatatgagatcagcatagaaacttaattctttttttccgtttgatcagcatagaaactcccagatgcagacggatattaattaattgtagttgagattgataatggtgattgaatcaacatcatgcagctcagcaaacatccggcctctgtttccttatttttcttggcgaaatttaaattcaagatttgttcttctgatgctacaattttcttagttttagaatatcagagaatgcaaactgaggatgcatatataactgcattatgagaaccggagatgattagggcaccggcatcattcgtctttttaactagatagaatagtatatatgatacttttagttatcattatagaataaatttcacttcgggatatcttttatcatcaatatttcgctctaaaccaccctttaaccaatactttgaatcggataattttgtctttgttttattttggatcaccccgactcttttctcaaacatgagtacgccagctcctattcgtcaataaattccctcagtcgtatatgctcgtttctttgacgtatgacaaattgaatatggatggataaaattaagagttgatggtggtccaaagtaccacaagtgtaaaattactcggtccaaagtgaaaacgttagttggtgatccaaaatgaaataatgataataaaaggtgactcaaagtaaaattgactctttctactataattaaaaagagctagttttcatataaactgtggccccgttaaaacacatgaatttcacaaaaattcaaccttattttcagcagagtactggtcaaatctctacttcttaaaacggaatagcagtgatgataagtggtaaatctaccaccaaccctaccaactcgtttagtttgcggaaagaaatctatactccaaaatatagtagtggtaataatgagtgataaatctacaccatcacctcttacgattttgaaaagaaaaaaatagcagcgtggagagctagagcgccttgccaacttcactaattccctactttcttgaaaaataaaaggataatgtgagtccagagggccaacgtgccagtaaaaaaatatacataaattaaaaatggtatataagaaagagagaaataacaggttaatgacccgttgcaacaaattcaaggacaatatgctaataaaaaatatgttaaaaagtttgatgccagtcccactaatcacagtagcattagtcaaatatttccgactgtaggtagtatatactcgctccttcaaaaaaaaaatcaagttatggagtttgaattttgtccgataaaaaaccaaattctaccctcccacctattctcatcatgtaaaacgagaagttttattccttcaatacaatttacctacctattactcttactacttttttcaatgtttaaggacagtcattctcactctccactaatttttactctctactaatttctcctatgatgctaggaatggactttgtgggacggaaggagtactatggtgtcctaaatcagtccggtttctcataatgcagctaaccttagttaattagcattctgatattctaaaactagaaaattgtagcatcatcagaacgtacagatcttgaaattaaatttcgcgaacaattttctgcaggagttagatttttttttttgtctctgaacgacacagtacaaaacaattcattgactggcgcaagacacgaaaggtgatgaagtcctagagaaatatgcagggtaaaaaaaaagtactctgacaggagcgaaatcgacgagatgcacagagatccgacaaagcttgggagatcgatgtatatatgtttctttcacgatgcatcgtttcaggttattatcgtattggaagctttggaacagaagctgtaaattacggagaacgaggtcaacgcggtacactcctgtcttaatttgttgggcaacacaaatgcttcttgtttgtttggacttgatttgaatacaaaccagtaatataacaatgaactgttttgtattatgtcggtatcagttaattattgtgcttggacctcgagttagcactagtaattatcataatatttacaatcgaacaacctttatatttatttagtttgacccatgtggtcgtgtacaatcattaattttgtttcgaagcttaggttttaaaaatgattaatttggaccatataccaaggggcaagagccctttgaaaataaagaagttgagaatgcaaatgaattccaaaaatattacaaatgatggaataacatgtattgttcttttcttttgctcgagggatgactagcttgttcagtctaggggcggatccatggcccgacgatccaggtagttgttggatagtctcacattggttgtggaagggtaatggacctaatatataagtgagggagtctcttacctcattagctagcttttggggtgagaaaggctatttacgatattaaatttggtatcagagcctgactaggtcaacatttctgactcgagagacaaagtgtgtgaagctctaatggaccgtaggtgcctgagggacctgagggaccgtagggcgtgaatggttaagagacactaatgtgtgaatggggtgattgttgaatagtctcactattggttgtggaaggacaaataatgacttaatatataagtgggggacccttcacctcattggctagcttgactgtggggataacggtgaaggggcagtgaacggctgagagacaccaatgtgtgagggggagtttgttgaatagtcctatattggttgtggaagggcaagtgacctaatatataagtgaggagcccctcacctcattggctaactttttgagtgggaaataccatttacgatcctacaagaccggcggtaccatggcttttagaccggcaacaccattgcagttagaccgacagcgatgacagtaggaggtggtgacgcgactggttgggccggccgatctacaccggtcagaccaacagtacagggacggtcagaccggcgcataacctgcggttagaccgatctccaccgacttgaggataacttttaattctgctaaaagttccagtttttgggtacttcaatcattcaccctcatttggtggcttggttcttactattcgatcctatagtagtcgcttgggctcgccgacggattgcaccggatagctactaactctatagttcatatctaaaatctttttacacatgtgcttaaccaggctcttaaagatttctacatccaccgccggttcagtccttcatgacttccaaaccaaatagattgaggaaaatataagctttctatttactagcttcaaaagttgtgatcggaggtggttcacaacaaacaattcaataatttaggagagaacgcttctacaaaatcatggagagagttaaaatatgacttgttagattgagcctacgacatgacacctaaaaaatagttcagcgagatttactacgtgcaaaatgataaatcgggaaaaaaatccacattttttccctcagctatatggccttggtaatttttgtttctcaactataaacccggttgctatctatcctttaactcaacagttaacatttcattctttgccttgaaaaaggtagtttctgatgacgtgacatatcctagttaacaaattaaaataaaaaataataatatgtaggatatatgggtataggaggaaatggaggcgaggatgatatgcttgttctatattttgttattattttttattactgatcgatactcttttcatcctataaaaaaccaatctagtaccggataaaaacattctattactataattctagactaatgtatgtctataattctggactaaggaatgtctagatttatagtattaggatgtgtcatatccgataattgattttctaggtacgaaggaagtatgatagtgtcgacactctttatccatgtaagttcattgtagaggttaccttaccaaccacattagcttgaaccaagggatgtaatatgaaccatttaagagttgttggactaatagtgaaaaatggtttggttgtcgaggcaccaaaagctagactaaggatgcgttagaaatagcttattagcctagcttatttgctgtacgtaaaatgagaaagagaactagcgtataactaattaagtagtattaactatttataaattttaaaatgtatttatttgattttttaaataaacttctacataatttttttacgaagagtgcacgtttagctatttaaaagtgtgctcatgaaaaaacgatgaagtcgcacagcggaattgctgattcaaactcagccattaaatgccatagttaagtaagtcttgatttatctctttcaaaaatatccaaattcgtcagcaaaataattcttacttgaatttcatccaacaaactctttaattacgaatcctttttctcctagcttactactgtcatttaaattatacattatgctcattgtattgctacaaaatcttcagcaatgctgaaaaaaaatactttacttttctcgacacttaaggcttgacacatccaatgatccaaacgattttaagatatctttaggagtactattcgttatcttgagaagataagtaaatacatatacataaaattattcataaaaaaccaaatttcaaaactaaaaatcgctttgcggccccatcgtaagccaaacgacatatttacaaacgaaaaataatttgtgaataaaacttttatatacgtattcttagcgatctaaaaggaaagattgaaaaataaattttgataaaaaaaaccctaaaatcaactctaagtttaaggttaaaaaatctaaattttggcaaataagcataagcacaagaaaaaaagagcccttggattataaaaagaggggggtggctagctcgcgcgcacacgcgaggacgttaaggtgcgcgcatacggaccttcgctttagtagcgcttagcgcttttctcgaaagaaaacaatgcgcatgacgctacggtaaagtaaagtgattaacgaaaatgctacagtaatttatcaataaaaaaataaaaacaattgattttgaaattttgagttaaaagttttcaaatattgacttgaaaattttaaaaataagatttgaaagtttttgaattttgagttgaaagtttttgaattttgagttgaaagttttcgattttaatatgaaaagttttcaattttgagttgaaaatttttaaattttgagttgaaagttttcagatctcgagttaaaagtttcaaacctgagtcgaaacttttcaaatctgagtcaaaagttttcaaatctcaagttgaaagttttcaaatcggagttgaaagttttcaaatctgagttgaaagttttcaaatctaagttgaaaattttcaaaatttgacttcaaaatttaaatcttaagtcaaaagttttcaaatgtaatttaaaaattttctatctattagtaaaaaatctcaaagaaaaactttcattaattactatcattatccttaaacaattagttacgttaaacgcgcgctatgaaaaaaagaatctcgatcagcgctggcggcaccacgcatacgggccgtgtgggccggaagtgcttgcccacggcgcgtacgcgcgaattaggaatcctatcttactataaaggtatcccccactaactccttaagcttaacatgcaaagatgccacatcatcatccactaacaagatgccacattatcatccactaattaacaagatgccacatcatcatccactaacaatcatcacatttaaacatcatgcaaacaagctatatctttatagtttttataatttaagagcgtttcaaatacaaatatgttaaattatcatccaacataattcacataatatttcaatgtatatctttattatgttttatgatatcctatatacctatatagttcatcctcacttagttagtgtttaaatgattaatctatggtctaaattattttttccttttattcttttaactaagttatatcacatcaattgtttttagcctttagatgattaatctacgatacaaactatctctctacttttcttctttcataaagtcacaccaccttactatttatgtttgaatcaccattctacatactatttaaattatccttaagcttaacatgcaaagatgccacatcatcatccactaacaatcatcacatttaaacatcatgcaaacatgctatatctttatagtttttatattttaagagcttttcaaatataaatatgttaaattattatccaacataattcacataatatttcaatgtatatctttattatgttttatgatatcctatatacttatatagttcatccttacttagttagtgtttaaatgattaatctatggtccaaattatttttccttttattcttctaactaagtcatatcacatcaattgtttttagcctttagatgattaatctacggtacaaactatctccctacttttcttttttcataaagtcataccaccttactatttatgtttgaatcaccattctacatactatttaaatttaaattatcataaaccacattaatttacttaatctgatgttatctagctatcttacatgttattattttattgttatcatactaaatttccgcagcaatgcgcggggtttcacctattcgtgtgaaaagagtgtcaaccactcctatctgcaatctcccaactccgtgggccaaggcctggcccatccaaacgagccttttgtgggccttctcgcagtccagccgggcagccggctaggcccgaatcgacgcgggcccaccaggtcgggcaaccaacggtgggggcccaccgccatccgaccgtttcgacggcttccccgtccgtaaccgctaacgccgttacgtctccgtttccgctccgtcaccccgtttcaccgctctccggacctccggtcaatcgcagtcaaaaggctccccgctcccccgtccccttccccctctcgccctctcctacccaacttctcgaactctccaaaccctagctttttcctcctccccctcctccgcgaatcttccatgcccgacggctatccggcggcgccgcccgggatggagcgccctgccccggaggcggcggctgcggcggcggagccccctggggcgaaggcggaggaggaggaggaggggccgaaggatgtgggggtgaagggtacggggaaggagaaggagacagagaaggttgaggccgagaaggagatggaggggaaggggaaggggaaggagtcgatggaggtggaggaggggaagagaaggagggtaaggggaaggcgaaggagaaggagaaggagacgaaggtgaaggtgaaggaggagggtggggaagagaaggagaaggggaaggttgaggtggtggaggcaaagcggcggccggctggtgttggcgcggagacacccatcctagcggtgccgatggtggccgtgccatgcttcttggcgtctcctgcatttgcggtgagtggtgccatttctctttgtcactaactaggggcattttgttttaaggcgagggagagatccatgggcggagaatattagggttttgatgggttgggttcacctcggtcaggttatccgtggcatgttagtgatgattttattctggtcactagttagcccatcataactgcagctaaattgtagcgtgatgccatttctatgatacgaatcgctagaaatgggcaggtcaggcctcgttgcactagccaagtacatcaatgaaccaatgatttgagagtatctagttgatcccttgctattcttgggtttttccttaatagcacgctgggatcataaggagtaggagctggcttgcagtcactatatccaaagcgactcaaaactttgtccacatagtgggatnnnnnnnnnnnnnnnnnnnnnnnnnnnnnnnnnnnnnnnnnnnnnnnnnnnnnn

SEQ ID NO: 29163 - DNA, 743 bp, Oryza sativa
tccgcgctgcttccgtactctttcctctaagattgggccgccggagttctggacgagacaatcgcccccctactcctgctccactttagatcatgtcacgggagcggtcaccacctcctctgacagcgaggcagatagggggagggacacttgcattggagatgggctgccggacttggagaagatgagggggtggtctagagtgaaaccaatggtagaaatatgtggtccaaagtaaaaaccattgctaggacctagtccaaattgcaacaatggtaaaaatatgtggtccaaactataatttactcgaatatattggaaaattaaaacattggtccagtggctcgccttcaacctccacctataatgatatattccaacaataccacttctctagttctcctaactagaaatcagtcatttctatcattttacttcataattggatagttagatgtgcgcattgcccctttttacatatacattatacattaatgttttttcatgtcattaatttttagatacatgtcacagtattggtgtattacgaatcggtatttgtgtctaataagttcacccacctataattttgtgctgggtcagccactgaccagttctattaactacttttcttataactcttgtagaacatgcagttgttattagccaagccaacagcatgtggtttgggaaaccaaacatggcatacccaacaactactctagactcatggatatgcatca

SEQ ID NO: 29164 - DNA, 448 bp, Oryza sativa
acgacggccgtccccccgtgtggcgctggcggatctggtagtgggaacggactcctcctccaacgtcgctgcctccctcttccgcctctcttgctcctcctccgccgtcgctgccttcctctcccccatcccctccacctccccgcgtgccgcttgcgcgccaaccgccggcccgcccccgcgccgccgcccatcgcccttccccgcgccgcgccatgcgtgccggccgccggccgtgcgcgcgctgccgctgaccgtcgtgaccgacgaagagagagagaaagagagagaggaagagaaaacgaagggtctgacatgtgggtctcaccattaaaaataaaataaaatactgactggattgccacctgcacgccacataggccaaaaccaccgcggattgggtcgagagggttaagtcgtccggtttgcatagttgggggtaaagaat

SEQ ID NO: 29165 - DNA, 685 bp, Oryza sativa
  unsure (1)..(685): unsure at all n locations
nnnnnnnnnnnnnnnnnnnnnnnnnnnnnnnnnnnnnnnnnnnnnnnnnnnnnnnnnnnnnnaatgaattggtcctgtggatttctttgaagatcctgagcaactgaatcccccttatgcttagcaaaggaaaaaagcctgggatatttgacagatcttatattatcatgccacaaatcctcccaaaacaggactgtcttgccagatctcaaaatgggctttgcaatacctctaaacaagacatcaaactgaaagacatctttccaccaaaaagaaccacaagaattagccacttgggggattatatttgagtaatatgaagaccagattaaattcacccaaggcacattatccttattataaaatttgtgcagatgtttcatgaggagagctctgttttgaattctaagatcaatgactcccaagccccctttattctttggcttgcacaccttgccccaagctgccagagactttttggtggaattaaggtcattacccctccataagcaatgccttctggctctatcaatattctcaatgactgaaaatggcagagaaagcgaacacatgtaatacgttggtaaggaggagagtactgagttaaccaacgtcaatctatcaccataggagagaaaagaagaactgactgttaatcttctttcaattctatctggcaatgggg

SEQ ID NO: 29166 - DNA, 704 bp, Oryza sativa
  unsure (1)..(704): unsure at all n locations
nnnnnnnnnnnnnnnnnnnnnnnnnnnnnnnnnnnnttcgtcacttcactacttcagcacacactgaacttgttgcaaagagagacatatagtatatagttagtagcttaatttgcagcgctaataagctctagctttctcttcttcctagcaaattataattaacactaggttctagctagcatgggtgtcgagaagacgacggcgaacggcggcagtggcgccgcggcggtctccggcggagggcgcaccgtctgcgtcaccggcgccggcgggttcatcgcgtcgtggctcgtcaagctcctcctcgagaagggctacgccgtccgcggcaccgttcggaaccctggtatgtatatatattgttatcggtagtttttaagaaatccatgtagattaatacgtaattatgtgtgtattatataaaagtatttttgcagtttgtttggtgttccagatccacgctagctgggtttaatttttttatgttaaatcatagtggtttaaaaattatattttatttaaaatgagattaaaataatttattcaaatgttaccaatataattatgtatttggatttgtagagttataaatatccaactctgaaaatcttagatcaggatatgtcgaacaggaccttcatgttgaaacacatgataaaaaaacatactccagatcttatgagcaaaacagcgtacataca

SEQ ID NO: 29167 - DNA, 823 bp, Oryza sativa
  unsure (1)..(823): unsure at all n locations
nnnnnnnnnnnnnnnnnnnnnnnnnnnnnnnnnnnnnnnnnnnnnnnnnnnnnnnnnagatatggattgcctcaccgcatcataacggacaacggctcccagttcatcagtatcgacttccaggattactgcatcaggctgggagtcaagatctgcttcgcctcggtttcttcccctcagagcaatagactggtcgagagggcaaacggcatatcactacaaggaatcaagacccgtgtctacgacaggctcatgtcacacggcaagaagtgggttgaagaactcccctcggtactatactatgggccgtacgtactacactgacaacgtccaacaaggagacacatttcttcctcgtgtacggctcagaggccatgctccccaccgagctacgacatcagagtacacgactacagaagtactccgatgaggatcaggaggagcagcgaaacgatgatgtcaatctactcgaagaacatcgagaacgagttgccgtcagagcagctagctaccaacaggcccttcaccgataccccgagaagcgcatcagagcacgcacgctttcaatcggtgactacgtcctccgacgggttcaaagccaagcagggcgaaacaaactctcacccaaatgggaaggaccgtacacgatcacgcaagtcttgcggccaggtgcattcaagattgtagacagcgatggtcgcgagttggtaaattcttggaacattgatcaattacgtaaattctatgtataaatcaatagtattcatacttgtaagacatcttacagcttctataaagtttattttcaggtaaagattacaat

SEQ ID NO: 29168 - DNA, 674 bp, Oryza sativa
tatagggcgaattcgagctcggtaccctttatgaaagaagaaaagtagagagatagtttgtatcgtagattaatcatctaaaggctaaaaacaattgatgtgatataacttagttaaaagaataaaaggaaaaaataatttagaccatagattaatcatttaaacactaactaagtgaggatgaactatataggtatataggatatcataaaacataataaagatatacattgaaatattatgtgaattatgttggatgataatttaacatatttgtatttgaaacgctcttaaattataaaaactataaagatatagcttgtttgcatgatgtttaaatgtgatgattgttagtggatgatgatgtggcatcttgttaattagtggatgataatgtggcatcttgttagtggatgatgatgtggcatctttgcatgttaagcttaaggagttagtgggggataactttatagtaagataggattcctaattcgcgcgtacgcgccgtgggcgagcacttccggcccacacggcccgtatgcgtggtgccgccagcgctgatcgagattctttttttcatagcgcgcgtttaacgtaactaattgtttaaggataatgatagtaattaatgaaagtttttctttgagattttttactaatagatagaaaatttt

SEQ ID NO: 29169 - DNA, 318 bp, Oryza sativa
  unsure (1)..(318): unsure at all n locations
agctcggtacccgtgcgaccggttgtctatctggcgcatcaggcgaacagtgttagaccaggaggtcatgtccggggctttgcaggttgggttaatcagcttcaccctggaggaaatccacttagctgtctcgaggtcttcagcagagccccacttcgcaccggatggtgtgtagaccgcagcttcaggatgagttgataaaaatttcttcagacgtgcgtcagaggattcgtcagaattctcggacgaagatcttttaatactgttcttgttcttgnnnnnnnnnnnnnnnnnnnnnnnnnnnnnnnnnnnnnnnnn

SEQ ID NO: 29170 - DNA, 551 bp, Oryza sativa
ccgagctcggtacccggtttcttgggttttgtttagatgaaagtttagccattgctacttccttgcagcgcgcgtgatcagcaaccgccgagaagatgcaaagccgatatgcttgaacctgttaaggctgagattcaacgcttatatgatgctggttttattcgtcttgccgatatgcttagtggatttctagtatagttcctgttaccaagaaaaacggcaaggttagggtatgcattgattttagagatttgaataaagctaccccaaaggacgaatatccaatgccagtagtcgatcaactggttgatgctgcatcagggcataagattttgagttttatggatggaaatgctggatacaatcaaatttttatgactgaagaagacattcataagacagcttttaggtgtcccggtgcaatcggattgtttgagtgggttgtaatgactttcggcttgaaaagtgctggagcaatgtatcaaagagctatgaattatatataccatgattaatcggctggttggttgaggtctacattgatgatgtgg

SEQ ID NO: 29171 - DNA, 495 bp, Oryza sativa
acaagattttcatcatcggttgcaatacaatggcctacatgagaggtgtttccgtaagtatctcctcatatttatgctttgacgacattttgcttatattaatatactaggcgctcagtactgatcgttacataatctcatttaatttaacgtcatagatacaaattaacatctgtgacttatgcagtatgtcataggttgcttgtccacatgctccgatcaaccaaaaaatggttcttgctctggcgctggctgttgttcggtggatgtcccgccagacctgggttatcttgaggcttacttcaataaagactataactcctcagaaatcagctacagcagttgtggctacgtggtagtgatggaaaaggctgtgtaagtgagtggctggacttctagttttgaactatagcaccacttacattccctcaacaaacttctgggatgactacaacgggactgttccggccgtgatggactggataattacatggg

SEQ ID NO: 29172 - DNA, 638 bp, Oryza sativa
  unsure (1)..(638): unsure at all n locations
nnnnnnnnnnnnnnnnnnnnnnnnnnnnnnnnnnnnnncggcacgttgccggctgcggccggcggcgccgagacggcaaggcagagcagcagcagcgacgagtactgcagaagaagcggcgggcggctggccattagcggcctgatggcgatggcgatggctctggctgctccggcgaaagatgtacacaaagagcaagcaagtgaaaggacttatgtgatattctaatgacaaattaagaacttgtgtgtcagtccaaggcatatgatgccgtagctttatattaaaatgggttgcttggttgggtgcatgcactggcctaaataagactctctctgcttatgttggatgcatgcatgttgttattgaaatgacaccagggaggcttcgcagaaccggtcgtttgatactttgatgtatagtgacaggtctatggtaattggaagggcaaattttacgatacttgaaaaagtatcgacgtatgaattttggtatctcgaagtgatgtacttaaatatctggagcagggtataacggcttggtttctctatttctataagtactgatatagctgaaatttcggttcaaaattatttggaatgttgaacaaaatttgattaaatagggaacattttttt

SEQ ID NO: 29173 - DNA, 11887 bp, Oryza sativa
gagagaaaaaccaaacaaaaacaaaacacacacacacacacacacagaaacccacgaagagtgaccgcgagagggcagatcggttcgcggcacggcggaggaggagaaacggaagaattcgaatcgcatcaccgatacgaggacgtacgttgacgaagcagtcgtggaactggaggcgcatgacggacgcgacgctgcgggcctcgtgcgcgcgtgcccgggccatggtgtcgcggacgacggcctcggcgtcggggcacgtctcggcgtagtacccgaccctgaggtccctcacggccgcctccgcgccaccaccgcaggagaggacgagcgcgacgacgacgaccgcgaggaccgtggccgcagcgaagccgccgccgcgtcggaggaggaggagcgccatggcgaggaggaggaggaagcaccgaaacagacacgcacacgcgcaggtgggggattgttgctgctgcctgcctgccctgcctccgcttccgcctgcgggtctgtctgtctctgctcgatctcctctgctgtgctctgctctgtactactagcgcccgggcggggtggtgggtagttatagaaaaggggaggtacgtgtcgggtcgggacggggagaggagtcgagactcgagacgggagggtgggagacacacgggccgcgcggtgcaggggaacccagccggccagtggtgcactgcacggacggacgggaggacgcgaggtggtttggctgttgtacagggtagagtacggccgggcgcggcgcaggctggcatgcgggtgcggcgttggtgaatggtgctgaccgtagcgtactagcgcgtgcgtcaaaaatatcagcacgggtgcatccggtgatagggagtagggaaggaggggggcattgacttggggcgcgttctaagcagctacttcacgtttcacaatgtaaatcattctagcatttttcatatttatattgatgttatgtctagattcattaacattaatatgaatgtggaaaatgataaaatgacttacattataaaacggaaggagtactagccttggctatctctttgtttttagggagagcgttttcaaaccgttaaatggtgcgttttttatgaaaactttatattactttttttgaaaaagtatggtgccgttaatttttcgtacaatgtttgatcattcgtcttattaaaaaattttagtataaatatgtaaaaatgtgagttaaattatattttatttaatgataaaacatgtcacaacaaaatatatgatatatatgttttgattggacaaatgatcaaacgctacacgaaaagttaacggcgttagacattttaaaatagaatgagtatatatagaagatatttaaaaaaatcaaataaatctaattttagggttttattaattaataatccctccatctatttttcacagtcatatttctaaatctaaaaaaattatttttgatagacatatttcaatccaacaacctatcatcttaatgattttctcgaatttaatgcgttaatctccattcttccacacaaaactgcctacatgggcatcgagaaatgtaaatttaatgaatcgcttgttacgaggaatgactataacatgtttaaatggatgataagtagacttatttatccttggtctgtgtgtcaagatgaaatataactatcaaaagtagatggaatgagtatttaattagttatatgttaatcatgtttatttattttacgtgtagttaataagctaaaaacataatcaaaaggaccttttagctatgggacactgattgtgtagtgtgtgatgaccgcgagttgagtgtgattgacgatggtgtgtgtggtgtggattttgatttttgttcatgttgacccaggaaccgggatggaatcatgggaacatggggagcaaatggagagcagcggtgtaaaaaacgatggtgacttggggtctttttccggttggaaaaagaaggcgtagtattttagtgccattctttattaggaaaaataaaggcacaaatatttaatgatatataagaataaaagatagaagtagctaaaagtagataaacataataaataagaataaatacataatcaatggtgagactcttccacactaggtcaaagataaagatagttgcataggctttggcacagctatacaacagagtaagatttaccttatcgtaagaggccgagtcaagtcttctcgtgtatatatcgtgcataatgactaataaattttatcaaagtttttataaaaaattgtacatatacttctaatagtattgtttgtaatgtctcatattcacatttataatatacacgtagcataaaaaaattctgtcagatttataacctttaaaactgtcaaatttttattcttttgcggctaaaacataacaaatatgaggttaaaactttacacataagtgtaatactattgaaagtacatgtaaatttttttcaatgatttttggtaaactttgttagctagtgcgcacgatgtgtaaaaaagcctgtgtacacataatatgttctcgggttaccacaccctagcagtaagagcggttatcaagcagtaaccttggtattacggtaaaccgtgaaaagcacacaaaatttatgaaaaaaaatctaattattttaataattcgtttgagtttgatggggttaccatgtgttttctattactactagatgggtaccccgcgtgttgttgtgggagaattgtgtgataatatagtatatatgagttctaaaattttctttcttacctactatactatttttttgtgtgcatgtttatatatttttgtaactttatcaattatccaaaggttataaatgattaggttgtatggtgtgcctttaggaggaagatgtgcaatttacactcttgctaaatcatcaaaagactaaaaacaattaaggtgatatgaagagatatattttacactcttgatgaatcatccaaatgctaaaaccaattacacaatttctttagtaacccatagaattgtctgccatgcatgggagggtagataaacatactaataaaaaaaaccttgttgtcacctctatctctccaagtggtgtagtagcactaggcctactatagtgtacaacaacagtagaaaataccccacgtcttagctgtgggatttgttaaatttagcattgtgtaaagattgaaatttaaaattatcggatgaaaatgttgcttcaaggttttttttttcaaagcatcatttcattgaagaaaaatataggaaatgaatatgtactaatataaaatcaaaatattacgtgcttgtttaacctagatactgcaatttgattgtactgcatcgatctcccatttagttcgtattcctcatcacgagttgttactacatatataagtattaaaaggtagggaggagagagtcaacaaatgttgataagtaactccttgatctaactattggtaattttatactaacatgatcaaacacttgggattacttatattgtgtatctagttaaaagtggagaggaggggatagagatgactaatataaaccgataagtaacccattctaatggttgataattttatattaacataaccaaatggattaggataagagagaactaatgaatgcgaataagtaactcttggatccaacagtcaataatttcatattaacataattaaatggattaggactactaattatgtgtatctagttaaaggtggagagagaagggctagagatgaccaatgaataagataagtaactccttatctaactgttcataattttatactagcatagtcaaatggattaggactactcattatgtgtatctagttaaaggtggagaggagggacatagatgactaatgaaagcagataagtaactctttatccaatgatagataattttatactagcataatcaaataggttaggatttgatcgaacgtttgacaattttatactaacataattaaatggattaggattactcattatgtgtatctagttaaaggggaataggaggggtagagatgactaatgaatgcggataaataaccacttaatctaacggttgataatgttatactaacacaatcaaatgtcttagcataagagaggattaataaataagaacaagaaactcattgatccaatggttggtaattttatactaacttgaacaaatgagttaagataactcatgatgtgtatctaattaaatgtgaagagaagtggtagagatgactagtaatgaacatggataagcaacttcttatccaatagtcatgatacgtaaattcgtataatagattgaataaatcttgtcaacctgattttatacatgctattattattgatagtataaatactataattttaatcatacaataaatatgttggctatgttccagagttatagccaaataaggattctatgatctattagttacgacttactaaatatccattttaaattttaaaataaattaataaaacaataactgagagtccaacttaggtgcaacttttttttaaaccggcaacaaacgtgccaatttcattggaaaaagtaggagtaaaaagttacttgtacaattaagaaaaaactgtacaagaagtaaatacaatacttgctgctttaagttttcttttttaacgtttgaccattcgtcttatttacaagactatgaaattattatttattttttattgtaacttactttattatcaaaagtactttcggtatgacttattttttttatatttgcactaatcttttaaataagacgaaagtataatatcaaaatgacatctaatttgggacggatgtagtaaaatactatggcagcataagtaagaggtgctttgcgcctgttgcaacacaagttctggcctcttcgatctttgctctgaaagatgatgcgatataaagctttttgtgctggaaaactctaggtgcagcttgatttattgattctaattttttgaaaaaaaaatcaacggaaggatccacgatattgatcatgttttattcagttcagagacaaagtaaaagttaaagagttcatgttattttcgactgtatatttttaacaataattttcaatagatctagaatcatatatccacctaactaatagtcaactgctagatatattttaacatgggaattttcttataaaaaggtttccaatttatataggtttaacaacagcatgggaaaaaactcaattaacatatattcaagtcttagtatttttcaacaagacaattaggctgtgttcgctataacaagttcccatccggaacagtgatcacggaaaacggagcaatccattagcgcgtgattaattaagtatttgctatttttttcaaaaatggattaatttgatttttaagcaactttcgtataaaaacttttttgcaaaaaaacacaccgtttaacactttgaaaaacgtgcgcgtagaaaacgagagagaggggttgggaaaaggcgcatccgaacacagccttagtatggttttgaaacggatcagaatacttacaaggtatgataatgggactaatgaattcatcaactatccttttcttttgtaagaaaactcctaaacaatcaagtcggctacttactccattttagattataagtcgttttgactttagttaaaaatcaaactactttaagtataatcaaatttatagacaaatataataatgtttataacaccaaattagtttcattaaatcgctaattgaatatattttataatatatttttcttgggttaaaaatgctactagttttttcaacaaatttggttgaatttcaaacaatttaactttgaccaaagtcaaaaaaacttataatttaaaatggggagtattaaattaataaaaagttagctacacgtacgtgtatatcaaacacaaatttcatttcaaacttttttatggtcgttgttcacaaatgtagtactagatcatttcatatcacaatataaattaataattaatcacaatggagtcggcgttttagtcatgctttcctaatgtttttgccgaacaacaagttaaccaccaataaaatcttgggtaggactcctgtgaggctgtgactactgtccccgcccatatgagaatatgactgcacttttctggtcccccaacccatgaccgggaacaaaggaaacaattcgatcgtagcaatagtgcgtttcgcactatcttgataaatgaaacttatcttggcctcgaaagatcacgacaagtagtccatctgattcctcgtgatatgccctgtatcaaaccatatcactacttcaactatttatttcgattattagtaacttgattatataaatataaaaggctacaaagctatataaagattggcccaggcaaaccggccatactagccgatcccattctcaacttgaaggaatatctctgaaacatcaacttggagaacttttttcttttgcaaccatcaacttggacaacttgcctgcaggagtgtcgcaatactggaagagccagctcgcactgtcacacagcttagaaatagcatccaggaactttctccaggaaagaaacaaaatgccaaagcaagcacgggtacggtctattcgggagccaggaacagcactggacaggtacgtacgtacagcttctgaatttctgacgacacacggcccatatgcatgcagacatccatgttacttttgagggtgcaaacgagcttagccaacgacagcacacatctcatcggtgcggtgcatccggtgcagggatcgtgcaagtagacgagcgagacgacgtcgatcgacgatcgagattgtcggtgacatgggaccggaagtatcatgactagaggcttgggcaacagcaatcacccacgagacctgaccccctcgggggggtcgggcccgagggtgatgtggccgcccccctctttgtctccccgaggggtcggaccgctcccgtttcggccccgagggttgaggcgccccgaccccttgggggttttgcgccgcgtgtctgggttaggcgagcgcagcggggctcacctaaccgcatttattgcggtttggtcaagcgcgtcacgccgcatgtaacgcagtgcagcgcgctcgtttatccggtctgtgaccagtcacagaccgatcagatcgtggattaggtggcgacaggcggtctgacacacgcctcgctccatcccgtcaagatgagagcctccaagcactcgtccctagccggagccggcgtgttacctcctggagatggcacgttggtcccggtcagatatatgccaggcttcatcctaaccattacaagcaagatattgtatgaagaagggcgaacatgcagattgataaactgacgcgtggtggacaagaatgaccgatttgtgaccggtctgacactggtcatatcgtcagcagacagccatgttcccacgtcgcgcctgcttccggcggaagtggaggtaggtatgggccgtcccattagaaggtcattcagacggcaaccatacaaatctccgtccatttatgaaaagataggataagtccccacacaaaagagagagatggtgcatgtggtatccccttgagatataaaaggaggaccttgcccacttagaaagggagggaggatctggagagtagatcccacgagaggaaaaaaggggagaagagggtttctagagtaagagctctctggctctccagctctttgtagcttcttcatacacagatccaccagaacacaggagtagggtattacgcttcttagcggcccgaacctgtatacatcgcccgtgtcttgtgctttttccattctcgtgagccttccacacaccgagagcttagaatctcacccagggcccccggccgaaccggcaaaggggggcctgcgcggtctcccggtgaggagccccacgctccgtcatctggcgtgccaggtagggggttctgcgtgtgttcttctaagctctcgcactctttcgtgtgcgccaagcttttcctgttcagcccaatggccgaacaagcaaaggcgcacagcctctctccgagtgttagcggtgacgacggggagccgaacccacgccgtcgagctcgtactccaccgccccctccacgccaaagtcctaggcgggaggaggcgctcgagagggtcgaaggatccgcgacttcgacatccacgggtgatggggaagggcggcgagatggggagcgtcgcctcctcgtctacggcgatggcagcacgcccagggcgcgctccaaactgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcatcaaggcggagggcgcggcgagcggcggcggttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgatcgggatcgaggccgccgggggtgacgacagggtcatggcgaatttctttcccatggccctgaagggacaggcacggggttggctaatgaacttgccacccgcgtccgtccactcttgggaggatctgtgccaacagttcaccatgaactttcaaggcacatatccgcgcccaggtaaagaagcggacttacatgcagtccagcgaagggatgatgagtcacttcgctcatacattcagcggttctgtcaagtccgcaacaccataccatgcatccctgcacacgcggtgatctacgtgttcagggggggtgtgcggcacaaccgcatgctcgaaaagattgcctctaaagagccccagactaccgcggagcttttttagcttgcggaccgagtggctcgtaaggaggaggcatggacctggaacccctccggttccggagtggcagcttcggccgcccccggatccgctgctcagacagggcggcgggacaggaggaggaagaagaggtcggcccattccgacgacgagggtcatgtcctcgccgtcgagggcgtttcgctggccacccgaaaggggaggcctgcgagcgacagaaagaaggccggcgctccttgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgattggcgtcccccggccgggctccgttcggctggccacgggcgacggcacagagctgcctaacccgtggaacatcgaacaccttcgtcgcttctacccctagtgggggtcgggtgtcaggtcttgggctcgggccaaccccgcacccccccgggcgtgcagggttggccgggggcttatcttttttctcttccgtatttcaataaaagcattttcgatttcctaaggactgtgtctgtgccattgtttccttttgaagaatcttggcttgaattagcacactcgtgctcgaccctgtcctcgggggctcgggtcggctaaaatcgccaaacggggcccagaaccgagccgtgccccggggcgtggtgaactccgggggggaattggcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacagaaggaccgcggcacagaccatcctcgtctcatacacacaacaaatagaattgacatagaaatttcctctttatttggttgcagattaaattagtctatacaagaagggggcccgaaggcctcggaagaagaaagaaaaagctattcaagattggcgggggcctgggggctcactccgacgcgcccgggtcaccagccttgtcgtcgctgtcgtccgcaccaccgtcaccgccctcctcgtcggagtcgagggcgaacgcgagccgaggggccgtaccctcgaagctgtggacgatgtggtcggcggcgtcccggacctgcgcgcgtgcgccgtcctcggttccggaagggaactcttccagcgctgcccacggggagaagtcagggtccgagaggcccccaagccgaacggcggcccaaggcccccgacggccggagttggccctccgcctgcttgtccgacggtgttaggcgcccccgaccctcaggatagcctcggggccactacgggaaggccgcgcctgtcgccctctgaccccgaggttatcggcacagaagccgagggcgccccgcgctgcctctcggatgaagagcgccctggagatgcggcccctagcgaagaggatcggccccgccgaaaggtgcagcggcccgtctactttgttagcgaggccctccgggacgccaaaacccgataccctcaggcccagaagatgctatacgctattctgatggctccgagaaaagcgccatcaccatatctccaggcaaaacgaaccggctcgtcccgattcgcgtgctactcgagtaatgtggcagtcttgaagagaccgctcattattggcagccgagtaaccattgccgatgtgcgtgatttgcgatcgttgggtttctgcccaactgtggagaccggtcccacctgtcaccaggccttaagaagtggcgtcacgcccgaccgcttccctcgaggagggcgatcgccctggcataacaccgggggctactgtcggtgacatgggaccgggagtatcatgactagaggcttgggcaggagcaatcacccacgaggcctgaccccctcgggggggtcgggcccgagggtgatgtggccgcccccctctttgtctccctgaggggtcggaccgctcccgtttcggccccgagggttgaggcgccccgaccccttgggggttttgcgccgcgtgtctgggttaggcgagcgcagcggggctcacctaaccgcatttattgcggtttggtcaagcgcgtcacgccgcatgtaacgcagtgcagcgcgctcgtttatccggtctgtgaccagtcacagaccgatcagatcgtggattaggtggcgacaggcggtctgacacatgcctcgctccatcccgtcaagatgagagcctccaagcactcgtccctagccggagccggcgtgttacctcctggagatggcacgttggtcccggtcagatatatgccaggcttcatcctaaccattacaagcaagatattgtatgaagaagggcgaacatgcagattgataaactgacgcgtggtggacaagaatgaccgatttgtgaccggtctgacactggtcatatcgtcagcagacagccatgttcccacgtcgcgcctgcttccggcggaagtggaggtaggtatgggccgtcccattagaaggtcat

SEQ ID NO: 29174 - DNA, 3937 bp, Oryza sativa
tctttgtagcttcttcatacacagatccaccagaacacaggagtagggtattacgcttctcagcggcccgaacctgtatacatcgcccgtgtcttgtgctttttccattctcgcgagccttccacacaccgagagcttagaatctcacccagggcccccggccgaaccggcaaaggtgggcctgcgcggtctcccggtgaggagccctacgctcctcaccgggatgggccagggctgcgaggacgacggcctgacggagacgggataaaatctcgtggaaacggtctagctctacgctgctaccggccactagtacgtagacgtgtgggtgcaagtgtgcaacgcgtacgcgcacggctcagcgtacgcggcccccatggatgcatacgtacacagtacacaggcgtacatgtacaggtttgtgctttcggtcgacgcatgcgtggttcccctgcacgggacaaggagatgagcaaaagcgattgatgccaactttggggcaaaggccggcgcgcgggtttttgacgaattcggcttcgctgtggcggaagtggttttcacgggcgaggaccaacggtttgcttttgcacggcatggggcgctcgtctttgggcttatactttaagttacacggttgatgggcttcggggtgcaggttttgccggtcggtgagatgatggaccatgtgctgacgtgcatgtatttgggcggttgggccggctaggcttcggaagaggcgaaaagcggaccgggattggcatagcgggtttggcgcggtcaattccacacatgattagtaggcacgcatgtggttcccatcttcttttttctttttttgtgggggaaaggaatcaattactcaaaaataaaatcgacttttacaatctgtgctaactcatcacaattagaatctaaccaagaattcgaaaaagcttcatatctagccttattagctaaagagtggctaacaaagttttgacttcagtgattttcccgagcaagatctccctacttccattcatgtggtcacacacctctctaactaagaaagccaattctgacaaattcttctcttttgtttggatcaattgcagcgctagaaagcaatctgtttccaaagcgatcgggcatagctagggtccattgaagcgctagaacaatcccttttctgatcgccaacaattcagcttccagtgcgttgcaacacctgttcagataagtgcaagcagcggaaataggtttccctgaacacccccttttttgtggctagcctcaaaggatccatcaacattgatcactttcatccaaaggatccatcaatattcactttcatccatccaatgtaaagctaggatttggtaaatctttttatctcgactagtaaaaaatctaacatatttccgtcgtctcatatgacttcatagttcctcgcacgatatcagttacaccccacacgtctgactgcacacgtttgcgacataccttagtacctcagagagcccgacactttctactctacttagtctctttgctcttcagtggagcacttgactccgtttgcatcattgcatggactcctaccgtgtaggttgtcactgcatcactattttcccttcctttttctttttggaaaattttattacatgacacccaaagtttgtgtaattttctatcagacatagaaaagtgtgctatggctgcatgataccctcaaattttgataatttcctgaagaacactttcggctcgattggaaaaattctttaaatagactagaatgcttttggggccacaagcttctaagttagtgttggattttaaaaaataaaaattatgcaactctaaatcttccatcagccgaagtatattgctagcatatatcatattccatcaacactccaattctaggttagaagtttttggctataggggtattctcgtttttaaaaattctctttgattgggttaaaagtgccctatagcaaattatgagttttttggtgtcctccaccgtgacacgcttttgcgatgtctagtagaaaatacacaaactttgagtgtcatgtgacaaaatttgactttctttttcccaattcatgagaaatattaaaagtctatgatatggtgtgtatgtggtagaaaagtttataagcggtgaattattccccacgcttgacatcctttgtttctgttcactaatattttccattgatttattgatttttctgttgcaacacacatgtcctttgctagtaaagaaaaaccccagagccaagaatacgaatataaagataggcaattatcacaacaaagagaaactaggagagcaaacaagacgatgcagccaattgcctttgcctttacatcaaaatttgcatctgcatatgtataattatggtgattcacagccccgaccctgaaagactgacaagccatacatcctgtacttaaataattaaatataatttctttcaattcccaagatacagcaaggcatatatgataccatacgtgcttcaacctatgatacactataacatttatgacacaatataacaaacttctatttaacggcctgattctagacactgaagttcactattgatgctgaaatttcctgtattctcaaccgttgagttgttgatctcgtaagaagagtccccaagtaagctctccatctcttcaggattttgttgtgcccatggatgttgcattaccttcctcaacctatcgagcttgtctgcaacttccttcatcaacggtctattctcaccagacatttccaagcattgctttgctaactctgcaatctcttcaagaaactccaaattatctcccgtcatgatttgatcatctaaaatatcagaaagtcttttttccttcatggctgatagaaacctcatggctaggctcctctcatcttcagggctttcaaggttgaatgctttctttcttgtgagcaattctagaataacaactccaaagctatatacatcacttttatctgttaactggcatgtttgcatgtactctggatcgaggtatccacaagttccttgaacgagagtgacgaactgcgactcatcagttggtgctaggatggaagcaccgaagtcagaaacttttgctacataatctttgtctaagaggatatttgaggacttgacatcgccatggaggatcggtggtgatgcccatgagtgtaaataggcaagagcctctgcagattcatgtgcaatacgtaagcgagtatccaaggagatgtgttgattgtggttcccgtggatgagagagaacaatgtgccatttggaatgaactcatagacaagcatcggaacttctacttcgaggcagcaacccaataatttgacaacgttcctatggttggtttgggacaagattagcatttccttgccgaattctttcttttgtttcatatcaattgtgatgcatcttttgacggctatttccgtgtttcccttgagaagtcccttgtaaacagttgcattgcctccttggccaaggacttgttgtttgtcaaacttgtttgttgcttgttgcaattcttcttctgagaagattttgaatgaaatgccttgttgagattttatctcttcgaatagcaacataccaccatgttggcggaagtaccgccttttgacatactgtagctttctcttctctctgatgaagcatgcataagttactataatcactagtaatacggccccaacacttgctcctgcatatataatagaaaactttagaattgctatgaaaagattattggaatgtgtagttgatccctttatgctagccccaaggaagtcccacatatgccacatcggcattggcagaggaagattcactaaattatttttttctttagcaacttgaggagttcgtgaggatttcatcattagttggaacatgaaat

SEQ ID NO: 29175 - DNA, 31247 bp, Oryza sativa
agtttccagggtagcatgagcaggtgaaattccccaacgtattcttacatattcccggacaagggtaagtagcattgtcgaggcactcattaatatctgaagccaaaccatcaacacatttggttaaaattgttgcattatcttatacatttgtaacaaagataggcagcaggcataagaaggtgtgtatgactatacctttgcatccatccttgacgtatggattgccttcatatccatcagagcacttgcagcggtaacctccctttggatcatcaacacaacgactttttccactaatgcatgcatatgaagtagtgtttcttttgactcgatcacatgaatccattgttatgatccaatctagggaaaccttagctaacccattgtatgtgtcatagaatgtagtggagttgaaataatttttgttgaagttgaaggttgtggtttccatcactgttatgaagctgcaaggactgctgttattatttcttttactgaaataagtactatagtaccatgtgccattggggaaatcaagtttgcagcaacccgcttcaccggaacatataccgtccttggggtcgtttctgcatgagggcacacaacctgttaaaacctgcacatgttacgtattatatatacaccttaatacaagatttgacaatgatccaaataattcccccccacacacacatcctatttgggaattgacacgattttcaagcacaccctttaattttgagaaaggccgtgtttagattcattttttttttgccaaaaacgtcgcatcgaatgtttggacacatgttagagcattaaatgtggacgaaaaaaaaccaattttatagtttgcatgtaaattgcgagatgaatcatttgagcctaattacaccattatttgacaatatgatgctacaataaacatttgctaatgacggattaattagtcctaataaatttgtctcgcagtttacagacggaatgtataatttgttttgctattagtttatgtttaatactttaaatgtgtgctgtatacttaaaaaaaaattggccaaggaactaaacacaccaagagtatgtttgtattcacaatttcatatactccatcaaaagtatcaaaaggctctgaattgtaggtaggcacatgtatttccattgaacgaatatgctcatatgtactccttactcctaatgtcgatggacactaatatgaaatgtaggatttaaacattgataggcttacaatcacaccacccagccatttggccacatgccaacttccaaccactacaaaattatatatacttatgctctgaatttctcatatatacacactacctccaattcacaagtaagtgttgttttggatacctacacaatcaccaatacatcactttgattattaattactaatattaaaatgtacacaaaatatagcacatttataatattttgaaagtacttttaaaggaaaatattgtcatatcgttttcaaaagtcaacttgaaatagcagcggtcaaattttccacacgcattccacatgcatgtgaaagggagaaactaataatattctcacatgacaaatcctaagtcgtccttgatatataaaggaataataatttagactatcatgtattttaaaggccatatattatgaacacatttgagtatttgtgatctaatgcaaccagattgacgaattatgggcatatacttacattattgatctgcatatacgaaaacgtttcgcacccgatgacgatgatcttgttatccctgtccgatatccagaaaggcgagcggctgaagctcacagatgttgtgttggtgttgtcctccctggtgcccgtcgactggttgtagcagttcttggatatgttcatcttcatccaggccttgccgtcttccatggagatcttggtcacctccatacccctgaagaaaggcttgctggtgccgtcaacgggcttgcagtcgaacttgaacgggtagtttgtgtaaggcgcctcgagcccgcagtgctcgccgatgccgaacgggaacgggatgtccacggcgccgcacttggtcgggcagcccggcttcgagacggccgccaccggcgccggcacgttgccggctgcggccggcggcgccgagacggcaaggcagagcagcagcagcgacgagtactgcagaagaagcggcgggcggctggccattagcggcctgatggcgatggcgatggctctggctgctccggcgaaagatgtacacaaagagcaagcaagtgaaaggacttatgtgatattctaatgacaaattaagaacttgtgtgtcagtccaaggcatatgatgccgtagctttatattaaaatgggttgcttggttgggtgcatgcactggcctaaataagactctctctgcttatgttggatgcatgcatgttgttattgaaatgacaccagggaggcttcgcagaaccggtcgtttgatactttgatgtatagtgacaggtctatggtaattggaagggcaaattttacgatacttgaaaaagtatcgacgtatgaattttggtatctcgaagtgatgtacttaaatatctggagcagggtataacggtttgttttctctatttctataagtactgatatagctgaaatttcggttcaaaattatttgtaatgttgaacaaaatttgattaaataggaacattttttttctaaatacgcgaaaaaatcacccgcaatcatctcgtttttttgggtgtgttttgggggagggggggggggctcgatggacccgaaatgttagaaatttcagttccaaattttaaatcttaatctataatgctaattttttttaaaaaaaatatgtaacttttcggtaaatttttaaaaaggtaaagttacttagttggaagagctttgtatgcttaacactatcaaagacagtgcatgacttgatacaggtgctcgtagttacgactaattattattttagttatagacgatgtacctatcgacaacgagatgtccgtagtgatgacttcattattctcaagatatactgatctagtctttagaaaatgtttatagggataggatgtgtgtatttatgtttacaagggtgagtatatgtatgaggacctgcgtttgtactgactttctttaggaaaaaaaaagacattgcgtatgacatcgacacgctgcacaaaattccgcgcgctatactgctagccggtggtgctactgatcggctacgtgcagaattgatgtacctttattttttcacatttttgaagagaaacgcattaatgtctgatcaaatatacgtgtcattttgatgcaagtggatacctagtccattacaggtcgtgtttagttcgtgtgttaattttttctaaatatacggacgcacatttgaaatattaaatataggctaataacaaaacaaattacagattctgcttgtaaactactttctccgggttgataatacttattgttttggacaagagcacggtctccaaaaaataactttgaccattattttctattataatatgtataaaaatgttaacaaatatatgattttattaaagtactttttaagactaatctatacatgtagtcaccatatttaaaagacaaatattttaaaaataattgataattaaagattctaaagtttgacttcacccttgtctaaaataacaagtattatcagcccgaagggagtacgagacgaatttattaagcctaattaatccgtcagcatcacattgtcaaatcacggcgtaattaggctcaaaatatttgtctcgcaattttacatgcaaattgtgcaattggtttttttcgtccacatttaatgctccatacatatgtccaaacatttgatgtgacaaaatttttgaaagtttgaagggaactaaacactgccatagttcaaagtgctatgattagatagggtccctgtgcacactagcttgaaaaaccgtcggagtgaattatgctgtgtgaaattcatatgtccaatttactctttggaaaggttagtgtgagaatccttgagtctgtttggcaaagttccagctccaacgccagttttaccttttctggagctagagcttagccaaacaatttcggctacctagaataggagtggagctacgtggagctttctcacaaaataaaagaggtggagctgggtttaggcaactgtaatagagagttggagctgggtttaggtagcttcacaacttcactacagacccaactcctgaagttaaatttaggagttataactttaccaaataggcacctagttatttgtgcttctggtcgatccatgcttgatgctttagtttggcaagttgatgcaatggtttctaaagccacacgcttcagacctaaatttggatttgacgggagtgcatagattggggtaggagaaaattaataaaaaaaactaatatttctcagtaacgagaaactgcaatataatgtttcacattccatgaaattattagttgtcgcgtacgaaatgggggaaacttgtagattttccggtaattagccgatatttaatgactagtgagccctcaaaggaagactatgtcaatatgcatgtgcacttaactcacgaaaacgaccttactacctgatggtaatgggtcctttgttttgttaataccacggtctagaagatcttggcttcaacttgggtatgtacatgaactagctagccggtgtcggtcgcatatgcatcgaccattgcatgttaccacaataggcacacacatatgaaatcttcaaattgctactagcgctggctggttggtagtgatgtaagtggactgagctgcaaatcacttatagatcaaataagtataggtctggttaccgtacctaggaatacaaatgagttatcacgtgaactcacttgtagactaaattattgggtaatccaccggtcaatttgtgagttacccactaattttgtttatgagtggattcatggatcgatctatttgcatccctactgattagaactccttatctctggcgtgtaaagcaaaacacgcatagcacataattaattaagcattagcttaaaaatacttttaaaaacggattaacatggtttttaaagtaattttttatagattttttttaaaaaaaagcgtattatttagccgtttgaaaagtatgcacgtggaaaataaaaaaatatgagcctgggaacaagtcgtcgctgatgctaatttgaatttctatattgtcgcaatcatcgatctgcttgccctccaaagccagcttacacacaacacagcaatgaaaatggcacggcgtacatcttgaggacgataaggcatgcaggtcctttctccaggaaacaaaccataattaattaagtatcacaaagcaatcatggtaaaagtgttacgaggggatttatccggtaaaaataatcaaataagtgaaaatccataaaaaccaaacttaaaagttttataaattcataaaaaaattttctagagtgcatgcatgaaatacattattatcaaatatcaagttcaattcaccttattatggagtaataaaaagataaatttctaggtgaatactaacgtaatattcccttcatccataatataaggcatggtaaaagttgacacggtctccaaaattaatctttagattataatttctcatatactataagatttgtagcaacaaaagtataatcatatgaaagtaaatttaaatgtcaatctaatgatataacttttaacaaataaaattcatttcatattatactaaatgttggtcaaatattttaaatgttaaatcttaaaatacgtgcgcgccttatattatggaatagagggagtactacttacctgaaatttgtcttttctttttctctctaaaaggaaggaagttgagtttggagttaagatctggtatgaatacattttatgactatacctgatagtattgtttttataaatttagaaatcttttaggcattgtttttatgaattttcactggcacgatggttttcaccggatattctccctcgtcatgaggaaaaagttcactttggctccctcgaatataggtcaaaacaagagtgcatccctcaaccgtaaaattagatataacagctccttcaactattaaaatcagaacaaaatgactccaaagacaacgttgaaagtggtttttacttaggtggccgcctatagtcaataaagtaaaaaaaatattcatgtgatccacatgtcggcgacttggcgtcctttctttttcttcactctcttcttttcccagccatatcggcaatacggccctccgcgacgacggcgccctacgctcactcaatccgccttctcccccttctctggcatcgacaaggacggtgatggcgctggctacagctagccacagttcgcgacgctgcagtcccacactcgcatcccttggggcgttggattgacgtcgtggtcccagactttgcacacaaccggccggcaaaggaggggaaggggagagggaaggtggtgaggaggagggtgtaggagagggtggagccgatggagagcgggagcaaccaacggtgatcgacggcagcggcggtaggggagagggcggtgccggtggtgggctttcatctcatttcatctcgtgggccttgcggtagctctctactattggaaagtaatgtgtgtacttttcttcatcagtagtacaggtggtgtggatgaactgaagcaactaaagtcataaacaccttgaccaaccaaccaaaccaaacaaaattttatggcatcatatgattgaaagcttgtattacctaaagcaagcacaagtgcacgtagggtgtcgacgatgcccatcacctcaaatggccctggagatgccggagaatagctgttaggtactgcgctgccggcgctacaacggcctcgcacatatgctgccacgagtgccgctacaagtgcaaggccatctgcaccgccttacaccacatccaagtccagggccatcaggatgtgggcaaggctaggtggataacaatcaccctgccttccgtgacggcaacgtcgcagagggcagcatcgcgaaggtctgctagccgcagcctaccaccactactacacataagatttttctagacagggacctcccattttctcgtgcggagctttttcatgtgcgtctgtaaaaatcactcctattttcacgtgcgggcctcctatttttacctgcggatccttaagaggccgcacgcgaaaatcgattttggcaggcggccctcttaacatgcccgcacggaaaaatacacaattttcacatgtgggcctcctaatccacccgcacaggaaaatatccattccctctcaacctattcaaaaaatttcaaatttccttctctctctttttcccctccgcccctctctcctctctgtccccctttaattatcttctcctcactatcccctctctctctctcccccggcccccttctctcctctctctcgcgccttctccttctccttctccttctccttcggtgcgacaggagtggcaggctcggcggcgggagaccgccccccgcccggatccgcgagctcgggcggcggccgggtgcagcgacgggtgtttctagggttaaggttaggttttttttttgatttttttctattttttgtttggcttttttttttggttgcgtgcgggcggtataatttgaccgcatgggataatcaattatcccgtgcggtccacttaacccaaccgcacgggtgcggttgggtgcagacacttggctacagatggacaaaagctctgcacggagaaatccttcttgtagtagtgcacggcaccaccgcctctaccgatgctgaagaagggggagaaggcggatcgagcgagtgcagggcaccgttgttgtggagggttgtattgctgagtggtcgaaaaaaaagagaggggagaaaaagaaaggacaccgacatgtgggccccacatttattttttagtttatttagtgactaagctgccacgtggatgccacgtcagcgaaaaccaccttcaatactatcttaggagtcattttgtcccagttttaatagttgaaggagtctttgtacccggtcttacggttgagggatgcactttagattcgacctatatctgagggactcaaactggactttttgcctcgtcatcaacagctctgctgatgtacgggccagttatccgttatccaccacgaggcccaattcgaactacagaaccatgtaaaacccaattaccgaaacaaaagtcctattgggctaccagtgccaccaatctgaattttggagcccatcaacactggcctctttttcacctcgcagcctcgcaccgcaagcccaagcagccgcaggtttcttcccctcatcatcaatcgatgcggcggccgagagacgggcggaccggcggtaggaagggcggcgccgccaccaccgcatcaagcaggcgcggaagaacgcctagatcccgtcctccggtaatctcctgccgccaccgcctgatgcagcatcccgaggtccaatgctcccatcccaaccctcgtgtgcataactgcatactggttggagtaccaaccctttttttagttgttggttagagtatagatttatagttctggtttaaattaagcgttttaatatttctctaaaaagtctatgttaattggagtaggataacaatcggtttgttcagaaactgccttcagattaatccttttttttatataatttaagatgctgatttatatttatgtatacttcttacaggagcagacaacgattctcaaggaagggtgggacaaatagtttgatttcaggagtatatgctcccaatacggatgccattaccagccactgtaggactgatgccattgtgaggtaatgttgttttgctatgaaacaatttacatacacatagttgctctattttttttctttggttcaattggtctgatggagattgacctatgggtaataaaactatttttttttcaattggtctgatggagattgacctatgggtaatagaatgtttaagcggttggcttacaagcaaagtatattatgccactctcttgattattggagtatgcaagattataatgaacggtagtttcttatgaggagatctaattatagtatgtcggcaggccttggtgttcaatatatgtgcaggtgaatggttactgataagctatttctgagaataaataaacttgcaaagcatatggatcctaacctcttgaaaagtacatgttgtcgtgatttgttagcagtatgagaattgatcaaactataaaaagaaaatgtgtgtcaaatatcaaatcaattactattgtacatagatttttgaaaggtaaagctacaatagcaattgaaacaacaacctcacctttggatcttaacaatgatgcaaccttgagctacacatataaaacatgtatgaatcattccatatatgatgacgattacctatacatgtaatacttttggagtatacctatataatttcctgggatatgatatacaacaaggttattagcgattatcttcctgattctaggcctattaaagatttcttctcaatgctgaaatttcccgtactgacaacctccgagctaacaattgatgactctcctagtaagctctccgcctcttcaagattgtgcagtgcccaaggatggtgcaaaacctttctcaagctatcaagcttttctgcaacttccttcattgatggcctattctcaccacacatttccaagcatcgtctggccaactcagcaatctcttcaagaatctccatattctcctcgctcttaatttgatcatccaagatttcctcaagcttgttctccttgacagcagaaaggaacctcacagataggcttttctcatcctctagcccgtcaaaatttaatggtttctttctcgtgagtagctctaggacaacaaccccaaaactgtatacatcactcttatccgttaatttccatgtttgcatgtactctgggtcaaggtacccacgagttccctgcacaaacgtgacgaactgtgcatcatcggttggcgataagatggaggctccaaagtcagagaccttcgctgtgaagtcaccatcaaggagaatgttggatgacttgacgtccccgtggaggattggaggcgatgcccatgagtgaaggtaggccaatgcttcagcagactggtgagcaatctgtaaacgcgtggatatagagatgtgcctgccgtggccatcatgaatgagatggaacagtgtgccatttgcgataaactcatacaccaatattgggacttccacttcaaggcaacaacttaatagtttgacaatatttttgtggttgacttgggataagattaccatttctttaccaaattctttcttttgttgctcatcgattgtcttgcatcttttgattgctacttcagtgttgccgtttagaaatcccttgtaaacggtgccatgtcctccatgacctaggattttcttttcatcgaaattattagtggctttctgcaattcttcttccgtaaagattttaaatgcagtacccttcatctcctcaaatagcagtcgacctccatgctgtcgaaagtacttctgttttatgctgtgtagcttatttctttcttggatgagatatgcacacgtcacaatagtcacaagggtgacaactccaatacttccacctgcatggtttccaaagtgatgttactccaaaatgatgatttgaaagcatttccggggttttcaaccttaaattttaatgaacatgaataatatgattgattcctactatatgttcagattggttttactgtaatgcgctattatgttcaagattggtgtcaatgtacaatttctcctttttttttgagacgctgaagagtgtaacggacctatgacaggtataatccaagaagaggaactctgcttgcaaacaccgtcaatcagatgttttcctcgttgacatgtacatgtgtagctcccctgcgtatttatgcaaattcccgtgcatggatgagcatcttggcactcgtcgatatctgccaaaaaaagacttaaaaatataatactttttctacatctcttaatttgcaggggtagaggaatcaaaatggccggaaagggaccttcgcatccatccgtgatgtatgggttgcccttgtatccatcagagcacttgcaacgataaccgcgaccattggtggcatcgacacagtaactgttgctactaacacaagcgtaggaagttctgttctcttttgcttcctcgcattttttccattcaactgtccaatccaagacagtgggaaccatccccttgtacgtatcactgaatactgtggagtcgacataagtggtactaaagttgaatgctgaagtttccatgactaccatgtagttgcaagggctgctcctccatattgcagtggtgttgtagtttgcattgaaataaccttggtaataccgtatgcctttcgggatatctgcctggcagcagccagcaccagagcatgagccattcttaaggtctacgttgtcgcatgttgatgagcaaccgattacgtactgcatggattggcgggttataaactgcaaataacagcacgaccccatgagagtttgcaattatatttgttaaaacaagtgctgcaaaacagatagctttcttaacatagtagaactaggattagtgtcttcaacatagagttcatttgtgattcatatggaaatgggctctaagccctctttggttgtgggcctgttcggcagctgcaccttgcagccgaacatgccctgtagtgatatagttggccgcacacaaaatccacccaatcaagttctttttattttttttgggagggggaatttcgacttatatgtatgttatgacaagtcgaactagttttcacatgtcaaacatgtctcatttgaaaaattaagatatgcaaagttttttacagaaaaaaattgaatcctaattttacctacattacccttaccctttgaaacaaggataaatgattgcacattttttgaatcaaacgtcaaaaaacacataaatatccaatttagttccagtcaaaaaaaaaacatgcatcgacaattagaaatgacccatcaatataacataatgattatattaagaattagtataagaccttacatgagaagtcagaaattatgagatgcaactagtgaactagaatctatagaagttggctttctcaacttctgacaaatagtttattgagtgaattgcactttggcctagttgagtgaattgcactttggcccggttattattgcctgtgttttattttggactaggttatatctaacgttttcactttggtccaggttttcttaccttctattgcacattggaccacttttttgtttgccactccttgatttcattagcgagcttacccgcaacacaataaaccaatcaatattccacctgaccttgatttctttactcattgatttagctgcttgatttctaccatttttcccttaatttatcatgtgagcttagaacaagtcactgtattgagcttgcaagcgacagctacagcagccagctaccaccagtcttgattttgctggttcctcaagctcggaacagagcagagagagaaggaatcctggtactttgcttgatcatccctcagattccatagcgcggctgcttaatagagaaaaggagggaagattgatggagaagaagggtggtccaatttaaaacttttgtaaatttatctagtccaaagtgataagataactttatccctcgtccaaagtgaaactttggtaaaaattcctagcccaaagtgtaattaactctactttattttatggattctataacttttgagtggctgagaaacaccaagtacagtgggctagcttgaatgaggtaaagatgctctgttttcggaattggggttgtgaggtcatgatttgcgattaaaaagaatatcaacctttcctattccttaagaaactgataatgtataaaatatgcaaaaattacttaccgaggtactgcgcatgtaagctagtgagttgcaaccaacaacgataagtttgttgtcctcgtttgacagccagtaaggtgaatatctgaaactgttccatatgtcatcgtacaaggttctgtttgtttctgggtcgaagcactgggaggatatgttcgtcttcatccatgcttttccgttgggcacggagatgttggtcacctcgatattgtgaaacataggcctcgcggcgccgttcacggacgtgcagttcagctggaagcccctgctgtaggcgcagtctggcctgtctgggtcgatgatgccgaaagggtaggggatgtcgacgtcgccgcaccttgtccggcagcccggaggctggccaccggccggaattgcgacgtcggccgcggcaagcgtagcgatggcgccaaggtagagaagaaggcatccgggaagaagaagaagctgatgacgctccatatgctgcacttgcttgtccgtactccttaggtagccggtttgttgtgcgttttggttggtgtgcttgggaatttcggcagcggcctccttaaatatgatgggtaggatatgcttgtggcgatggaaaaagaattcagagggggataaacttgtctcgctcgtgagattctagactaagtcccattttaagtgtaagtataattttctgcgtccaattttaatcgttcgtcttatttaaaaaaaacttttgaaaaaaaaaattaaaaacataagttacgagtaaagtattattcctattttatcatctcataataacaaaattactaattataaaaaaattttaaataagacagatgatcaaaattgggcaaaaaaaaactcattattatacacatgaacttaaaatgagacagaaggagtaataaagatctcgaaaaatgtatatttgatcataaatatattccaagaattatggacgacgacttactcccgggtcttcacgtcgaaaagaaagagtgcatatatttttatttttcaaaatgtttttcctccatcgtaatcgatcctccagctctactaactacacataacaacggaagacttcgaacgactgacgtgacttaagcgcgtaggccatgcgtgatagcagcattgagtgacaaccgcttcatctcccctgttgtcatccatgttaattctatcctgccactgtagcgagaggtctttacctatgtgctattaaaaaaaaaatgatgcctgcctctgtgtcactaaaaagttcaagtctccctctatgccatcgtcgaactttatcgcgccctccacatcattccatctgttttttttctaacagtgggtaacggcgcagccaaatgagtttgttgcccatggggttgcttggcgacctcacctggcgcgtggcgcagccgatcgaccaggccgcgatggccgggtacgacgccctcgtcgccgacgtcgaggcgtctcttgcccgcgccttccggatgctgctcgaggccgtcgaccgcaagatcgacggcgaggtcggcgccacccacggggagctcgccgcgctactggaggagagctggagcttgagggccagctcaagcggctcgacgccagggccgatgagctgagcgatgcgcgccggatcccgtccgcgccacgcctgtcctccaccgctgccgcccgcgccgactccgcggcgagcgcgaacatcgccaccgcccgctcgatcgccagcgccgcgcctgtcctccaccgcgcccgcagccaaatcggcccgcgtgagtgctgccgctgcgcacggccaggccgactccgcggcgagctccacctccacggccacgtcgccctgcacgacagccttctcttccaccggcgccgccgtccaccgagccgaggcagcgacaccgccggctgcctccccatccggcgccagaccgcctcctgcctggcgctccgtcgacggtgctccccggccgtctcctcctccattttgccgaagggccaccacggccgtcggacccgcatcgccctccctcaccttgacccacgctgctgcaaccgtgccgccgcgccaagcaccaggcgccgccgtgcccggccgtcgccgcgccaccgcgcgctggctgccgctgcttgtgtgcgctcgcgcgtgggagaaagggggaaggagtgagaggaagaaaccggaggaatcgaccaccaccacccctctccgacgacgacaccactgagagacgcatgtatgcctccctgtcctcctccaggctgccgccgcgccgccgcactcaaccgcccccccccccccctctctctctctctctctctcgcactcaaaagaagaaagggcaatagagacatttttttccgcccggcctacatgtcagagctgccaaacagttaaaccaaaacagaatagcgacggaatggtgtggagggcgtaataaagttcgacgatgacatagagggaggctcgaactttttattggtagatagacatgctccatcttttttaatggcacatagggaaaaacctccgcaggcgaactactgtgagctagcctagctactggtctcagcagtgtgtacaacagtacaaggaaatttacagcgacctgataagtgaataaacttgatccgttcaatttgtgtggccgatagtctaactgtaccaatcggccactgttcacatcacaatggccctgctttaatccaagaaaaaatttgagtaaaaacaggccgcgttcacctgagaaaacctggcctcgtccatatcacacaatttctcggcaaccagaactgtcacaaggtcggtcttttctagtgacagttctggttctcttcgctccgctcagtatcatggaagactcgactgtttcacagcccacagggtcctgtgacttcgaacggtgaattccgcgtgatgctctgttgcgtgcaagactacaaatgtacattttccattgcgagctttagctctattattttcggttaagattcagattttacttcgattgcatactaaagttactaaacggtgtattctctgcctttctgtttagaaggtactttaaaatatcaaatatatttatcaagtttgtaataattaaaacttagttaatgactttctcgtttcgtgcgtgtcaacttaatttttattttcatccgcttcaaacacagcttttataattaaaacacagcattgacaacttaatttttagagatggaattgctgaaaaatgtccggaccaaacgcagcttttgtcaatgcgcaaccgagtacgatgagacaacattttttgggtttagaagttggttaggataggttgcaagatgcatgggtcagcatatcttgcaaggtttggtcaagaaaatgctgaaaccaagtgtaccataggcaattaccacacggtagacagaatcacatataaatcagtggggaaaatagtacagcgatagaaaattaacttgacttcgtatgatttgcttcttattctcatatatgatgaaacatagtcccataaagactaaaggtgtacacaaacaatatttttttatttttacacaaaatttttttaataatgaacataactgagtctgaatttctagggtaagtgaaaactatgatacaatatgacgcggtatgatatggtgatatgatgtatgctgggtagcaaagagattccagcttaacgccctgatgctaggtccttgacaactttcttctcgatgctgaaatttcctgtactcgaggctcctgagcttataatgtaagaagattctccaagcaagctctccaactcttcaggattttgttgcgtccatgggtgttgcattaccttaaccagcctatcgagcttctccgcaactttcttcatggatggtctatcctcaccacacattgccaagcattgctttgctaaatctacaacttcttcgagaaactccatgttctcttcattgctaatttgatcgtccaatatattctcaagcttgttctccttcatagctgagagaaacctcattgacaaacttttctcatttccaggagcatcaaggttgaaaacgttcttccttgtgagcagttctagaagaacaactccaaagctgtaaacgtcactcttatctgttaattcacatgtttgcatatactctggatcaaggtaaccccaagtcccttggactagcgtgacaagctgtgacttgtctagtggagctaagatggaagcaccaaagtcggagacttttgccatgaagttaacatcgaggaggatgttggaggacttgacatcaccatggatgatgggtggtgaagcgtaggagtggaggtaggctagtgcctcagctgattcatgggcgatccgtagacgagtaactagagaaatgtgttggccatggttgccatggatgagattggatagcgttccatttgggataaattcatatactagcataggaacttgtacttcaaggcaacatcctaatagtttaacaatgtttatgtggtttatttaggataggattagcatttctttaccaaattctttcttgtgttgctcatccattgtcatgcatttcttgacagctattttagtgttgtccttgagaagtcccttgtaaacagtgccatgaccaccatggccaagaatttggtttttgtcaaacttgtttgtagcatgctgcaactctgcttctgagaaaattgtaaatgatttcctttcatttgaattcatctcttgaaacagcagtagaccaccgtgtagcttaaaatatttctgcttgatgtgttgcagctttcttctctcgcggatcaagtacgaacaagttgccatgatcacaagtatgacaaatccaacacttgcccctggttgccgaatataaatttgtcagccaataacaatactaggacaaacgacgacttgacttagaaaagcaagcgttgtagtacgtaccaatgcactaataagataatcaatatgtaaatatatatatattagcaaagaatatctactgctagttgtagtacgtacctacaacaggcatcacccaagcttgggacttctgaatcttctgatctggaacacagacaccccgagccagctcattttgtccttgagggcaagaacatttgtaactcccgattgtattttcacaaattccagcgcatggataagtagtgttatcaagacattcattgatatctgaaacaaagcaaactttcgtgaatataagttcttattgtatactttgctgaatagagagagggagagagagagagagacagagagacctctgcatccaagaagaccgtccttgacgtaaggattgccatcgaaccccttggagcacttgcagcgataacctctcccattcgttgaattgaggcattcgctattgttgctaacacaagcatatgaactcatgttcgttttcgcttcctcgcatgtctcccatgtaattatccagtccatcacggccggaacagtcccgttgtagtcatcccagaagtttgttgagggaatgtaagtggtgctatagttcaaaactagaagtccagccactcacttacacagccttttccatcactaccacgtagccacaactgctgtagctgatttctgaggagttatagtctttattgaagtaagcctcaagataacccaggtctggcgggacatccaccgaacaacagccagcgccagagcaagaaccattttttggttgatcggagcatgtggacaagcaacctatgacatactgcataagtcacagatgttaatttgtatctatgacgttaaattaaatgagattatgtaacgatcagtactgagcgcctagtatattaatataagcaaaatgtcgtcaaagcataaatatgaggagatacttacggaaacacctctcatgtaggccattgtattgcaaccgatgatgaaaatcttgttatcctcgtatgagaacctgaagggcatgtaggtgaagttttggaaatccacccattccttcattttgctcgaggccgagtcatagcactaccaagagatccgcatcttcatccaggctttggcatcgcgcacagagattttcgtcacctcaaacgaccccttgaaaggcctcttggtgccgttgacaggcttgcagatgatgttgaagccatggtggattgcgcagtgatcgccgatgccgaaggggaacgggatgtcgacgtccccgcacctcgtctggcagcctgggtgtccagccacggggacgtcggcggctaccatcccgatggctgaaacgcagatcagaagaatggtggagggaagaggcttagtcattgcgtgtgtgtgtggagactggaggagacaggagagtgtgtgctttgctggggcgtgacgcggtgtgtgttaaatagagatatccgctttactgtccctgggcagcttgccctgcagtatgtgattaataaaagctggtggttgattattgatcattcccgatatgatactttcgtccatgtatataaataattttacccttttatttttttgggattttgtaatcttaagatagtattttattttcccatctatcaacttgtgtaatagtttattctttacctatcaacttttgtcttattttatccttccacctatcaccttttatactatggcatatccttttgctacttctttaaaaaaaatttaaatgacataattccttatagctaggcacacgcacgaggaattaaagtctgttgtcatgtactctccattctaaaatatatttttttaacagaaaccacacgagattacgctttttcattaaatatagcaggagaaaaatacaacccctaaaggcaaacattctaaaatatattaaactagtattagatttgatataatttaattctataaatctaaactagcatgatagtatcattatattttctctcatataatagcatatatattttcttattatattattcaaatatattaaaataataacataattttaaattttgcaataactttacgaaactactaatgttaatgtgtaatattcatatagtattttatatatgtgttagttcttaattatttttaatatcaaattttaattatttgtaaattatatatattcctacattgactctagactcgtctattaatatttcttttttttaattttaaattttctgtaaattgtatttctatatatagactctaggctcttcttccaatattatttatttttatttctgattttttattatttctaattgtatttctatgtggactctatactcatcttttaatattctttaattttgaattttgaatttcagttacttctaaattgtattcctatattaactttaaactcttcttcccatgtttttcttaatttcaaattttagttatttgtaaattatatttttatacggactctaaactctactttaattttattatgtttatttcaaattttagttagttttaaattcctatatggactctatactctacttctaatattccttattttttaattccgaatttctttttttttcttaattgtatttctatatggattctatactctacttctaatattccttatttttaattccgaatttctattatttcctaattgtatttctatatgaactctatactctacttctaatattccttattttttattccgaatttcagttatttcctaattgtatttctatatggactctagtctcctattctaatattctttatttttaaattccgaatttcaactatttctaaattttatttctatatggactctagtatcctcttctaatattcattattttttaattctgaatttcagctatttctaaattatatttatatatggacactgttttttctttttctttgattaatgtgagaatttctagaccatgagagcgaacgtggagactcatttttctatgcctttaataatataatagataggttcttgttcaatttcatactactaaaatatgtcttttatcccgattgctatattttataatacgtggcgtctaaaggattcaggatggtccatcaacgaaatactcgccctcgcccatgcacgctttactcagtcagccggtcagcttagtatatgtcgctctaattggctggattaactctagggtcccagggagacttgccaagtcaatgccgctgttgttgagctcagagcatatcagagcaactagctagctggagtagcttccaagaggtacagtagcagtcggtccacgattgtggagactgatgaatgagtccaagtcttgtgtgactgagacagtgagacgtgtgattcccccggaacaagttggaggttggagtagacaagtgttgcaccagctaaaaagactattttttgtcttgctcgtattagggcctgattagtttaaaaaaaaattttcacgctgttatatcgaatatttggatacatttatagagtattaaatgtaaaaaaaaaataattacacagttcgccaggagattgcgagacgaatctttcaagcctaattgcactataatttgacaatatggtactatattaaatattactaatgacagaataattaggcttaacaaattcgtctcgcagtttcctggtggaatctataatttattttgttattagattacgtttaatactttaaatgtctgtccgtatatctgatgtgacatgtagggcaaattttttttctaactaaacaagcccttaatcctctgtctagccatcccgttgatatatatatttttctaaacttaagcccttaaacaagcccttaactccggatcccaaacttttttttctatttttctagagcaaagtacacggccggtccttaaagttggaacgaggtgtcacttaggtccatgatctaggaaaatcgtcattcgggtccgcggtcttgtttaagtgaatcatttaggtccaaagcgcctttgattggattgactggcttacgtgaccgtccacggtggcagcatgtttgcattttagcccccctcccatcttggctcccccttgtctctatctcatttctctatctccacatgttgtcagttgctgaccaccacgcgtgcatgcatgagccactagctgcacccgccgaacaccccggagccgtcgcctgcacccgcgttgtgcgtgtcctgggagaaaccgagcacggtctgagcttgttgttgctcctgctgtggcggtggcggcatgcggaactcgccgagatggaaccccacggctgcatactccgccggcatccctagcggccccatctgaggcagaggaacgtagcagccaatgctcctcagcaactccatcgccgagaacacgcacccacgctgcccctgccaccaacgccgttcgccaccgccatgttgcctccggggttgcacatgttgctactctccaagctcgggaacgctgtgaactccggcgactgcagggcgcggccgtggtgatgcgggaacgccaggttgaggtcctacgcgcccttgtgcatcgacttcaggttcttagccgccagccccacggggaccgagctagacaccgtcgcggaggtggaggccgacgcggccgctgatgacaccatgaggacgacgaacgcttgttctcccttaccgttgccgccgtacgcgcctccctcatcgtcgttgtcgtcctcgcggccgccgccacatctacaccgccacccaatcgccgttgcaatcgctaaccctagaaatcacacaggaggagccgaggaggatttgggggagaatggttggatcgtatatgggagagccaagatgcggggggctaaaatgcaaatatgctatcaccgtggacggccacgtaagccagtcaacctggtcaaaggcgctttggacctaaatgattcacttaaacaagatcacggacccaaatgacgattttcctagattatggacctaagtgacacatcgctccaactttaaggaccggccgtgtactttactcatttttctataagtaaattgcgacggatggatatgatttagaacaacaacttgaaattcgaactaactggtgcagtaactttcttggtttgtgacagtttgtgtgggtttttaatccaaatgagtgccacgtcgacaatccagttattatagctagagagtgtgctcccatgggaaaggaaaaagtacaccgaaggtccctcaacttattatcgggataaaaaacgtcctcgaaccgcaaaaccagatatgcccaattttaatcgttcgtcttatttaaaaaaacttttaaaaaaatttaaaaacataagtcagtaatgagtaaagtattcttcatgttttatcatctcataacaacaaaaatactaattataaaaaaatttcaaataatacgaacgatcaaagttaggcaaaaaaaacttatcgttgtacttaaaataggacataaaatagggcagagggaataagatctcagaaagtgtatatttgatcataaatgaagtatatcccaagaattatggacgacgactgactcccgggtctttacgtcgaaaagaaagagtgcatatacctttttttttttcaaaatgtttttcctccatcgtaatcgatctccagctctattaactacacatagcaacggaagacttcgaacgactgacgtaacttggcagtcatgcgtgatagcagcattgataagtgaataaacttgatccgttaaatttgtgtggctgatagtctaactgtaccaatcggccaccgttcacatcacattggccctgctttaatccaagaaattgagtaaaaacaggctgcgttcacctgagaaaacctggcctcgtccatatcacacaatttctcggcgacctggcgagcgatgtttatgggtcttgggtacaattggggggcttcacagggtcggtcttctctaatgacagttctggttctcttcgctccgctcagtatcatggaagacttgactgtttcacagcccacagggtcttgtaacttcgaacggtgaattccgcgtgatgctccgttgcgtgcaaaactacaaaggtacattttccattgcgagctgtagctctattattttcggttaagattcagattttactgtattatgtgcctttctatttagaagttactttaaaatatcaaatatatttatcaagtttgtaataattaaaacttagttaatgactttctcgttttgtgcgtgtcaacttaatttttattttcatccgcttcaaacacagcttttataattaaaacacagcattgacaacttaatttttacatatcgaattgctgaaaatgtccggaccaaacgcagcttttgtcaatgcgcaaccgagtacgatgagacaacattttttgggtttagaagttggttaggatgggttgcaagatgcatgggtcagcatatcttgtaaggtttggtcaagaaaatgctgaaaccaagtgtaccataggcaattaccacacggtagacagaatcacataaatcggtggggaaaatagtacagtgatagaacattaacttgacttcgtatgattgcttcttattctcatatatgatgaaacacagtcccataaagactaaaggtgtacacaaacaatatttttttatttttacacaaaaaataattaataatgaacataactgagtctgaatttctagggtaagtgaaaactatgatacaatacgacgcggtacgacatggtgatatgatgtatgctgggtggcaaagagattccagcttaacgccctgatgctaggtccttgacaactttcttctcgatgctgaaatttcttgtactcaaggctcctgagcttataatgtaagaagattctccaagcaagctctccaattcttcaggattttgttgcgtccatgggtgttgcattaccttaatcaacctatcgagcttctccgcaacttccttcatggatggtctatcctcaccacacattgccaagcattgctttgctaaatccgcaacttcttcaagaaactccatattctcgttattgctaatttgatcgtctaatatattctcaagtttgttctccttcatagcagagagaaacctcattgacaaacttttctcattttcaggagcatcaaggttgaaaacgttcttccttgtgagcagttctataagatccaaagctgtaaacgtcactcttatctgttaactcacatgtttgcatatactctggatcaagataaccccaagtcccttggactagcgtgacaagttgtgacttgtttattggagctaagatggaagcaccaaagtcggagacttttgccatgaagttaacatcgaggaggatgttggaggacttgacatcaccatggatgatgggtggtgaagcgtaggagtggaggtaggctagtgcctcagcggactcatgggcgatccgcagacgagtaactggagaaatgttctggccatggttgccatggatgagattacatagtgttccatttgggatgaactcgtacactagcataggaacttgtacttcaaggcaacatcccagtagtttaacaatgtttatgtggtttatttgggataggattagcatttctttaccgaattctttcttgtgttgctcatccattgtcatgcatttcttgacagctatttcagtgttgtccttgagaagtcccttgtaaacagtgccatgacctccatggccaagaatttggtttttgtcaaacttgtttgtagcatgctgcaactctgcttctgagaaaattgtaaatgatttcctttcatttgaattcatctcttgaaacagcagtagaccaccgtgtaacttaaagtatttctgcttgatgtgttgcagctttcttctctcgtggatcaggtacgaacaagttgctatgataacaagtatgacaaacccaacacttgcacctagttgccgaatataatttgttagccaacaacaatactaggacgaacagatgaccacttaacatttaaaagtaagtgaatctcaatattacaactaatgcactaataagataatcaatatgtaaatcttagcaaaaatattaatcttgctagacgtacatacctacaacaggcatctcccaagaggacttctgattcttctgatctggaacacagacatcctccaccttatgttgtccttgatggcatgaacagtcgtaaccccccatcgtattttgacaaagtccagcgcatggataagtagtattatcaagacattcgttgatatctgaaacaaaacaaaaatgtatatgttattgagtaaaagttttaagtgtatatatacacaaatcgatcatttaggaggtggaggatagaagtagctagacctttgcatccatccttgatgtaaggattgccgtcgaaccccttggagcacttgcagagataaccatgcccattcgttgaattatggcagtcgctattgtcgctaacacatgcatatgaactcatgtcccttttcgcttcctcgcatgtctcccttctgattacccagtccatcacagccggaacagtcccgttgtagtcattccagaagtttattgagggaatgtaagtggtgctatacctgaaagcagccttttccattactaccaggtagccgcacctgctgtagttccagatttgagaggtgttataatctttattgaaataagcctcgacatagcctaggtctggtgggacatccaccgaacaacagccagcgccagagcaagaaccatttgttggttcatccgagcatgtggataagcaacctatgacatactgcataattaagtcacagatgttaattaattagcttagtgtaaaaaatcagcttatcttgtgatctacgaattgagattgaaattatgtaacgatctggaagcatagtcacttaacataagcaaaatagatacaagtatttgttaaaatttccaattttgacgtcaaaaaggttgaaagcataaacataaataaaggaaatacttaccgaaacacctctcatgtaggccattgtattgcacccgatgacgaaaatcttgttatcctcgtatgagaatcgatagggcgtgttggtgaagttctgcccaaccatcgaatcattcatctgttttgtgaccgggtcatagcactgccaagagattcccatcttcatccaggctttggcgtccggcacagagatcttagtcacctcgaacggcccaatgaatgtcctataagtgccgctgtcgttcttgcagtcgaggccgaaaccaccgtggatcgcgcactgatcgccgatgccaaacgggaacgggatgtcgaggttgccgcacctcgtctggcagcctcggcgtcctgccgggacgtcggccgcggctaccacccagatggctgaaatgcagatcaaaagagcggagagaagaagcttagccatttcgttgtctgtgtggtttgtactgtacatgttctgaattctctgggctgcgtgttaaatagagacatacgctgccccttgctagctatatcgacgttgacgattgagagtacctgaccaatgccgatagaccgcgaggtcgctcacaatcacatcacatgggacaccgcattatcagaactattcgtggccagacgcccagactcggtcccagccgagcccattcgtggacgttgacgacgacgtggtgtatttacgcacataaagcagggtcgtttccgctaatttccgtcgctacgcacgtccgtgaaaacgcgaaccgatcgatcaagcgggtagcaagacttgcagcataggaacaggtgcatcgcgcatcatcgaaaggacggagtttcagctagcttgcctagttgcctctcgggcactacgcttctcagtaattagccgatcagctctaccgctcaacaaatctccctcgatttggcttggattaactcttcgttcctagggactagggagacttataataccaagtcaatgccggttgttgagatgagagctagctagcttccaagaggtcccgtagccatcagctagctcaggccatctccggtgtgctaaaaaaaaatcgaaccataggactaaaatgtcaacgaaattgctagaaaacttcagcaaatacttccaaaactttcagagttatagctatcggattgcctcgagatttgtgcataaaaagaaaaatattgctagaaacactactacacaaagacatagttttataggtgccggaagtgtatactacaaaatttatatgtaaatacatacgtatggtatattagactacacactagagggactagagggggtacgtcgcgcggtacctggggcatgcgcccaggcgcgcaataacaagctcctcgacaatacagttattacagatggcaagcgtgtgctctacatatgccaaatgggccgctaggcctgggcctgggccgagattagtcgggcttacacggcctaacctacacgttgggctgccccggacctacccacttgttgcaccatcggcaaaggtacgacccaataagactcgggccgtgccgggccggcccaaaggcacgaaagcgcatcgtgcttctccttagaaaaaaagtctattttgcctcctcccccatctctttggtctgcctcttatatggccttaataagtctattttttgcatccctcatctttttgggctgtgacttacatcgcgagaataagtctgttttgacttcctcatctatttaactctctgatcgttgaattgggccatgccgggccaacccatcgagccgaggcaaagggccaagcacaatccaaaggttgggccaagccaaaaccccgtcccatgggtcggaccgtcgtgcctcggcccttttggccaacttgtgctcctataggaaaggaataagttcaacctggtcccttaactttacacttaatccgattttcaaccttaaacccaaaaaccagatacaactggccctgaattgtcaaaacaggtgcaaacgagatccctcggtggtttggaaagcgcttttggctgacgtggcacctacgtggttagtttgactagatctttgtcccacgtggcaattcgatcagaaaaataaaaaactacgggcccacacgtcagctccacacacaaaataattaaagatagtggggcccacgtgggccccacatgtcatcctcactcctttcttccctcttccctctctttcttccttatcctcacgtttcatctcttttggggagaggcgggcaacaacctcggcgagcgaggctagcggcaggtggagtgaaccgacagcggtgacaccctcgccgccgccttcctctccaacgggtcgtcgtcctccgcggcctccgtggtggtgaccgtggcttctcacgctgctggcccaggagctgcaggagtcggagcgccccgaccgcaggctccgccgacgaggacgacaactccagtgccatcgccgccgcgcgcgccaagaacgcgccgccctccatcgccgccacgctcgagacggagatggagttcgacggcggcgacggtggtattaagggcacggatgcgactgacgcagcctgacagcttcttgcgcttcccgttgccagcgcgagcaggtgcgcgcggagacgtcagtgagtagcagcggtggcatcggcggaagcgtcggtccaatccgacgcaagggtgtcgatgagggaggcgaggccggggctgagatcgttaggggaggcggaggtcgcagaagccgtcggagcaatgtagagaagggggagccctgtcgcgggcgtgccagcgggccacgctaagggagccggaggtggacatggctgcaggtggcgatggaattggtgaagacctgggctgcgtgatgaagttggcggtggtgtgctcgtcctctagatcgggcggcgaaatcaacagccggcgaggggctgccagatccgcccgcgacggattgaggtcaaggtcgggggttcttgggcagtagtgactcggcactggcggcgagccgtctcacaaatgagaagatggggaggagatagagaaaggaggggattaggtggggaaatgggacccactgtcatgtggtcccactattatttaatcttattatttgaccgacatgaggtccaacatttttttattttttaaattgttaaattttgctttatatgccacgtcagatgaaaaccgagtcaaattagccacgcaagggccacgtcagctgaaactgccatccaaatcgtcttgggtcttattttgtgctggttttgacagttgagagacccgttgtatctggttttccggttgaagaatgaaaatcagattcgttgacaagttaagggacctcatatgaacttattcccatagaaaattagtctacggaaaaagtatactttgactcccttaactatcgctcgagtatgattcatgacctccaaccacaaaaccgggtatattgactccgccaattatcaaaaccggtgcaaacaatgtcccacggtggttttagaggtggtttttgctgacgtgacgcccacatggcagtcttgaccgagtttttgtcctacgtggtgcttacgtggtattagaataaaaacaaaatcaaaaaaatatgtgggagccatatatcattcacacaaaagaaaagtattgtgggacccacatgtcatcctccctctcctttccttcttcctcccctctctctcccttatctctctctctctcccccggcctttctcttggctggagcggcggtggcggcggttggaagcggcggtggcggtgggggcatcggaagagcttaacggattcttgcgggatgttggccttgccgtaggcggcgataagggtggcgacggtggcctcctcgggggcaatggagaaggagggcatggtgtcgaggaggaggcagcgggcgtggttgagcatgcggtgggaggcgacgatcgggatgaggagggcgaaggtggacggctcggggttgaagccggcgcggcggtaggcgaagcggaagaactagaagacgaggtcgacgcggccagcggcggcggccccagaaatgacgcgcgtggaccagcggctgggagagcacgcggatggagttctcgaggcggcgagcctt

SEQ ID NO: 29176 - DNA, 8291 bp, Oryza sativa
ccaccgccaccgatcccctccgcctcgttcccatcggccatcgccaccgccgtcgctcttgagagagagagagataagggagggagagagagataagggagagagagggaggatgacatgtgggtcccactttttgtgtgtgtgtgtgaatgacatatgggtcccacatatttttttatttttatttttattttgatgccacgtaagcgccacgtaggataaagactcagtcaagactgccacgtgggcgctacgtcagccaaaaccatctccaaaaccaccaagagacattgtttgcaccggttttgatacttggaagagtcgatatacctagttttgtggttggaggttgtgaatcatactcggacgatagttaagggagtccaagtatactttttccttacctagcgtctcgattccagcccaactagcgccactcccacctgggccaccacccacatcactcgtcgccgttcctaaacccaagagaactcctcccctcacgccaatgccggcctcgtccgcgccgccgccgggagagagagtgaccgaggcggcggcaggagcagcccgtgcgagagagtgagagggaggaagggaccatgcgaggaggcagtaaagcgcgggcgcacgcagcgccgccacttcaagcaggggcgcgaggtcctctggaagcacaatcccccagcgccctccagccgcttttgcttccaatttccctaccaaagcacggtaatcctgcaattgtatctccttgaatcccctattctgcttgacacacgctaaacgtttggctgcgtgtcggatccatgcacaatctgtggggtcgtttttgaaaaacatccctacaaacggtggcagatctttaaatttttttgaagcctagacaagattaatattatcgctgataatttagattttaaagctagtgtcatcttgaacatcggtgctagtaggttgtattgctttggcctttataactacagcttgatggtttggtccttgctatctcgttttctgataatctgattattcatctaattaatcttcattagaacttacgagacaaagtgattatgtttgtttcagcttaagattattataatctagattatagaactagattactataagctgaattataataagccgacatagaataagctgctagctgtttgtttctctaaattattatctgtttgttagttgtttgccacccaataatctaagaaaagcacctttagagtggctcaccagattatagtaatctggcttatagattataataatactccctccgtttcacaatgtaagtcattctatcattttccaaattcatattgatattaatgaatctagacatatatatctatatagattcattaacatcaatatgaatgtgggaaatgctagaatgacttacactgtgaaacggaggaagtatatcataataagctatctatttgtttcagcttactcctaataatccagattaaaataatcctaagctgaattaaacatggcctaagtatatggttaacgagtaatacgctgcatatgcattggagcagtgtgttgctgtacgcatggtgcccaggcaattgcgcgtgatggccgggcgccggcgccgccgctgcctacaaattttaactttcatgtacaaattcaaaaaattatagaaatgactccatttaaatacaaactagtagtaaccgattttaaagggttaaatttctagctccgccactagctgcgtcatcatggttggcggtggtggtggcggccattcatgcatttaggcttcagctatttgccttcacgacatcgtgtatagaagtagcgcacctgggcacgttcaatactcagcatatcctactctgttttaggctgtgttcaggagtaggggtttcctagcacgcaaaataaaattcgtattattgcatgattaattaagtgctaactaactattttttttaaaaaaatagattaatatgattttttaaaacatctttcatatagaaaattttttataaatcacaccgtttagcagtttgaaaaatatacatgcggaaaacgagagatgtgggttgaaaaaacagggagaagaacacagcctgaggggactaacgaattgttgacacattgtacatttcaatgctcttgcctgaggggagcagtacggcaaaaaaaatgtactacctgcatggctgcatctaaatatagttaagtggggatgtgagttttcttatttaacatttgacatacgtcttatttaaaaaaaattataaaaaaatagtcacacataaagtattattcatgttttatcatctaataacaataaaaatactaatcacaatttttttaaataagaataacagtcaaatattaaatacggaaacttacaactgtatttatatcgggacggtgtgttacgttccaacatcaattttgacagatcaagccaacctcaagtaagcacctcaagtaagcacaagcaaaaccagcatcaaaccactgaaatattcatatacaaaacagagagaaagaagagtttagacaaggaatagcaggagattgggttggtagaaaggagatcaggaaatcagaggaaatagagtaggatttgggaagaagcaagagggagggaacagccaggcaataggcttcagttcttatattctttgatccccttcccattgtgcctggttcctttttgtagtaattacttgatgtagcatattgggcctaacaggccacaatccaccatggatgtctagcccaacgcgagtccgtgacacggagagagtaccagatttgatcttgaaatcctttttgttctgtagtggtagaaattaaagaggaatttgaaggttgcttcattcgcgtgcatggctgcccaaacaacccgtcttgtcactcaggaggaaaaacaaccatagaagcatccgtttctctttctttggaatgctattatccctccgtcccacgaaaaagatctaggactggatgtgatatatcatagtactacgaatctattacatccagtattaggttgatttttatgagacggacggagtatgtggcaagtaagcagttaaaaaagagcaagaagttggcacaacaattaccgactggataaacttgtaaaagatatgtaggcatggttataaataatttaactctgaaattctaagcacagactatgttattccacccttcacattttctggccgttttcagttcagaacttcagatactagaccaaaacaaccaatacaattatataaactatacaatctacaattcattctaccaatgcaaatacttacctagtagtcttcggtcagattcctgcgttttggggatttttcaattttttttgacccctccagtgttcgccacgtgttaaactgttttgcttccaagaacaagatattcgtttatgatcaatgcattaataactataatagactagagaaaaatgtgcatacatacatagacaaatcattgttaggcttcttatcttgttaatttccttttattattgatcctcttttccgttcaaaggtataacttagaattatttaagtttctttccttccttgtggtgagttttctatctacctcatgagccaatgatttctgaaattgcgatgttgcctatccaattaaagatatagtgatatctataaatgtccccaaggtgttatcaaagcgtttaaaaaaccatagcctatagttctttagaaaaatgataggatgcattatttaattgttttgttaatacacaaagaatcaatgagaaattagttgttcatcaataggagaagcatattatctaaaagaaataaatatagaaaagccataattcatctttgtagctagagagagcggttaattattgataagactaaaagttcttttattagagaaacttcaccaattttttttcatacaacaaataattttgcacacattctattcactcttatactcatgtaaagaattactcatttgttccaacacaaatatgcaatcccttctattacctttggcaagaatttcttaaatttgacactctattgtataactttccttttcatctacaagagagatgaatgatctgtcttaaagttaatacatgttttgaatcccaatctaccaagagtagtgataccaggaggatattctaacagatacaattaccttgccttcacaagatctcaactttacacaaataattgacatagatgagtaagagttccttggctctacaaggaatctatgataaatcacaataggattggacataagctataccagagagagtactgcttaacgccctgattccaaacccttgacaactttcctttcaatgctaaaatttcctgtactctcaacctctgagatgaccacacatgatgactcaccaagcaagctctccaattcttctgggttatcgtgtgtccatggatgctcgatgactttcctcagcctatcaagcttatctcttacttccttcattgatggcctatctacaccggacatctccaagcattgtcttgctaactcggcaatctcttcaagaaaccccatattctcattattcttgatttgatcatccaatagatcactgagcttattctccttcattgcagagagaaacctcatagacaggcatttctcattttcaagcgcatcaagattgaacggcttcttgcgtgtaagaagttctagaagaacaactccaaagctatatacatcactcttatctgttaattggcacgtttgcatgtactctgggtcaaggtatccacaagttccttgaactagtgtgacaaattgcgtctcatctgttggagctaggatagatgcaccaaaatctgaaacttttgctgagaggttgctatcaaggaggatgttcgacgacttgacgtcaccatggaggattggtggggaagcacaagagtggaggtaggcaagtgcctcagcagactcatgggcaatccgtaggcgagtaaccagagggatgtgccaaccattatagtttccatggatgagatggtaaagtgtgtcatttgggatgaattcatagaccaatatagggacctccacttcaaggcaacaacctaatagtttaacaatgtttttgtggttgatttgggataaaattagcatttctttgccaaactcttttttcttttgctcatcaattgtcatgcatctttttactgctacttccaagttgtccttaagatgtcccttgtaaacaattccattgcctccttggcctagaacttgatgttcatcaaatttgtttgtcgcctgttgcaattcttcttccgagaagattttgaatgcaagaccttgtttagatttcatctcttcatatagtagcaggccaccatgccgtcgaaagtattgatttttgatgtgctgtagctttcttctatcatgaattaagcatgcacaagttatggtgatcactaggatgacaagtccaacacttgtgcctacacaatcataaaagcttgtgtgaatgactagtaaggccagtcccaacccaatgactagaatggtgtctatagcattaaataagctaccacctaggatgaaagatgatgtggcaagtgaataaatgaggaaagaaaaggaaaccaggtcttgcatgagacatgcatggtttttacacaacatccaagacatcatatgagataagtagcattaaatctaagtatgaaacaatggtgtttgcattgaaagagcagtgtcttgtactagttttttttatgatgtggagtttatggaaactatgtctagtgtgttgggttgggattggcctaagatatggaattatggaagatccatgagctagccatgtgtaatgactagtaaggcatgcaaaatttatatattaacaattctcatattggtgtgcacaaatggttggcgttatcattagttctagtgattacggaagaggggaaccaacctactataggaagtgcaagaaaaccggacttccgatttggtatgcaagtgccattctccatatagtttccttggtggcatgagcaagtgaaactccccattgtattattgcatatccccggacaaggataagtaacattgtcgaggcactcattgatatctgaaatcaagcaaccattgcaagtttgattgaaattgtcatatcaaggaagaagaataacgaaaaagtaactatggtaccttcacaaccatctttaatatacgggtttccttcatatccatgtgaacaattacaacggtaacctccactcggatcatcattgcagatgctgtttgtactaacacaagcgtaggaagtggttttgcttttagccttctcacatgtatccaatgttatgacccagtccaacacaactggaactccctctttgtacgtgtcgttgaataccgtggagttgaggtaagtggtgctaaattggaaggccttatcctccatcaccgccatgtagctgcaagggctgctcctccatattttgctatcattgtaatcttcgtcaaaataaccatcataactatatatgtgtcctggaacatccatctggcaacagccaccgccggagcaagatccattcacaggtgttgaaccattacatgtcgagaagcaaccaattacgtactgtggaatttgcatatgtattattagaccaagaagtagtgaactctgccactgttttctttattaaaaaaagaataaacacttatatggtagtgtgtatctgtttttttttcttgttgtgaaaacatactactttgacgatctttttttggagggagcaatattgacaatcttgatggttgaatgcgcattggcaacctcactagttgcacatagtgactcatatcactactatagagtcggtcatctatgcacggaaatggtttgtttggtcccttgacgtgcaggtgacttgaggcgacgtttggtcaatggacaagactaaattaagctagagaagcatattttatttattataaaagcagcatgcttttttttaatattaaaaaatggcaatgaaatcattatggtgggtctagttaggttttggaggggggttgatcttcttcctccccttctctcctccccatagggatccaacagggtgggaaattggggcgggggggggggggggcttaatccacattagatttgccccgggcagcgagacacatgtggtatgcaccgccacggacacaaacacaacgtcccctgaattagctggggaacatgcgcagaagaaaaaaaatactagatggctacaccttctaggatttgagcaagaataccttactatgatttttaccggaattgataattaaattaaaaatgttcgacaatttttcaaccaaaaccttcagatttatgattgtcagatcaccttgatattcatgcggagaggggaaaaaaaatctgtgcaatacgtacaagttgaacatgcaacatgtgaggtggatgtcgtgctgctagccaaccggttgcatgaacgttttattcaactacatataagttacactataatcatattataattacaatataatctcaaattatactacattatatttaaaagtcttttattaaaaaaactgtagtgtatactgtacagtagctcctaatttttattggaccataactaatatttatactgatgtatattatggggcagggtccctaaattattttttttaggcttaaggctgcctctccgcttgcgccctgtagcgcccgttccgtcgtggcgcctagcgggaaaactatctcttaaaaatcctatttgcgaaatccgtttctttgcttgttgtctagtgtccgtgccatctcagatctcaaatccccgatctatcgtcaagttcaatcccgaatccaaatccttcccaaatcaaattcctccgcaaaagtctattttgcctccctcgggttcgatgggccgaatccctctaggcccatctccccctccctccccggctctctctctctctctctctgcccgctctgccgtgagccgcgccgagccctccctcccgctctcgctgccgttcccgccgatgccgcccaaatcgccgcgccgcccgcgcgcgcgcgcgccttggtggccgaccggccagtcgccgccgccgtcagcgcctgccgcgcctgccccgcgtctgccgcccgtgtcgccgctccactccaaaccgccccgccgtcatcgccgtcgtcatcgactcggccccgcctctccccgcgcgtgcctccaagggac

SEQ ID NO: 29177 - DNA, 3581 bp, Oryza sativa
  unsure (1)..(3581): unsure at all n locations
ccccccgtcgccgctttggccgcgaccgccaagcgcgagctccctcccttgaccgcccaaggtcggtttccaaaccgacatcgccgccctataaacaaaagcgcctcccttcctctttcccctcccaatcttccccgtttctcgcccgcgccattgctgtctctcccgccggccgcccgcgccgtcgcgtgtgctggaggagccggtgcgcgttaggacgaggaaggggactccgggcgctcgtcttcttcctctcccccggcccgaggccggagagatcgctcccgtgccgtcggcccatcgtcactgcgccccgtccgcacggtagtgaatctccccgttctccctcctcaatccatctcttccccttagttttcggtagtagcatgtgtagcctccccgtagctagccggcgccgccccgactgctgccgtcgctcgccgtgtgctcaccgcccgagctcagaagcgccactcgtcgccggcctccctcgatgcgattcctcctaatccggcgcaaggggtgggttcccgtagccgcgtagatgctctcgccgccgggaatcggcccctcgtgacctcatcgccgtttcccccttctcccgccgccggttgccgccgccgcaatccgccgccgtcgagcatcccccggcgaatccgagccattggctcgtctcccctcgtcctgtgcaacatcccggtgtgctcgccttcgcctgtatcgccatggttcgctccgccgctcgccgctgtcgtccgccgtccgttccggccggcgtcgtcgtctacctcccgccggctcgcgtggcagccacgtaggcgccacgtcggcgccacctcggccgcgaccgggtcaagcagaccccggtccgccgcttccctccgcccctcgcgcgcgcggtccaccgcgagccgtgaggctgcgcgtgggcccgtcgcaccacgtcctccgcgaaacgcgcgcatgcgccgcgcctccctccccaaaccctagcacgccccgcgtgcacctcgctcacggtgagccgagtcgctgacaagcgggtcccacccgggaccacgcgggatggacccggcccaccggctctctctctcccctccccgcccgcgcgcgcgccttgggccgccttcttgggccggccggcccattaagctcggccgagccgcccctttctctcgggccgcgccctagccgcccgagggaagtctaatttccctccctccttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatcgaatggcacgcttagaggtcaataatagggctttatttttgccgtttgctgagctgtcccgtttcgcgtgtagtttcggagcccgaagacccgcagtgcgaggatttcgaggatcaagctcaagatctcgagcgaggcaagccacctttgaacatcttgagcctatatttgaacttaattatgttgcttgaaaaatattatgcattgataggatcgcacttaatctgcttgtcccgtctgcaaggcagattggcggacctacctaatttgttgcatttgaccattccattgtaattgttataccatgttcccttgtacccacctagttgcgcctcggtaatcgtgcactctgcacgggtatcgacggtcgccttcaaacttaaaatctgagaaacatcttgggtaaaacttgcgttttacaaaagacttggaaaatccgacacctgggtcggtgcttgcgaactaaatgaatttccaaaaccgcggaccggggaacgtaccgggtgtacggtttcccgctcttgcacctaaggactgtttccttggaatttcatccgaacataagacaagtacgaccacatgggtggaatgggacacccctggctgagtaactagcttatcgggagagccatgatgctaagagacatgtggattcgccggggtggtgtcggggaggacccctgggcttcctggcacaatatggtctgggacctaatctggtgttggtctgggacccttctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttatgaaatttgctgttgtgggatgggtttgatgtttggaaaatctgcggctgatgggatcagccaggcccgggtggccgtttgaaagctgttggccgggtgccaatcttgatcaattcaaaagactgatacattgcacatactccgaccggacgagacgcactgtctcatccgtgtcgtttgagaagcactcacttagttgtttcagaaaagagttcaaataaaatcaattgcaaaaacaacagcctttctttgaagcctacattaaacacttatttcccatggcttgctgagtactcccgtactcacccttgctctatataaataatcccccctagttgctgaagaagatgaagcggatcccgctgacgaggagttcttccaggagcaagccggctacgatgagttttagggtttcggcctagtttccaagtcgcgcctgtgatgtttggtccaagtcttggcttccgcttcccttttgtaatgcagttgtgagctcgggatctgtccgcagcccaacatgactatactcctactctataataaagagacctctgttgctgtgatattctgtcttcctgtgataccagcactgtttcctgggactggtatcgattaacaggttaatttggagcgtcacgggctagttccggtcgggactagttcggggcgtgacacgcccttaccccctaccctggctgggtcgcaccttggatgagaaaaaaggagcatttgtataggctggtttactttcagactacatttcttgagaagtgttcaagcttgtactaagtatgagatcttgttaacttttctttgaaatgttgtgcatggaaaggtgtgagttgtacgtgttgagttaatttgcttctttatttgtaaattatgtgttctattgtctttgtgatatggtttttcttttgatttatatgctgagtttttgtggtgagaagaaggatgaatagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29178 - DNA, 1200 bp, Oryza sativa
tcgagtgctgtcagctcttgctttggcattcaacacaaatctgtttggtgcactaactcattatagtagcggacaggctgcagtgtactttggaggtaaattcatgttctacttttctggatttcatttcattattttcatttacaaacgggttaccctaaaaaaaaagagcagaggaagcaaaaacaacatgctataacagataaggcatatagatatagaatgagaaaacctgttatttccttctatgctgttgttccttttatatttggttccataattagtctttccaaattcatattctcactactctgtaatttgttgctttctatctgcagcggggtatcttgagcttccagatgtattcaggatgggtttcgtaacagccttgatcaatattctgatctggggtgttgttggaaccttctggtggaaacttttggggctctattgatagcggctgcctgtaaattgaccaaagttttccattggagctcactgaattcggaagggatgtttcttttgtggcctgtcgatgagagttcaataacagaataactttgttccttcaaaatgatcagctcggccgctcggttagctcagctgtatagtaaatgtaaattagggaactaagagagtaatggaaaatcaggtcaatctgattacctcaatgcgaaattcttagctatgccttcttttaaagaattctgttataaccgttctgtgtctttcctttgcaacgattgaacttgcttagtcagttagtctacagtacgtacacttcagatcatgtccaaagtgattcccccggcggtccaactaggctcaaatgcattgtgggagaagaaatttgaagaggtgtggtctcaatctacgtacgtggcatataggaccccttgtaggagggtcttgcaccgcgaatggtgtgaatggtcttagtgcaaggagcgggtgtttcatcgaggaaagggtgctcctgagaacaacatggggacacgcctatctgaggagacggccgcagcttgtgtatgcgatttccggtatgccatggattcatgtcaaagtaagtgatagggatggtcggatggcaatgacaaatggaggagacgatcgaaggttttggacactgtacgatagctgctacgagggatccagcaggatttggacactgcagacacgacacaccgaatggtttgagcc

SEQ ID NO: 29179 - DNA, 1273 bp, Oryza sativa
tatatgtaggagtagtatgtgccgcagtacatacgcacgagtaacctgacggatggatgccggacgaaggaaaacgcgagcatatatatggaatgcttccgcgctccttttcgcggtgttgaattgacgctaccgaacagtacccaaagtgaaataacttttgctccgatcgatcaatcctcgcttgtacatatatgaccatgaaaaagaaccgagagggagagagagagatacgaacgaccgtgacaactgagaccgagaggtgtcctagctaagcttagctacgccaaatatgtctctccactaccctacactagctctctccaaccgcgttaactgctaatggaaaccgaacgccactctcatgcacgatgctgcacagtctatcgtccgaaagcgtgaaagggaaggaacttttcctccaacttgacagtatggtcgcccttgacaaaagagcttttagcatcctctcgctaacttttcctactcacctgacagagttttattcaggccccaacactgaaccgtgtaaagtttcagtcatctacagtgaaagaaactcacgaaaaaagaactaactctaacagatgaatccatactacagggtttcccaaaccgtcaggaccaggttcccgcacctcggcggtaagcaaggtaaccgtggtaactatgacaaactatacgaaaccgtgtaaaattgatcaaaattttaaattattttttaaatttacttaaatttaaataggttaccgtgatttttcttttaccgtccttcattgtaagtgtgataactacggttatcgcgccgtaacgccaaccctgagttccatagtgggtgaccgggtgaccaaatgaaggccaactcatcgcatcgatcgacgatcgggcaggaagaagagaggagagagaggctacttaaagccgtgagcttttgcgcggatcgccggccagccgggctgtgcgtgtgcatgcatgcaggcacgcacacacgcaagaaagcgaaggaatccgttcgctattcggtggtgggtgcgtgcagtcagtgcgtgtgtggggtttggaccggttgttcggtccgtgcaggcatcgccgagcgccgagctatctagcacagtagtacgtacgtacccggatggatggacgtggagctagaaaaaggtgttcaatatattgggccacaccatgcatcgctttcctagcccgtccggcctagctagatgcaccgcggcacgacgccttttgggggcagcaggtgccgcgctttggctccttg

SEQ ID NO: 29180 - DNA, 45536 bp, Oryza sativa
  unsure (1)..(45536): unsure at all n locations
cagtgcgtgtgtggggtttggaccggttgttcggtccgtgcaggcatcgccgagcgccgagctatctagcacagtagtacgtacgtacccggatggatggacgtggagctagaaaaaggtgttcaatatattgggccacaccatgcatcgctttcctagcccgtccggcctagctagatgcaccgcggcacgacgccttttgggggcagcaggtgccgcgctttggctccttgccgagtcgtttccgtggcgtggcccggcacgtccccttcatttcccttccctctcctctcctctctctctctctctctctctctcacacacacacacacactctttctatctctctctcttctctaggtttactagacgattccctgacaggttggaaagagaacacggcagtggactaacgagacgcgacaggggggggaggcccatcggcggtgtgccggtagttcttccggacggacggggtagctaacgtgtgctgaaaaattggggccctggtccttgaatatgtctaaaaaaattcattggatgcatatgtacctgtcatgaataggttcattaatctttacggtaggcaggcatgactgcctctcttagttgactgccctgttggactgtttgtgtcattacgtggagattttagtttacataacgatctttaactggcttgcattcaaaaggtaatttgctagtagctataatgaaggcagacacgatcgaattgtagggcgtgctcggtttagctagctgtgggtgtacaaccgttactacagcttgttaagagtatatatatgatagttaattagagcaaaatgtaattcacttgtattgattatgtgcctttttattttacccacataatttggatatatattgtcacgcgaatctcagtacactacattcactattcaactagtatgatctcatcttttattgttaaatacttcctccgtttcaggttataagactttctagtattatccacattcatatagatgttaatgaatctagacacatatatactagaaagtcttataatataaaacggaggaagtatgatattagagcaactacattcttgagttgtcttctatcccttccacaagtgtttccccgagagctccatgacaatacctagagtttaacctagtcagtcgagtcgatcgactatcatagagagttttatctcgatcattaatcggttttgtctttctcatcaatctattggtctaaccagctcaaccgtgttattatgaaaatgcaaatgaataagccgtaaaaagaaagacaaggcgctacactatatgttaaccacactttactgtagaaggcataactttttcgtaaaccctctcgtgagactaaatttttatatgtgcactggtggagaaaccatctttggtcggttcacccaaattcacaatagtcccggttccattaaaaatcaggactaaaaagtatttttatgccagtttataactgtaaggggactatatcatctttaatcccggttcgtgtcatcaaccgggactaaagatgatttttagtcccgagtagtaacactaaccgggactaaagatcatctttagtcatgtcagaggatgccagtccctagagttctttagtcccagttgatattaccaaccgggactaaaatcctaactttagtcccggttgttgtttccaaccgggactaaaaatcaaatataccatatatatataatcccttgctgctatcctcaaaaatttctatctcgtattcctcctcctctctcacacacttatccttatcctcttctcagtctctttctattcttctctctcaacacttagccgacgaggagctcgcccccgaagcgcggcggcggggacccgggcgcggttggcggcccgtaccgggaggtggtggcggccgtccgcgcaggaggaggcggcggtggcggccgcccgcggcaggaggtggcggccgcccatgcaggaggaggtggtggccgtcgcccgtggcaggaggcggctggatttttcttgtttttcttttttaataacttgtgattcattggatctagatctgtgttatttaatctgtgatgtatttgtgatctgtgatgtatctgtgattgtgattgtgatgtatttatttttttagaatttgtgatgtttttttctgataatttgtgatgtgaatattatgatttgtgatgttgctatttgatctggggatattgggaccatctcgatttcgatttggaatttgtgattgattttatgattttggagagattggtgtgaaatcaatattcaaaggaacaatgaaaaaaaaactaggactaaccctttaccgggactaaagattctcctctttactcccggttggtgttagactaaagatcgatatttagtcccaggtatttgaaccgggactaaagattgctatctttagtcccagattgttactcccgattgaaaaaccgggactataggggggtttccaaccgggagtaaagagcatttctctaccagtggtgaatcgattgaaatttacaaacatgacccactaaaacataaagcaacgatattttacattacaagttaaaattcctaactctgctgccacttcctttcaccagtccgtttcttcaacatgagcatgaaccgtgtcatgcagtaaatgtaaatggagaaggtgttgaaagaaagttgaggtgctacacaacacgtttaccacccttgtgttaccggagaagaacatgtgtgtggtggaggcccccacaacctttcctcgttgctgttgggttttctccatttcccagtgagatcaccaatcaccttttggtccccggtccttttgttctgtaaggttgttactgtgcccaaaacactgctgctgcactacagtaaaaacccggtcccttctgccggccgggcgccctttcgcatcgagttaaccttaccgctgctatctcaccagcacagtaaaacgcatgtacagaatcgactcagggtgtgtttgaggagaaggggattaaggagattgagaagatacgtaaaatgaggtgagccattaactcatgattaattgagtattaactattttaaatttcaaaaatggattaatatgatttttttaaagcaactttcatatagaaaattttttaaaaaacacaccatttaatactttggaaagtgtgcgcgcggatgtgtattctcactctatcacctaaaacgaacgcagcctcaaatccacttgtttaaaagtcaatacgttagccactactacatgcatgtgtagactgtagagtagtgtatgtcacgcaaaactagctgacaagtgaaagtttgcacggtgaaatatggctatgctccgcgagtagacgcggtcgacgggcgcgcgcggcgcgccggcaacggcgcgaggagaggaggccggggaagaagaaaaaggctagcggccgggggccctgcggctttcagctgctgaccaccgcggaaggggaccaggctctgccccgcgcccggatgtcatcagcgcaggcaggcaggcacacacgcaggcgcaggcgccgtccgcgcgtacaccaccacgtacgtacccgccccccaccacgcggccaggccgcgcctagcccaacccaatccacgtagtacgccggaatgatggcgagatgatatcgaaatatcgatacccttccggttccacgcaaaaaacttcacgcccatcccctcgcgtcgcgtggtaggagcacgtaccgcacttcgcatcgcacacagaaacgcccaaacctgcacgcccaatcgtggaacggaaagcgcgggggtcaccaacttgatccaatgcaaaggtgcgacgatgacgacggcacgcagccgcaaagaaacgaggaagacaggagggggataaagagaaaaaaatcatcaggacgagtgaagtgggcaagttgcgttgcgacgcagcacacagggtattttccccaatcccggtgagcatccgcctgtttccgtttgtcgctgtaagcatgtcacatcattgcgtttgttttcttccggaatctcacggcgtacggttccagacatcccagacgctccacttttgtcttctccggcggcaggcaggaggtcaggaggaggtatagcggacggtgcccaacgccaacaggtgcgtgtactgctactacttgtacgctgcccgtgagagatcgagacgacctgaagggatcatttcacggcaacctgcaccgtgttgttatgcgagtgggactgcgcgaggctgcgactgcgcttgtgtacaactaagtagcagaccctggccgtcactgtttcgtgcattcgtgtatagtacattagtactggatcaagtaagtataccaaatttttattctcgagtcatgcaaatttatgaatcattcagcacatctagctgctaaattacagtctactccaggtctccagcagttgcaaacttgcaatggtgcacaagtgctgcagggcattgggcatacaaaacttgagagctgctaatgagatgggatgataccggttagatattaggtcctgatacctaaccgatatcagacaattcctatcacgtatcaggtgatatctatcagttatcaagcgattcctaccacatataggtgatacttgagaggtatcacgcgctaggtgatacctgtcagatatcaggcgattcctaccacgtataggtgatacttgcaaggtatcaggagccggacaccaaggtattgttgccggtggtcccaccgtccacgtctcacgccggagctcatcaccggtggctgcatcctccaccgtccacgccacatcggagctcggcggcggtggccgagtcctccgtcatccacaccccacgccggagctcatcgacaacggtcacatcctccaccgtccacgccacgtcggagcttgtcgccagcggccgcgtcctccgccatccacgccccacgctggagctagtcgttgatggccgcatcctccaccttccacgccacgtcagagcttgtcgccagtggccgtgtccttgctccgcgtctatccactccgacgacagcaccatccccgactgtcgcgacaacccatgtccatcagctctgacgccaagctcgcgttgctccttaacgcggcacctccctttgattcagcgacggcagccaagccccgcgcatcatcgtcgtcctcagctagcgttagtagctacgcagcgtgacgtagatgctcacgacctacggcgacggacgccacactgtaacctcgaacgaaataggctccgatcaaccacaacggccaccgtgaaacctggttgtttccgcaccattcttatccgaggctccgatcaaccacaacggccaccgtaaaacctggttgtttccgcaccattcttatccgtagccgcatgaggctgggagaggatgaggatcctatcctgaatactagcaagagggagtaaccgtgtaggccatacgatggacctacctacctagatatatataaatataagtttgtctagccatccagcttcagccaacaaattgaccacactccacacctatatcagtggccctacttatacgtgatttattttatccaaataaggccgttaataaaaatatgcaaagtgatggacccaaccgggatcctgattttttctgacctttttataagtgctataccgttttcatctggaatttcggaagaaattaacatgagtatcgtcaacctatcattttttttaaaaaaaaacttaaccacaaaagtattaagtagtacttaattaatactttgaatttttactagtagttgtatatgacgctaatttaaaatgtaaacatactgtgactatccttatgacagtatgttgtttttgaggctttatttcgataatttcgtttcaaaaatagtatactacagcattactgatatcgttattggtgtacgtcccaatttggtttccgagaaaaacggtttgagcattttccttgactattgtcatcccaagatactactatctgcaatcttcttcttttcaagaattctttttaggcaaaatttgttacataacacccaaaaaaatatgtaattagctgtgggacaccgcaaagacgtgaatttgtccgaggacactccaaaaatatggtaatttgcttcagaacattagacgcattaaaatataatattcagtcaatggatgagagagaaagcacgtaaaatgacaattttgcccttgtcttcttcttcctctcgatcttgcccaacttagagtagggcctccacagctttgtcgtgtggagcgcgcatgggcacaggcaccagcggccgatcgcttggaactcctccacgccggcctacgactgggtccgcttcgcctgcgacgctgccaacgccactgtccttggtctccgcctacctggcgtcagcctcatcggattctacctccgggtgctctcccttcgatgcaaccacctcttcggtgatgtcccaggtgacctcttttcccttcctggctctgtcccgcctgacgtcgccaagctcacgggtgctccaacaccttgctcgcacgcttctcgccggagtccttcgccgacaacctccagctctgcggtaagccgctgagccggccatgcgtgcgagtcattcttcctgtccccactaccctctcatgctagcgcaccgacggatagcggtcgttccgtgctagtggccgaaaaaaagaagtggaagaaaaagatgtctggcgcggcggtcgtgaccacaacaacggcgaggagtccgtggcggcgggcgtggcctgtgaccgcactcgcagcagggtacgcacgcaagaggatattcagaagaagaacgagagaagggagaagaagataagagcaaaactgtcattttacgtggtttctctctcatcaattgactagatattatattttaatgtgtccagtgtcctgtagcaaattatcatattttttgaagtgtcctcgagcaaattcacgtctttacgttgtcccacaactaattacacattttttgggtatcctgtagcaaattttgcctttttttataatctagctgatgtaagctacaatttatttgtttaatcttattggaacttataccatttttgccttcagctgttcctagttttgacaaaggtgattagggtaatgttagggaagcttaaaattctgagaaatatctagtgagaatttgaaaaatgtgggaaactcaacttctagcttattttttagattctacaaatacattctcagaatctggatgaaaatctggactatttaagagagtttatggtaactgaagattctagtagaaactgcagctgttagaagctccccaaacatgccccccatcttattggaccttatgctttttttttttgcaaagaagaaattaatgcctttaactattccaaattttgacaaagtggtcatctattcttcttgtaaatatgtctgaactagttcaacattttactccatgtaccttcatgttgagtggcatgtgtcaaggcctggactcttcagttgttctaatatgattgatgtgatgtggttggttttataggcacataaggccacatatataacttcaaagaaatcaatgaacaaacataaacaaaagacgcatgatcacaaaataactccatggctgaaattctgcaagaaccttttgctagctttacaattgtgaccgtgatcgtacatcacaattcacaaagggcacgaaccaatggaacatccaaggaatccagcttttacgattcatcgttttcgggacgaattctatagtcgcgcagatcgattaaaaaagtccctagtcttttgcgtccagggattcgatggagatttgggaggataaaaaatgcaattaaacagataaaaaaatgaggtgttacgaaagccgctactgctttttccacaacgacaagctcatagaaaacgatttcgggtcgccgtctgcagaaatgggacagagaatcttcggtgattacattaagttacagaacttgctacaagaacaagaataatcctccacccccttgcgttccactgaattccgatgcatacacacacattttaatattctttttgagggaacacacattttaatatcttaagcaactgcaccctcgttacccgccagaatttaattctcttgggacgtatagtgtactcaagttgagattccctcccacacaaaatatactgacttctaatgtttaaaattctatcataaaatataacaatttctcccacttaactcactccttttaacaaatcatcgcgatactttataatttaactagcatggtggcccgtgtagattgcgcggctagcatcattatattttctctcatataatagcatatatgttttctcattatattattcaaatatattaaaatgacatcataattttaaattttgcaataactttacgaaactacaaatgtgtaatattcatattgtattttatatacgtgttagttattaattatttttaacatcaaatattagttatttgtaaattatatatattcctatatggactctagagtcgtcttttaatatttattttttttaatttcgaattttctgtaaattgtatttctatatagactctaggctcttctttcaatattatttatttttatttctgaaattttattatttctaattgtatttatatgttgactctaaactcatctttcaatattctttaatttttaatttcgaattttagttacttctaaattgtattcctatattgactttaaactcttcttcccatgtttttcataatttcgaattttagttatttgtaaattgtatttttatacggactcaaaactctacttttaattttattatgtttattccgaattttagttagttttaaattcctatatggactatatactctacttctaatattccttattttttaattccgaatttctatttctttttcttaattgtatttctatatatggactctataatctactactaatatttcttatttttaattctgaatttctattatttcctaattgtatttctatatggactctatactctatttctaatattccttatttttaattctgaatttcagttatttcctaattgtatttctatatggactctagtctcattttctaatattccttattttttaattccgaatttcaactatttctaaattgtatttctatatgaactctagtgttctcttctaatattccttttttttaattctgaatttcagctatttctaaattgtatttctatatgaactctgccttttctttttctccgattaatgtgagaatttctaggctatgagagcgaatgtggaggctcctttttctatttctttaataatataactagcatggtggcccgcgcagattgcgtggctagcatcattatattttctcacatataatagcatatatgttttctcattatattattcaaatatattaaaatgataacataattttaaattttgcaataactttacaaaactactaatgtgtaatattcatattatattttatatacatgttagttattaattatttttaatatcaaattttagttatttgtaaattatatatattcctatatttctttttttaaaattttgaattttctgtaaattgtatttctatatagactatatgctcttcttctaatattatttatttttatttctgaattttcatattatatttttatacatgttagttattaattatttttaatatcaaattttagttatttataaattatatatattcctatatagactctagactcgtcttttaatatttctttttttaattttaaattttctgtaaattgtatttctatatagactctatgctcttctttcaatattatttcttttatttttctgaatttttattatttctaattataaactcatctttcaatattctttaatttttaattttgaatttcagttacttctaaattgtattcctatattgatcttaaactcttcttcccatgtttttcttaatttcgaattttagttatttgtaaattgtatttttatacagactctaaactctagttttaattttattatgtttattccaaattttagttagttttaaattcctatatggactctatactctacttctaatattccttatttttaattccgaatttctattttttttcttaattgtatttctacatggactctatactctacttctaatattccttatttttaattccaaatttatattatttcctaattgtatttctatatggactctatactctacttctaatattccttatttttaattccgaatttcagatatttcctaattgtatttctatatggactctatactctacttctaatattttttatttttaattcagaattttaattatttcctaattgtatttctatatggactctatactctacttctaatattccacattttttaattccgaatttcagttatttcctaattgtatttgtatatggactctagtctcctcttctaatattccttattttttaattcctaatttcaactatttctaaattatatttctatatggactccgccttttctttttctccgattaatgtgagaatttctaggccatgagagcgaacgtggaggctcctttttatattcctttaataatataatagatagatagatttcaggactgtctacacaacttgtaataaaaatttccatcctaaatcatatgtgtgtacagtaacattatctttttaccttcccttcccagtcttccctagcctcgccggttggccaaaaggcccgaacgacgatgtcaagtctcccctaacacccccgctcaccccacccttaactcctcctccttaaagacgatggtggcgaggccctctttgtcgtcttctctatctccagtggctctccaccgccaaatctgttaccaaccacttgatttatttacctcctccgctaacactggcccaatgcctaccatcaaccccacagctttggcacctcgccatgtgcccgtatccaccacccacccccgatcctccaccgtctatggccatctcgcgtgctaagccccaagtaaactccctccttccctaactcctcctcctaccctaattaaccccaaaccctaattcgcatgtcctctattggagtagtggtgtcaccatcatcggagaagaggagtccaaatacaaatcttggcgtgaatccgataatctaaactcgaaatctatttttatatgcggttgagctgcccgtttgcccaaaagtatctgcaaaaatcgctatttttccatgcgggcggtgcacccgcacgcgaaaactcaattgttgcgtgtggatgcttatgttgtctgcacacaaaaaaaatctagaaaaaaatccccaaaaataaatactcgaaaccttagctaggtgcggtctgccagtaacatcatcgccaactcgtcgtagtatgtcgtcgcttgtcgtctttgccgtcgctgtcaccgattccccgcagctcgtcgtcgtcgtcgccgtcaacgcacctcctcagccggtggatctacgtggggaatggccgccactccgtctttgatgggcctcctccacgggcctccgggcaggcgaggggtgatgccgctcccaccgcaatgggaagagaggagaggggttagaagatgagctcatgtgaggagaggagaggagtgggacaaggagatgataatagaggggtggggagagagtgaggagtggaggaggaaattagatattttagggcccctttgaatcgcaggaatgggaaaaacgaaggaataggaaaaaagaaacacagaatattgataggaatgcaaatgcaaaatagaggattacagaacacagaaaaaacataggaatgactatttgattcggccgcatgaaaaacatacgaaccggatgaaagagatagactcaaaagaaatttttcaataggttagagctcttgctaatttttgctcataatctctatcgaattgtccattccattgaaatttcaaatgataagatatgattcaatcctttcaaaggccttcataagagttttttttgtataggattaaaatcgtccaaaattcctatgtatttcctacaaatcaaagggacttttaatgtggcagacccacttcttaacatacctacttatttttgtatgcgggtatgtcaagaggctcgtctgcgaaaattgatttttgcatgtgggcattttaagaagtcgtatgcaaaaataaaaaagtaggtcgatttttgtaggcatgagtagttacggtctgcctgcattctatagaggccctcgtacacaaaaatcttttctttagtagtgtagaacatacacatttccctaccacgattggtataacaacatatacatgtactccagtgtcctgaaataagttcatctttcactcattccacacataccaataaaaaagaccaatatatctctaatttatcaaatcataacacaattactttacccttgttcaactctaaatgcaattattctctactttcataaactcaggtatatgatagttaaaagtaaaaacttttagagatatatgtgagaatctataaacaaacttattataggaaggaggaggcaacaacactggttcacatactcctactctctccgccaaaaaaaagaaatctaggtccggatatgatatattctagtactataaatctggacatatgtatgtccagatttctaatactggaatgtgtcatatttggtactagattggtttttattggacggagaaagtatgtggtttcacctttttttaagggtctgtttggcacagctccagttccagttcaatctctcctagagctagagctcagacaaatagtttcagctccacctaaaataggagcggagttaggtagagtgctatcacaatatgaactacagatgtggagctgaattttagctactccacagctccactctaacccaacttctagagctaaattttaaagttagagctctactaaactgggactaagccacgttaaaatctctctaccatgtgtcgtgcaaacacagctattgttccctcaaatccacacgaaagccactttctcagcacccgacatgtgaggcgtcgtccctcgttgtgggtctgggagctactactcctacaccagtaggggtattaccgcagaatctagggaccaaaccgcaattccgcgaggatttttactgtgcacctgcagctccgcagtcgcgcgctccaccattccccaggaaagctgcgctccgtatcgcttggcttttaccggcacttcccccttttgatgccccgaccaaccgaagcaggcagcagaagcagagcagctgctgccgctgccgctaccatccgcgcgctcttctccacgcctctcgccgggccgcgggccgaaccgttccaccgccgatccgtcgccgaatccgcgcatctctcaccgccaccgcctcgccgtcgcttgcctacgcgcggattagcattcggttggaggagtagttcgtcttggttgccgcctcctagtctcctaccgattcggtgtgagacggtgtgtgcgtgcaagcatgggcgtgaccgaaccttgaccaccgcctcgttccagtcctcgtagggctatataaactttcgaaaatgctatacacacgacggatttgtacgaccatcatacgactagtcgacggcgttatctgtgagcgtgagctgtgattgttgggccttttaaaagcccaactccagccgaagctccatattccgacgtcgattcctcttctcgatattactctatacacatccatgacttttcatcttctacatttcctttctcaccctaaaccctcattctaatccccttcgtctcctatccataccaatcagttaagattaatcagaatttttttttgcggcaaccgcaacagagtattcaggttgaagctaacagaaggtattttaggctctgattttctaggccccatgaacaattctattaatcttttatctcaattcgtttttcaacatctcttgtttttccatgcttgcaaacatatacatggccatatttgatttttcaactgattttggtcataaatatggaaattgaagccatggtgccttgtttttctatcaagtctggtcaatcattttttcttgcatgttatggtttttttaagaggacttgcatgttatggctgtgaaaatatattggtttcatatcctgaaggcctaaactaatctaacatctggagtgaatccttttaatagcaacctaagctatatcgatacatgtctcagccggactagcctctggcctcagtgtatagaaagcacagtacgcaagcaaacaacaacgaggctcagcgacgcgtagtcatatctgacgctgtcattgctcgttttttctgccgtttcagtcgtacatgcgtcggacacatgagttggacgtatagcaaagttgataaactttaggccatgaccaacgcaggaagcacccccaccattggtgagtgaagctaatgcctacgaaaggtgaaaaatccattcgactttggacgctagatcagacgtcgattcagtcgtttttcagtgccgggagtacagtcagtcgtcgtactcgcgctagttcgttcggttgttactggactcaacgcaaagaacggccgcgcctcttcgtactgtcttgcacatgagcatgcaaacgcacgtcacgttaaccctggtcacctcctaaccgcaccaccaccccctctctacctaacccgagcgcccccctctcctctcctctcctctctcttggtctctctcgcctttattaatacacacagggtacagcgcgccgtcttgcgaaaacagaaaggaaaccgagaaagagagagagagagagagaggtagggagggaagaagagtcactccacactccacactctcatcccctggtccctttcttggatcatgagaaaccgcgcaacaaaattgcaattctaggcagcatttggaccggggacttggctacgtggtgtttggccatggatcgcagcgtggaattaagaccggcgaggactcagcgacggaggcacccgcgtcattcctacgcttctgtgcccgtcgtcttctcgcagtgagagagagagagagatcgaccaggcgttcactgaattttactagaactcggcatgaagcgacccggcggtgccggcggcggcggaggcagcccatcgctcgtcacgatggctaattctagtggtaatctttgttctttggttttccttttgtggcaattcattctttggaggtgatggtgtagtgtgatatgtgcgggaaattgagtgttttgtaattgtacatgcgtgttttgattagatgatggatatggaggggttgggatggaggcggagggggacgtggaggaggagatgatggcgtgcggcggcggcggggagaagaagcggcggctgagcgtggagcaggttcgcgcgctggagcggagcttcgaggtggagaacaagcttgagcctgagcggaaggcgcggctggcgcgcgacctcggcctgcagccgcgccaggtcgccgtctggttccagaaccgccgcgcgcggtggaagaccaagcagctcgagcgcgactacgccgcgctccgccattcctacgactccctgcgcctcgatcacgacgcgctccgccgcgacaaggacgccctcctcgccgaggtacgtgccgactgagtcgctgccctgccgtgccgcctgagctgttgctctgcgtgactgcgtcgagcagtcgttcgtttgcgcgcataatgtctgatggcttcttggtcgcgcgaattgtggcagatcaaggagctgaaggcgaagctcggggacgaggaggcggcggcgagcttcacgtcggtgaaggaggagccggcggcctccgacgggccaccggcggcgggatttgggtcgtccgacagcgactcaagcgcggtgctgaacgacgtggacgcggccggcgccgcgcccgcggcgacggacgcgctggctccggaggcgtgcacgtttctcggcgcgccgcccgccgcgggcgcgggcgcgggcgcagcggcggcggcgagccacgaggaggtgttcttccacggcaatttcctcaaggtggaggaggacgagacggggttcctcgacgacgacgagccgtgcggcgggttcttcgccgacgatcagcccccgccgctgtcgtcgtggtgggccgagcccacggagcactggaactgaagcaaatccggcgtaaccgcagccgagagagagagttggaaaacactatgcctgggggaataaagaattctgcaggaaagcagggtcttatctgcaattttgtaaaaaaaatggacctctacgtacttctctagtctcttttgccaattctcgcgcacattagctgtagcactgcagtgtagtaaaatcctactactccattacctctccaatttctagctctcacttccctacttaaactcatctgagctctaatgtaagcatatgccatccaaaatggaccataaatatgtcactagcagtaggatggtaattaggactttttgaggaagtctggctgagcaaggaaggggacgactcaacgaacggcccacggcctgaacagtgtcgctgttcggtgggcccggcggccacgaggagcagccgttggcttcttcctcactgaccgggactctcgcctcgcggacagcgatccgacgacgtcgacctgctttggcttcgcgctttccacggccacggcgccgcctgctccggccgcctccgcgaaagcgtcgttccctttcggaacttggaacaaaagcttgtgatttcaccatggcgatgtgatgggatcagagcacaaccagagtttcccaaaccgccgggactagagttaccgcgccccggcggtaaggacggtaacagcacgaaaccgtgtaaaatttatcattaattattttttaaatttatttgaatttaagaaggttactacggtttttcttttaccttttaccgtacttaacccatgataagcacggtaaccatgctgttatcgggggttttacaaaccctgtgcacaactcccagtagatttcaatactactgcagctggttgtagtaggagtactacgcaggaacaaccggtacggtgagctagttattgtgagccggaacaccagagagtacgacataaactgcctgtgtttacagcagctcgtgcagcgttcagtgccatctgtttcgatgattcgtcagggttgttgtataagctttgctgcttgcatgccattgaagtgcatggagaaggttgatgaatgtgttgcgatgtgttctacttgctactgctactctgctagtggtaggtggtgcagtggaaaactgaaaaaatcatcgatatggttgccggaatattctctcgcgacttttgccttggtgctcctgaccaccgaccacaccgagtggaatattccggtgacgattgttgctgctactgcctggctttgtaattgtagcaggtagaatgtactgcggttgtcggcataattatcggcagagagagtaaaatagactcgctgatctgaacgtcactgcgtttgttcgtttctcgaagcagatcctcccggttctgtaacagcatggagtaataatcagacttactagtaccgtactgtggtttcggcctgctttattcctaaattttttttctagtaacatcacagcgaatttttgtatacatgagcattaaatataaataaaaaaactaactgcacagtttggatagaaatcgcgaaacgaatcttttaaacctaattagtcaataattagctataagtgctacagtaacccacatgtattaatgatggcttaattaggctcaaaagattcgtctcgtggtttccaggcgagttatgaaattagttttttcattcgtgtccgaaaacactttccgacatccggtcaaacgttcgatatgacaaaaaaaatttgcgaagtaaacacacccttctactactagtggtggaaggaacagtgacattttcagtttgctccgcacgaatttgaacctgtcacagtgtcacgtagtacactgtgattgtatcaggcgatcgcgatatactcatctcgttttgcttgttcttcacggagtacgggctttgctatcgcgatagagaagacaaacggggatggaaagtacgagtttggtgaaagctagacgtggtgagcaattcagcagcgacgttcgtgcaacggaccaggtcaagttgtgagatgtacatccggttatactacatctgcaagccggtcatatgttttttaaaaagaaagaaacatttttactggtttcaaggtaccagcattagatttcttgtggcccatgcattttataattggaatattttagatctcggtgcacagaaatatagattagctatgtgaaacctagatggataaacaatcgtgctttgcagtagtattttatagagctcgcgtgaagcacggtcgcatgacgttgaagtgacttccgattaagaacctgaaccaaataaacagtgatataatagtatataaaactattgtggccatgatatacttgtggttgtggccgatcgatataaaattagcaaaaccatacgatatatattttaaggatacagacatgaggactttctgaaccttacaaaagcaacgttatcatagttaaaaggaggtaacagagacggacagattatcctatgctttgtatagtcgagtactgtcagcaatctcctagaatcaggatcattttcagcgaggtttgtggtagtacttcactatccggacgctaatggacggatttttctctcctttttggactgtaagtgtctataacctcttgtactagtcttgctaaacatttcaataaacactcatttacataggaaagtaagtgaactttttgcaaaaacgaaaacttgggtttcttcttgagtaacatgaaagtgacaaaattgagaccgtcaaccagagggacgaggccatgctggcgtgacagcagcctcaacctactagcgaattgggcccccatgaaaaacgtcgacgagacgataaccttttttaatggccgaatcaatgcaggcccagatcgcggaccccatattggaccatggcaattggtatttggtagtccacgtcaggcccggaacctatcaagcggctatccaccacagtgccaggtgggcccgggaggtggtgggtcccacgggcagggagagaccaccggggcagtgcctccgtctcctgtccttttctccgtgcggtgatgtgggctcattggtggtgcgtgggccacggaatctgaaaggcaacgtgacgatcctcggatggaggcccgtcgcctcgtgctcggtgggccgagacgtgccggggattacatggacaagaagcatatatctacgtgactacgtggcagccctaccgtgtgtggtttaacactttaacctttggtttacagcgtgatgaaacggatggtacatacggtatgtcggatcttcaaaatatcgtatggtgtaaggtgcgtgttttaccgctcagtgaaaattactttggccctatttagatccttcaaaatggcaaaagttttaccattttgtagcactttttatcattttggatctaaacactagtagcaaaagttggcaatttggcatttggcatttgctagcccataatagcaaattgtgccaaaaagtgctttgggaccactccctctctctttctctctcactttagtgctagaatggcaaaactttaacatgcatctaaacaccaactagtacttttgcaatgccaaaacttttgccaccaaaatttttgccatttgccatttgccatttcaaatggatctaaacaggccctttaacaaaatgtttcagatgtttgtatcttggagaaaaaaaaattcaatgttcatcacttcgagaaaatgtttcatcgctgggataaaaaagttttcactaggtgtaacacttgaaaactatatattacaacacaaatatatcaatatgttcaatattcattcagaacaaaatggaacatcttaacgcagctaggtgcaacaaaaggaaataatggattacaacatcgtcaaactatataaaaaaaagctacactaccttcttcttctacccaccagagtcgtatctgggccttatcaaggaggtcacaaccaacatcttgttgacatgacaaccggcaaagccgtggagcaaggggcacgggggttcgcatgtctacccacaggaagcagtggtcatgctaccttcttggaactcatggcggtcctcatcgacaagctcctcgatcgtagccaactatcgttgtgcttcgcctcatcgcacttgagccaatggccaagccaccgccatcgctcaatcttccttatccctccgcatctccttctccctttgtagcgtcgtttgtgagatcgttcctagtgacggagctgcgcaagcaaactttagggcaagaggagcacgaggtaacagggaagagaagataagattggaggttgtatggtgatgaaatgcatggagtccctaatgcacccaatattccatcttgtgtcgaatgctcaatcttaaacattttaggatcatttttctaggcaatggaaattgtcgagtatggtaataggaatcttcaaaccagttacgctattattactatttaaatagaatcgaaataacataaatggaaacgatagtgatatcggtaataccggaacataaaaaaagtatcaaggctttgttccgaaattttcgtttttgatattttttatgttagtcaatgtatatatttttacaacgttgtaaaaaatctcatactattttatgaaaaatcttaaatgtttcatgcaaattattaatgaaaatgattcaatttgtgcaccataatgttattccatttgccttaaaaagagagtgagtgtgtaccagccttgcagagggcctataagttgtgttggtttgacgtggaacgtcgatggtgatagtttaacgggtgctaatgccatgcgtcccaaaaaaaaaaaactttaagcaagcaacactgagttcattacttgtagcgggccttcattgatctcacgccaagcgacggcccaaggcaaagtatacaggcccaggggagggaggttgatctcatgggctgagcttaaaatttctcatgctgtgtcaaactgccaattcactcgttggtggtcgacaacttgacatatgctgtctgttttattccccctctataatttggtgacaaactctgtctcaaggtgagataatttttttttcttattatacgtaagatgttttggacactaaggacgtgtttgaataatgggaaatggggggtgggattaggattggaaaatgaatgaagggttaggattaaatataagagggagaatgaatggttagaatttaaagatgggttgaaaatcatttccctttcccatttgcaaaacaccacctaagaagtaagacgccactgtacatgcaaatgacatatgtaagttttgaatgccaagacaagtagacttttcagttcgtgtttgaattatggtttgataagatgataaaaaatgttgaagtgtgcgcaaaattgaacagaatcatgcaataattgatacgcggactggtctgttaagcgcattgggttgcttatcccaatcggcacggcctgtggacccgtaattcttctccgtggaagaattacagagttgtcacgctgaaaaaactgcactagcgaagaaaagcagcgcccacctttgacataaagtttggactttgcactttggacctaccggctttggtatgttctttgctcttcttttcgttttttttaaccctttcctgaattgacttgctctgccttgtttttcttcctagactagattcgtagtggatactggatccatcgcttttgataaagcacacaaaggcagtagccatcttcctcatcctttgatcgcccccactagctttgacgaattggcaaagcaccaaagaaaggaaaaccacacaaaggccctgtttggaggagtagccgagagttattttaagagctatttttttagctcaagaaatagcccttcaatgaaatagcccttgagctgtttggatgcaagagctacttgacctttagtacactttcccaatcataactacccattttctctctttctccactagatcttttgtgcatgtgtcttggtgtggccggctgcatatgccatgctgttgtgctctatcactaggacagtgctctatctcgtatgcttgtagcataaagggagaaaacaataaagttttttctttaaaaaagagagatcaaattgctctgtggaggcgtgtactgctcattccattgcataagcactgatccatccaacgcatccacgccggcatggggaggaggagcatggccggggccgatcaccgacggccagacgcttggatttggatcttcggagaagaaattgaagccaccaccctccatggacaagaaaacaaatcgagcagtggggttcggagaagaaatcgaagccaccaccctccatggacaagaaaacaaatcgagcagtggggttcggagaagaaatcgaagccaccaccctccatggacaagaaaacaaatcgagcagtgggggccggtggtggctcaagtgggggagggcggcgacgtggttgacggtcggcaaggagcggggccggcggcgctggtggggaggaggtgggggcggcggcgctgctgggggccggcgaggagtggaggcggcggcggcgaaaatgccccgcgcctgcgcgcgcgtggtcgtgcggagagagagagagagaggaggtcgcgttttctaatcccgtgagcctatgggagagagaaaagacacttttcagtgggccccactcaaaatagctccaattagcaccctttgggtgagatagtttttttgggtgggctatttccaaatagccctcaaatagcacccttttggatcttttagggctatttaggctatttgagagagggctaaaaaatagccattggattcaaacagggccaaagttaaacacaaacacgagtgcctgcacaaaaaacactagccattttctgaacctaaaagcatgcgctcctcaccggcgtacgggtacaatggctgggccgctacgccgacagcggcacgggcctcaattttgatgcgactacgacatgtcactcacatgtgacatgttggttcggaagcagcgaactccgtggcgcttctggtgctcaaaaaggcccggacaatctctcagcgatggcagagcgtttgacgcgacgagttgccgtgccaccgggagcacgggcgtacgaacgtctgccgctggacaaggattttttttttctaaggcacttgtcaattgccatccaggtcgtcaaggcattacatgttgccacggtttttagggttttagtggattgctagtacactgtacagagtaggagtacatcttacgggaagagatgggagatgcatggttggagttgaatcaagtactgacaggtaaggacgacctagacgagtgtagacaattttcgaagaagagtagtacgctgtacgcgtacacgtccacgcgagttaattgtagcttccccatcggcgcgttattagccggctgcaggccaccgcggaggacatgaggtgactggctgtgtggtggtcctgtttggtttcattgtctatggctaccgtagctagtatgcgtacggagtactacgacgcaaagctggaccctctccaattggaggcaaacgggcccaacacgataggtgtcgacctgacatgacaatatataagctcccccgacatcgccgcgcgcacgacgcagggtccgcctctccaaacggcccccggccctccccgcggcgttgcgccgcaagcggacatgtgtgttagctagctgctgtattcttgaggccgcggcgtgacggaacgaggctagcgaggccgcgccaaggcgcccagccaaaaccccatctcttccgccgcgtggcgcgcctctgcctcctgccgttccatgcatggcacgtacggtccacggtgcacgcacaccgtagcactagcacgggcggaatagctcgttcatatagcccgtacacgctggcgcggcggccaaactccgtgtctccgtctccagtctcctctactccgtccgtccatacgtcctcgtaccagtgacagaacgtagtaggagcagcttgtacgactagtagtcaggtcagcggtcagctatactacgtacgaacggctcaccttgacgactcccccccggctgtcaatttcacgtgccattgtttcctcctcgaacgggggccaatgaagaactactcgtactcccactctccactaatccagtactactactactccctaaagtactcaggcgcaggcatagagtaacatggaaacaccagggagaagagggggtgtacaagggacatgcatcaaagtcaagagcatggaaacgataagaaaaaatccagccgtgtcagtcggcgtacgcccaggccccgaaaaattccagtgcgaggtcacgagtctccatgtagatatgtgcgcgcgccaggcagcgcacggtttgccattgccattgccagccagcttgagccagccagacccgaagcatggttagactgtaggaccggctggtccatgggaagaaggacacagacggacaggaaggcgccggagacaatgggaatcgtgttgttaaatgcgctacagtaggagcacggtgtcctgcatctcgccgatttggtccaaaatttgaggtgtaccgtgtacagtgtgtacacactacacagtctctagtaggagtacttcaattctcttccatgtggagcctctttgagatcacgacagagggtttttcatgctcatgcagccatgcggtcctgcctgaaacgaagaagtgattattcacgtgtggaactccgaaaattttggggcaaattgctgcttttgggaggtggtttggttaacagcatttagggcctgtttattttgatatcattttcaaccttactaaattttggtaaagttacaaaaggtggctatatttagtttgctgtcaaattttggtaactatataagaaatcctgccaaaattttggcaactatgctaaaattttggtaatgctaaaattgaaaatggcatcaaactgaacagggccttaggctctgttcgcaactcttggttcccaactccctattctagttttccacgcacacgctttcaaactactaaacggtgtgctttttacaaaaagtttctatacgaaaattgcataaaaatcatattaatctatttttaagaaaaaaatagcaaatacttaattaatcacgtgctaatggaatgctccgttttccgtgcatgctgtgtgggttgggaagccagactaacgagcacagccttagcgtacatgtgtttaacaccacttgtccgcttgtatagggcctgtttggcacaactctagctcctaacttcaacttacctagagccagagctgtgccaaacggtccagattctctgtttttggggtggagttaacggagctactcctaaaaaatgaactacaggggtggagataagtttttactgctctacaactccactccaacccaaaagacatattaccctttaattttttaacatatttttaaaaatataccattgaactacccccaaactctcctcctcacctccccccgctctctcccccgaaacttcatctcccacgggcgggcaaaggcggcgggccgatggcgacgctcctgcggcggcggcgggcgggcgaacggcggcggcgggcgatgcgagcagcgacagcgcacgggcagcggtgcttggcgggccacgcacaggcggcagcggcggcggcgtcgatggcagcgcttcgacgggggcggcggacgacgcacaggcggcgacggtgctccgacgggggcggtcggcgcgagcggggacaacgggcgatcggcgcatggcctgcgacgggcaacacgccgacgcgggcgggcaggtggtgcaagggaggcagcgcgcggagaggacgctcgggcggcgcacggccggcggcgggcggtgtgcgcagagacgatgctcgagcgacgcacagccgatcgatagcggggattcctttttttttcttttttttttgatatttttcagatttggagttaaaggttaccaaacacttttgggtgggtctccaacgctaataggagctagctccaactggtgtaggagtttagagctgggagttagagtttggagccctaccaaatagggccatagttgcactagtttgaaaactgatattctattccccaccaaaatgcaaagcataattagaggcgagtgatatttacgcatgagaacaatttaagttcatcaagaacacaagagtttaaacaaaatcgtactaatatatcaacttttaggagttcaaataaaactatacaaatataacaacttttagctaggtatctcggcatttaaaaattattatacattagagcggatgacgcggatcggatgtagagtatattaattgaagaatcaacacaattcttactagcaatgtaatgtgctatttgtacttttcatttatcgaaagagcatcgatttaggcaggcatccgtttataggttagtgttgatacatgagaacaccatattaccctattcaactactacctctgttttttaatatatgacgccgttgactttttctcacatgtttgaccattcgtcttatttaaaaattttatgcaaatatataagatataaatcacacttaaagtactatgaatgataaaacaactcataacaaaataaattataattatgtaaattttttgaataagacgaatggtcaaacatgtgagaaaaaatcaacagcgtcgtctattaaaaatggagggagtattatgtttgtcccttccaactaacagatcggtttagttcaccttctttagcaaaaactagctctccccaagggccagggtacattgaatagatttattatttgaggtgcataaatatctactctcttcgtctcataaaggctctattttttggcttttaatctcttcgtcttatttaaattttttttatgattagtatttttattgttattagatgatagaagatgaaaaatactttatacatgactatttgttaatatttttttataaattttttaaataagataaatggtcaaacgtcgaacacagaaacataaaaataaaatctttctgaaacgaagggagtactatacaagtggagaaggtgtttgttagacagatctaatagtcgagacccgtgcatataatactattagtagcattagtactattagtagcatgaactaagctgagggttctttctttctttcttttaactagggcacagtctccttcatgggtttgcacatacatgcacgtacaatatatagctagctcgtcaagaaattaggaagtgaaaagctatctcatatgtgtcacagtgtgcatctatgcagctagctagcgcacagtaccaatcaccgctccatttcactttttttcatgtgacctatagtgagtactccggtacgggagaaatcatgccgaaagcatggtttatgtcttgatgtgtgttctactaaatggtcgcatcccttgggaccagctccaaaagcctatagcagctaagctaagctaatcctgccctaactaatcaccgcaaaacagcagctttttatcagaacaccagcagcacaaacccgttcagattaagattcccatgatcagattacttaatcgctaaccactgcatcaccaattgttaattgctctttacacgtactacttctgctacacttgctcagtccaggccggcaacgcggagccaacctgttccaagcgagccgctggggcgaatgcttgcatgcaggttgcacgtactccagctgtaaagaattggggcgagtagacttgcgccgaatgattgcgccgaccagagaggcagaggccactgcactgaacactgaatcctctacctccagcagaatgatggcaagtgaaagaatgataccaagtgaaagtgccattctttaatcgagcaaagatgccctctttcgttaactggtgagtactccagtggttactgcggtctcagcccgagcagagtatgaaattcttgcaagaattaactcgggctccttttgtactgaaacacaaaatggagaacaacatgaacagtagacagctactactactagtaggatttcttggcagttgcatttcagttaggtagaggaaaggagactaccagttgtgctagttggaggttgcaacgggcgtctcatcagcggagcgagtgctaattgaccgctgcttcaccggaaaatgacgaggcgtgaaaacggctgcccacctgcccgcgagctagggaataatgacatggaacaaccaacgtcaaggcaaagtgtacgaagatggcgcgatcgcctgaagctttcccgaccacttcaaccagtgtgtcgcgatcggcgcgtccgtctccggccggcgtaagcggaggtgggggctaggctaggcatgggcagcaagttgcggctaaactataggacaattggtgaatccctctcattgtattcaaataagcattttaaaattttaattttttatctaacataagtttttcttttctgatggtatctacgagcaggtacaatagaaggctataagccagctataaccacatatcaagaagaaaagtgaagagagagaagaaagcgggttacatatttatagctagctgcaacacggactctaaaatattatttgtgtatgagaggtataaccggatattaatgatgtaatatatttctatagttaactattgtatgaatgtgctattatattagatatatatgatttggagttagtagttggctatactattaaacttgctctaatataagtttctttatacactgaaatcaaagtatttttagccaattaaatgcttagaatttaaaattgaatcacgacaacgatatggttaactctttttggaaatataataccaacacagtcgcttacaacatacacactttcacctatattaaagtacacacgtattctatccattcatctatatgagcacctgaatgactgaattttttttattaatctttactaaataaaaaaacaaatattcatatttacaaagcagtgagtagaggtcgtcactcatcagcccggctgctcctgccatttgttttgattatcagtgtcaactgtcaagtgttccgcaaatggatatccctatcgaatcgagctgacgagactgaacggtgtcgtgttctcattgaaagcgttcacggttgggtggtcaaatgtctggttaccttcattttcactttaattaacgtggacttgttcttcgtttgagatcgctttcgaggctgtgggggagaatgcagcctacgtactcggacataagttctccaattgattaatttgtttcagcttactaatcctcctttgaatgccccaaccacgtcaaaatttagcacttttttctcctataatttatagattattatggccagtctaaacggttaaacattataattattaaaaaactttatacaacttttaaactttacaatagttaattcattcatttctatcctcaaatattatcacaaaatcatacacaaatatagtataatctatcctcccttcatcatattataaggtcacgtttagttgttaaaaatttttaccctgcatgtcacatcggatatatagacacacatttgaagtattaaatatagtctaataataaaacaaattatagattccgctagaaaattacgagacgaacttattaagcctaattaatctatcattagcatatgtttactgtagcaccacattgtcaaatcatggcgcaattaatcttaaaagatttgtctcgcattttcctggcaaactgtgtaattatttttttttctacatttaatactccatacatgtgtccaatcattcgatgtgataacacgaaaaattctgtttgggaattaaacatgcctaacataaaattttgttaagaaatcaaatcaaacatagttacatagatttggtagtgtccaaatcaaaatcataccgggtaatttctcactgtggaaccaaagcagtgagtagaggcagacaagccattaaacaaagtgcaaatgattgactaataagagcccaattaggcacctaaattacagcgtccctgtaacaaacagcagcttgagctcactgcgctgctcaccccgtactcgtcgtaatactttttttaatctcttctcgaacaaactccccctttttatcacacacacactctctctcctctctttctcgcccgtttccccaccaccaccaccaccaccacctcccctctcccattcgaccaaatcggcgaggggaatagcccccccgcgcgccgcgcctcctctcgtcgccggcgatggccgacggcgaggcctcctccggcgcgtacagggagttcaaggcgctgacggaggcggcggaccgcaagttcgcgcgcgcgcgcgacgtgccgctctacggcggcggggtggaccaccacagccggaaggcgttcaaggcgtacacgcggctgtggcgcctgcagcaggagcggcggcgggagctcgtcgcgggcgggctgcggcggtgggagatcggggaggtggcctcccggatcgggcagctctactacgcgcgctacctccgcaccgccgagccgcgctcgctcgtcggcgcctacgtgttctacgaggccatctacagccgcgggtacttcgccgccgcggcgcaggtggtggtgggcggcggctacaggcaccagggcctcctgatccggtacaaggagctgcggttcatcgcgcgcttcctcgtcgtggccatgctgatgcggcgggccgaggcggtggaccacctcgcttcccgcctccgttcgctcgtcgaggagaccaagtcggcataccccgtaagaagcttagctcctctcgtgctttgaataggggaaccccgagttaagtttgtgcgcttgctgttttgtattttaggaaacctaaggagtaaggagacctttttaacttctagattagagtagtgaagaagagtgggaacttgttgatttgaaggttgttttgccgcttggttttgaaattttgatagaagtgatatgtacagtgctcttttttttttctgtataaagaattctgattgggaattttgacctggactgctgcttaatcaagggtttctatttatttcccaattcgattatatgtaatttaaaatggcaaattcgttctggtagtatgtaacttaaaatttaaaatcttactttatttgtggtgaactgaagtaatacgactgttcaatgctcgtcttaccattcggatttgggatattgcattgcatgagtcgtacatttcattaggataacggatttcgaatcatgtatggtttacagttttagctgctaaagtagaatcattctctttagttggtttgataattttaaagttactacgtactaaagtgtatgaactagagcaatttcacaagctctattacctttcaatagcatatatatcacattgttttgtcagtgcttaattgagaaatgatatgttgtttgagggttgaataatgaatgttatgctaaaacgatagcttagcatttaggagcctatgacatgagtgccttgttacatatttcccattttcttgcaatgttatatatttcaatagagaatcacatatttatatcctttctaattaaaacaccttgccatttaattcttccataacaactttgtgacctcatacttcttagaaaaccaacttcaaggaatggaaacaagtgcttcaagagcttgggagattcttgaaagctgatggagcatacaagggatctagatcactgagatatgacaacttgtttgactcttttccgtcgaaccttgcacctattgcacgattccattcaaaaagagtactgaaactgaaagaagctgtattgacaagctatcacagaaacgaggtcacatatattatccatcaataattgacccacttatcttactgtgaaaacaagcttgacattttgtaatatgtaatgcaggtgaagttcacagaactaactctggacactttcagaatgctacagtgtctggagtgggaacccactgggtcttatcagattgctgccaaagagcttacagaaaatggcactataagtgatcagagtggaccctctggcctgattgatatccacctatcatcagaaatatctgatggaaatcttcctgcaaatcctcaaaaggcaatcatatatcatcctacagtatctcatcttctagcggtaggttgtttatgcatgttgttctctttgaagctcagttttacataagatggaaatcaaatcttgatagaatcacggatcttcttttaggagattactcttgaaatgatatattatgctcaccatccagtgaactggatgcgtattttcccctttaacaatgtcattagctttatatcaatacaattgtctggttgacgtttgtgttgggttagcaagtctgtgcaagtcctcatcatgcctggatgttgtcatagttagatcggctgctgctgcacattataatttatttggtggtggaaccacccacttatttggcagtatactgtaccatttctcatgacacaaatggaaaaatgtgagaatatttcagctttgccaagttgcagtgctgattgacaatggggttaattgttgcaatccattggaatgtacttttattcattcacgagtttgatggtccatatgatttgttcttttgctatttgaaccttttttgtagtgttacatcagaaattcgtaatttcaggttctagccacagtctgtgaggagctttctcaagatagcatcttacttgtctatctatcagcatcaggttcccttcttgatctgactctgtaaaacatctagtaacattcttgttttgagtagttattaggttcttacccttctaactttagtgatcaaaatttcaggtttttccgagcagaacattacttctcaaaagtatgcctcaagctcatcatatgcaagggcaacttccgtgtatcccatcgataagccaaattccaatggcaattcagataatcatctatggcttggtccccgtggaagtggaggtaaagcatctgtcttcttgtagggttgatttctggaattatatctcagtgtaatgatatagttcaattaagcccactttttatggtatactaggttagtgtccgactagactgatggtctagtttcttgttgaaaggttgatacagtatgcattttctattctgacatgactgtatctttaccaggtccaaacaatctttatccagaagatctgattccctttacaagatatccactattccttgttatcgatagtgaaaatagtcatgcattcaaggcaggtttgtcagaacttaatcttagcttggtagatgaaaatcattatcatgagtattttgttatttttcagagccaaacttactaccctggattgcccatgccttttgttctgtagttcctatatggctttatttacattcattgtggatgaagggtcttgtattctcatttgttttgaagttcctactatttaacctactgtaatataaagcagctgcagtagtttttttcaacagagcatatgatttttctttccattttcatagatcactgtattgctaaaatctaggcactggctatccatagtagcttgtgaatccatcatttgattctgtatttttccaagtacattttaaaaactttaaacaaaatattctttcagaaaaaaaagataattaacttaatactacgaagggttttctcttttcattatgtttctaacaatttttttccctgttcttaaaaaaatgggagaacgaatttcttatatgagccataattgcaggctatacataatgcagagaagggagagccagctgccttgctactttcacctaggatagcatcagcaatgcctggtgtggaatccacgagtaatggaagccaatttacgtacttcctcacagctccaatgcaagccttctgccaattagctgggataacttctgacatagacagcgtatgcactttccttgaagagtcgagtatttgtggaatattgatttctatattttgagctcttctgcttggttttcaggatacatatgctaacgcggaaatcatacttttctccgctttggaacaatatgaaggaatcctctgcacatctgttggattgaacaacgtctggggacaaattttaccagatccttttctcaggcgcctgatcgtcaggtacctttttccatatatctccacattcaatgttttgactatctgccatttggttggaaggttagcattgcatcatcgcttgaagatagtatcttgacctcttccaaaacatgaaagtggttatttaacatgactagttaatagtacacaacttgagctctgtccattgcgatatttcctgcaaaccgccggtgggcttgtgaacaagtctatggaggtgtaaaagggaacagtggaaggatggttttacagcaccatacctgtacataatcagaactctccatgttgcattccaagacattattttgttccatatttattgcattgtgccaaatcatattccttcttttaatttgcaggtttattttctgccgagcagttatattctattttcaccctgaggagaatggtgaacatataccaatctgcctacccagtcttccagaatcagtcgcgccaaatgctgaagccatcatggcccccatccttgagtttgcagaaaaccttgttgtgagcgaccggtttcatttccgacattctgtccacaacaataagaaatgatgatcaggagcaacaactcaatccttctgtagatacctccatggtatataatcaagttatttgttgatttgttcgtatttatacagcaaacggagcatgattcagtatgaacaggctgctgcagcagctgcagcttggagagggtgaatgatttatcatttttcgctgcttcatctccattgagcatctgtacaagtttggttaggtggtccttacttttgatctaggcagtgtagggcttctctttccttttctttcggtttgtggtggagaggacagtttgtaagctggaagaggcattttttagtaccccggaaggcaaattgttttttagggttagcccaatattttgagagttagtttactaccatcggatgcattgcgttgcacatttgtctagtgcacccaacgtttgtaattgttgtttgtcctgaatgaagggttctggattattgtctgatgttctttctctacactggtggtgattatagttcgtaaagtactgaaatccatcgctgacgtttcgggatcatctactttcatctgacaactttgctttgagatagtcttgcaataaggatccaaggtgttagctctgggaaggaactatgaagtacctctggaaataccagtgggaagcatgtctgtgcctcacggtcagtcacagctggaaatggaatggcagctcgtttctcctttttgtcacgcgagcgatgagacgggcttggtgtatgttgtactgggcctttttcttagtgagacgcgagaagatgggctcatgggcccttggcttctcgtttcaccctaactaggccgtggggttaggggcggtaacattttttacaagcagcttatcacaatcaccaaatctcagaccactgccattagaagccaccgttgtaatgctaggacatcatttagtccatccactttaactatataaatattatgtgatttaaaatttataccatgatataaatatttctaggacactaatttcaatgcatgaaaatctatatgtttttagccaatgagatgctcggcaatggcggagccgggcctagggcagttaaggtatgagccctaggctcgggccaaaatcccctttgaattctatataaaaattttgaacatatattgtgtctaattgaaatacactgattcagccctacttttgtaattttcctggcgccgcccctgatgctcaggaatttaagtaactcaaaattcaaaatattcatagaaatgagggtgagcatgtgtatgtgagtgttcgtgtttgtaccatgctctcaattttttttttcaaattttgatcattgaaatgactaaaagttttttttttcatttatcaaaatttttccaaagaatatgctcatggagtattttggaacggatgaaatatcatgtacacagaatgtgaatgccattttaaactcttctcggagaggttttcaactctactggtgttgtattccatacatgttcacacatcacagagagaagaccagatggatccctcgggaggtcagagttgatttttttttctgcaaccctggtgcttccagaaggggtattatagagtttgacattgcaatatccaatcagataaacttgtaaacgccatcccatcagctctcgcatgttaccatagctttccgttgtctagttgacattgcaatatccaattatccatacatgatacatcagataaaaccaacgcagcagatcatgtaaatgtcgtcagctctcgcatgtttacgttgcttctgatgttgatttgacgctgcaatatccaaactatcaaaatctacgtaggatatcctgcaaatgccgtcagctctcgcacgtttacgttgcttctgatgttgattcgagagattttcaattccaccgcccacccagggtttgaaattttggttcagaaatttcaccccccaccagcatgctcaaatctcgcccaaaattttctcttttttttatattttttaaatttggtcaaattttaatcaaatttaagtcaaattttcaaataatttcggctcaaaatttctgaaatttcgatgacccccggtataaaaaccaattttgaaattgaaaaccctgtgcccaccggtgcttgaaaactcatgatatttccgtgctcccaccatgtaaccgtgcccatcggttgatcaccagatgtacgccaccttcttccttattgacgtcaggggcggcgtcctccggcggcaggacaactggccgaggaacgaatctagaaataaattgtaggggaatctgaacaaactagataaacttacatattagtagtggaggcttaagcccccacccccataatagatccaccactggccaaggctgacgatagagcgaacgaacatagcgacagggagtggagctaagcatgccccaagtctcctaacctccattgcgacgagggacctatggttgtagaagtttctggaacctttggaatcgaagaggccggtgatgagaactggatcgtgtctgcacctctgcggggttggaaaacacccaaggggtttggagttttcttatccgtaccccttgggaaaagttgtaacgcgtaaataacttgaaaaagagggttcgttttgaaaagtttccgcacctcccagcctcaccggtcccaccgtcgtcattgccgccgtcggctacggccgctggtgatgcagatcgtgagttcgcttgcagttcatgcttgtttcagtcgatgaactgatggagtgatggttcatttgagtatgtaactgtcgcttgtttcagtgttttgagataagaatgcatgtttgatgagtgctttagagatgatccacaattttctacgattccagaagaattacagcttttggggtttactggaagtgtagcgtggctcagccttctatctctcgtttgttttgagtagcctatgtttagcagtagcctcttggtttttcctcccccacctcccggcataggcctgtttggccgattgcgttgtgtaattaaaactatttttcttctaatatattgacgcgtaatccctttgtgcgttcggaaaaaaaaagtactcgttgctctatttgctgttgctatgtttcatatataattttgtcttaaatacgactctctaaattcattcagataagtagttcaccaatcatagattgattttacggtcgcacttgtctcaagactgagagacagagcgtgtctgcgcctctgtggggaagaagagaggtcagaggaggactacatgtgatccaatggttggaaaataaccaatggggttcggagttttattttccgaacccccttaggagttgtaatgggcaaatagacttggaaaagagggttcgtttgcaaaacttttgaacctcctgcatccccaattcccaccgtcgccggcagatcgtgacgtggtctgatctttagactttggtgctgcaatgcttgttgctatcttccgctgatgacgaactgacggagtgatggttcatccggtaaatatctgactctcgcttgtttcagtttaccgtgataagaaactattatatcgtacgctttgatgaaagattgtggatgagacacagttttcaacgatttcagaggaattttagcttagggcacccacaatggttatctataggctctctacaagagatccatatcagcatatttttctacttgaaagagattaaatgaagagagagagagcacaactatctactaacctagagatagtctatagagaaaaatgagggaatggattagagagctatagatacccatgtagacatactattgaggtggtttactattaatctagtctattgctgagatgtacatattttatagagagcaccttattttaccattgcgggtgctcttagttctgaacttctgatatacatgtcgcactaattgccgctatcaaattcagagttttgtccaaacacgtctgtccaatttcagattagttagggcatgtttagatccatttggaatggcaaatagcaaaaattttggtggcaaaagttttggcattgcaaaagtattagttggtgtttagatgcatgttaaagttttgccattctagcactaaagtgagagagagagaaagagagaaggagtggtcccaaagcactttttggcacaatttactactatggactagcaaatgccaaatgccaaattaccaacttttgctactagtgtttagatccaaaatggcaaaaagtgttacaaaatggcaaaatgccattttggaggatctaaacaaggtcttagttcaagcatgagcaggatttgctagaagcggttcccaatcggaacagtgatcacggaaacggagcagtctattagcgcgtgattaattaaataattgctgatttttttaaaaaatggattaatttgtttttttaagcaactttcgtatagaaacttttgcaagaaaagctgcggtttagcagtttgaaaaacacgcgtgcgaaaaacgagggagaggggttgggaacatggggattgcaaacacaccactttactccagcagctcgccgccgtccgccggagccggaaaccgttgccagcgtcaccaactcgccgttgcctcgccaaccaatgccacgttttgcaaaaatacacgcaattgtgttaagttaagccacgatctgcgaccgtgcacccgtaatcggatggttataaagtagccaaaagctactccgaacccccgcgcgggacgaggcaagaggctcgcttggctggaacgcgagacggcgcggcagggagagcgttttgccgcttccgcgtgaatcggaaacggtcggcgacgacggagccgagccgcagagtggttgcgcacgacacggcgccggtgttctcgtcttccgcttcggtttcttggttctctgtctttgtcctcttggagttgcgttgcatggcgtaatatcatgggtcaatctgttgtccgatggatgaactttgtgctccgatcgatcgccgccatgccaactgcaaacagggcagcgaccttgctccagctccagagcgtataaaccgctctgcacgactgcacccaatggcttgctgctaaaactgaattttttactcaaaatcttttttgaatatactactagtattaaactgctgcccaagaacgacccggtctgtgagtagtattatcccagcctgggccgcatgcttaacggataagcatgcacagtgcagcgttcccatggttttgtaatcttgcatgccgatcgatataaaataaccgacccgcagtagcaagttccaaccaggcaaccaagcatccaagctcgtctgcccctcttcagatcaatcaatcccctgcaagaatttagcgtacattatttttacgccgttttcaaactcttttcgcagaaccgaacagcgacgcccacatggaaaaaccgaaaaataaaatggcccgtgtggccgtgtccggattccatgcgaccaaaagttcctatttacccagctgcattcgccgattgtttagtatcgcgaacagtagtttcgtgatgaccgtatcaacggaaaactatttttaactctagctaatctctaattatttgcatgtcatgaaaataattaaaaaaattaaaaagatagattaatatgtgataaattatttcacaaatatgcaaggtcaaatttaacttctacaagttatagcgaaaaaaataaatttgactgtgaatatacgttaactggtcatagtttaatttgtttttttcgttgtaacatgtagaaattaaattttaacttatttttatagagtgatttattatatattaattatcttattatattttttaatttttttcatagtcatttaaatgacatacatataaacagaaatatcttctcgaggatttaggatccactctcgcatcgatcaagccacacaatatgtacacgagcagaggagatcgcacagctcgcctaccggtgcgtgcgtgcagagcgagccagccagccccctgtaaagtcgaatcgcccacggtttgtaccgccggtaaacgccctcgcgacccttcgatccccttgaaattcttgaattcttcctgcctcataacgcacgaacgcacgtcacgaagctaggtagaaagcttcgtagtcactacacgaaacacacttgcatttgcacagttatctctcaatcgccacgcgcgctcaccgtcagctttctgcggtcgcacgtatgtactacgcgctggatatatacgtgtgtacaagtgcaggttgctcggttgttttgtgtagtgtagatgtgtgaaagttaaaaccagccgggtcacttcgcttcctgtggcagcacagctagcgcgtggccatggacgaccaccagagcaaggtgcagcggctgtacgacgcgtgcgacgccgtcttctcgtcggggagtaaagcagggttgccgacgctcaagcagatcaggtggctgcaagacctgctcggtacgttatactcctatctttcattgcatcttggttcatacgtgtgcaaattaattaatgtgttggttcattttgctgattttgcagatggcatggaggcggcggacgtcgggatcgaaggcggcggcagcggcggcgagaggtcgtcgtcctcggaggacgacgacgagaggagcccgccggggcggcggtttctctcggcgcgggcgttcacccggatcacctacgtgcacatccacgagtgcgacgatttctcggtacgcatgcacgcgcgcgcaatcgnnnnnnnnnnnnnnnnnnnnttagtatttttttgcactttcgcaaaagggtgagatggtaccaatttgacgctcgatctggtggcggtgttgcgcggctgcgtacgtacgtgcagatcggcgtgttctgcttcccggccggcgcgacgctgccgctgcacgaccacccgcaaatggtggtgctgagcaagcttctctacggctcgatgcgggtcaagtcgtacgactgggcgaacgcgcccccgtgctcgggcccaaggaagagtaagcatttgtctcagctgcatgcgaatgcatgcgcctgtttgccgtcgattcgctcgctgatgatcaatcgacaaaaaaactcgatcgttttctgatgtcaagttgtcaactgcatctaacatttgttccttgtctcacctacatatactagtttgaggttacctggctatgatcaaggacagaaaaaggtctctgataatttacaagcaggatgagattaatacctccctacaaaatccttgtaaaagacggtttcagatagccaaatcccaccgatgtctcaccaaaccagcattttttttcagcaatataaacaggagaacctatctctccctgtccactgctctactcttgatacagtttttaatggtttggaatttgcaaaagatagctctcgcctgaaactggaataactttttggatacttgcagcctctgtcgattaatttttgaattactactagcttacttcggttggaagcccaagccacgtgctgttggaaaaacaacagtgtacatagaatgaaacaactgcactactagtagtatcagaaattgccgtttttatactaagaaaaaaaaaagaaaagtaagtgacgccatcccactgctttccaatatggcaagatatccaaaagtccaccaatcctctcaagaagagacagtaacgaaattctcacaggaatatagtatttttcatgcaggtggtttagcccgagtggtcgccgtcgacgagatgcgggaggcgccgtgcaaggcgtcggtcctgttcccgcggagcggcggcaacatccactccctcaccgccgtcacgccgtgcgcgctcctcgacgtgctagcgccgccctacgccgaggacctcggccggccgtccacctacttctccgacattcccatcccctctctccctggtacgcacacaacatgcatgcataggaatcgctaaccttcattcgatataaaataccttcaaatattacatattttggatcattgggtgtgcttcacgtttcatgctcctgtctttttttttaagccccgatgatctcctcatcttttccaacactggcaacattccaaactttgatagagaacttacggattagagtcctaggttagagaagttcgttagttttagaggataacctaggaggcaacagttcgggtgggcagcaaggcgaccgcggtattgccaaaactacagggtcggaagtggatagtgggccggtgggctggtggggaaatgtagaacaaagttaggaggtggtggcggatccagttatggggagccacgggaagatggcggcacaggggtagccggcttgaggacaaggtgaggagaggaagcggggaagaggctagcttagggatcttaccgatgttgttgaccacttctagtcagttgacaagcttgggtggcagcggcgatggtggtggtagtggcgatgaggggaagtcggaagaaagagagagtaagggaggggtttgaaggtttggttgtcttgtactccctctgtcccatagaaaacctaataggctagtacatatatctagattcattgtattagaatatgtcaaatctagttttagattttttttttgacgaagggagtagtacacaacataaagtaatcgggcggtctaaaatattaaaggattttttgtcaaatgatgatagaaggtccctaatttgcatagcagcacaggtgaccgtggaatgatgatctgttgagatttctgacagtgtgatggctttctctcaggttttgcagtactggaagaggcagacttgcctgacggtttccgtgttgcaggggccccatatgtaggccccgagctcacaatagacatggacagcatgtataattagatagctgatctctgcttttccagagtatcagatcagatagctctcactgcttttcttaaagtagcatttgcatggacaatacattgcacctcgccatcttgtatatacgattatgcatgtgtgttgtcggtttgtctttctaccatgcttatttaccagttggtgttggaatgcttttttgacagttttgctcttgtgctcctctacgcaatgtcaatggctaccactagttttctaagctgcccactgtttggaatagacctctccatttatgaactactactacgtactcctagttaactttgcattaccgagaattaaccagacccggtctttggtgccagtatgccacctttggcttagccttatcactcatactagaaaggagagaccaaaccacatcaggcaatgatcattagctcgatttctcagttatttatcaccattcaataatcggcaataagcgggtaaccctgaaatcacaagcttacaggtaggtgcaaacctgccatcggaccaaaaactcatatatgaatagccacaacactctcatatctgagcagctcctctcgaacaccaacagctggggagtcaggggactagcagctcgttcgtcagaagtccaccaggaccaccgccttggacgtcgccgccacctccgcctccacaggcggcggcgccggggcattggcgacacggcagttgcgtcgtatctctcccttcctggggttctgcagctcccccatcttgatcatcccttcgacgaaggccctgaagaaggcgccctggtcctcgccgaatttcctcacggagagccgggtcccggcgttgtcggagaagagcgtctggtcggagttgaggaagccgcggaggcggacgaggtccttgaagtactggttgtcgaagacgagcggggtggcgtccatgcctccggtgacgttctcgtcgccgccgcgggggcagagcgagtcgagccccgcgcggtaggcggggtccatgttggggtcgggcctgccggagccggactggttgtagaggcggaagacgatggagaagcagcgggcctcgccgatggagtgcgagccggagagcgcgacgaggtcggtgacggtgaggttgtagccggcgaagagcttgatgagggtggtggcgttggcgcgtgggctcggcatgatgttgtccgagtcctcctggctcgccgtcaggctgtcctcgcgcccaagcctcacgtcccagaagggcccacctgtctgtgatacagacacaagaaaggaggagagagagtcaaatcaagtcaataatttcactgaccagccaaacgaacctggaaattaacaacccaaatcttccaatgttacagcattgtgcagacatggatattgattgcaacgtatgatcatttatttgtatctacatttgtacatttgcatgcaa

SEQ ID NO: 29181 - DNA, 797 bp, Oryza sativa
tacccatgaattcagaaccccagagtccgcacatcctcaaatacaaagcacttccctagttagatgtaggttagacttgccgtgtcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctaca

SEQ ID NO: 29182 - DNA, 1689 bp, Oryza sativa
agaagataagcatctccatggtgcgagccagctcgtgaaaatacagtatctagaagataagcttgaagcacagtcgagcctcccgagctcctataaaaggaggggtttgctcagctgagaagaacaacaacgaagacaccattcagagcaaagcttccaagcgcgctctcaccctccattccaccattcttagtagtagtgactttagcctaccttgcatagtatattgaagcaaggagttgtgtaataacgctgtgtaaggtaagaacagcttgcttgtacctaccttcgggtttcccgaaaagcaaaaccgtatgtaagcttatctgtttaatatgaagtaattttccttaagtattcctgcacgtttgttctagacaagtgtttatgctaaggaccctataggagaaacctcttccgttttttctcgtttttagcctgcatcttgcataggcgtctggagaatcggtatccgtagagaagtgttcccttcgggtggaactgcctggggagacgataaactcttggctagaacaagtgtgacttggaatatctttttaagttgcttctaaaaagatagataggtgaggcatacggtgagtaccgagtaggactttacatcatccgaagcaagcttctgaggctgtctaaataggattcgccaccctgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgttttgaacagtgtttttttttgtctgaagcataagtgtggtatcagagccagtcattatagagaaatcaaattcagaagctaatattggaaagataattactaccaaagataatttgaatataaggtgtagattaaatcacattgaagaccatagttggcactctaacaatagtcaattaaatttaattgttgatctgatatataatttttatataaattgggataaaaagcaagaagatttagagcgaaggtttgaagatttgtttaaagaacgaaagcaatctgaagaacaatatttgcttgtcagtaataaattaaattcagtgctaaaagagctagaggattataagataaggcagaataagatattacaaaacagtgactatatcaaagaattattagaaataataaattctagtaaaggaaaagagatagtcttggcttcaacaggcataattacctcgtctcaagctattaattcagaaaaatggacctatctaggagtttgtttagaagaatagcaagcagagacgataaatctttaagttgtattgataaacaaaaaggtaaaaatgaagacatagatgagcttgaagatattgcagaagtagacaaacagctcgaaagatatcaaagagatactctgagggcaataagacctcaacaaatatattgcatgggatttttgagaataaaaatgggttatacagaatatctagagaagtagagttaagcgttttaacaaagccagttgagttaaaaattgtagccaaggaatttgaaaatggattaaagtattcagggtataaatatattcactaaggtatgtatataataggaatcaaaggtatgacaagaaagaaattaggagctaaagtttt

SEQ ID NO: 29183 - DNA, 1499 bp, Oryza sativa
agctagagtaaagaaagtaaagaagaacgaagatatggcagtagaaatttttaaaaaccaagaaaccaagatagaacagataaagaggaaagagcaagataagcatggcaaagaagagcaaaatctttgtaaaattttaagtgaagaagagcaatgggcaaagaatgaaagattatttcttgaaagttatgaagaagaaattaatctaataaatgagatggagaacatagaaaatgaaatagacaatgcagaacaatataatgattttataaacacattagatgaagtagggttacataatcttgataatgcaatggaagctatggaagtggacttaggaacaggaaagagaaaaagatatggagaaggtactgtgaaaaacgaaggagaaagagaaagaccagctagggcagcaggaaaatggcccccttatagagaagaattttcatataactatataccaggtcaatataggcatatgggtacaaagagaagagactttgagaagcctgttaaatttcaaaaccagaggagtgatggtgctatattaaatttagccgcacatgaccctattgattggcctaatattattagtatttggaaaggtttaatagttcaaaaatatatacaaaaccagcacaatataggaagtaaagttgaagatatgataacttacttagaaacatttttgataacttacttagaaacattttaggtgaatctgctaaggtctatgggaacaatgggttgaaaaaattcctcttattattaaaaattggaaaaaactggtagccatccgcataattttgcaaatgttatatctaacattattatagctgaagatccggaattaggttatacaactttgcaaaatgaaaggttaaaagaaatagaaaaattaacgttaacaagttggaaaggcataaaagaattctcccaacattatttatataatgctacaactgctaaacaaggatataacaggggtatagttgaacgttatttcaataaattacctgacccactaggaagtatgatatttgaagaatataaaaaggaaactgaaggagctgaaatcaacatctctcaagccataacttttgtgtttaagcaactaagaaaaatatgcacgggtatccaagcccaaagatctatgaaacactcggattacaatttctgcaataaaatagttcaaatacccttatcatatggagaagacaagcctagaagtaaaaggatttataaacatcaaaatagaaaccataataatattagaacaaagaaaaggtatttcttaagaagatcagataatagagcacccttcttacataaaagaaatgtaagaagatataatccaaagaaaacctatgacaaaacatgcagatgttttatatgcaactcgccagatcatttaagtagaacatgcccaaataaaaatcaaaagagatattctagtaaatatgaagaacaagagagggttctaattatagatagcgtaa

SEQ ID NO: 29184 - DNA, 2107 bp, Oryza sativa
gccagtcctccattggtttactggccaacaaactagcaattgtaatgatagctaatggcacaccacgacattttttcaaaattttgtcacatgcctcaactgatgggctatcaagacatttgccttcactgtcaactatcctggcatacaataatttttcacagtcatcacgagaaagtggctgcattttgtaaacatcaccaacatgtgtggcaacttcagaaatgcgagtggttgcgactactctacttccacacttacagtcttgcagagcgcatctgattaactcccatgatttcttatcccatatgtcatcaataacaatgaaacatctgtgcagccgcatgacagtgcaagagccatcaatttaataattgaaactagtagaaataacatattaaaacaagaaaagtggcaaccataaaaaaatatcataactactgaagctaaagaaagcattataactattgaaacttaagatcactcatataccaaaagtaaattgagaccagcattgggtgatcatcatattcttacctcattttctgaacaaaattctggagcttgtcgataagttgcctttcgtcaatatcatcacatcagaaactttgaagccaaaatcaatgagaatgtcccttaagactttctgtatgtcaggtactcgaccgactggaacaaaaaccccacaatcgaagtccggtttaagcttgtcatagactgctttggcgagagtggtcttgcccaatcctccgaatcccacaacggagacgatcttcatgttcctatcatccccaagggacagcatctttataaccttgtccactggcccatcaataccaacaagctctgttgatcttttgtacagagcctgtaggcgaggatcaatgctcgctggtcctgcaggcttggtgatgatgctatcaactgtgtatctagcacgccgggcttccacctcctggagtttcttgtcaatttctttgatcgcgccagcgatcttgcgacgatccttggtcctcttgaacagtctgctcatcttcttccggaggtgcctaagcacagaccggtcatcggtctcggagctgtcgatacgcaccaagaaggtgtcgacgatgtcctccatgtcataggacagctcccggacatcgcgtgcccagagcttcaccagctcatcaagctgctctggtgttacctcaccgactttgcggaggacggcgtgcacgctctcgagttcccgtgagagagacttgaccttctccttcatgcctgtctgcaggtcatactcgtccttgagcagctcacctagcttcgggagcaagctccccatcgcccctgtcaccagctccatgattcaagcttgatcaagcaggttgagttgatggataattgaacaatgctaatagtgtggtagtgtttttggtgttatcctctgctaattgtatggcagcttcctgtacctcatcttctcagacttctcaccccccccccccccctctcctttttcagtcacagccaagataaggatcttttaatgaaagaaatatttttttactcgaattttatatgaaatttcaactcgctccctaaaaagcacttcactcggttttatctgaacttcaaaactctcaaatctctaactcaatttcaactatcaagtaggagtatcaaccagaaacctgaagcatgtttagctctaatttctaacagcttccaactcaaacctcacaaagcccaactagactaatactagcagatcactttcacagtgagtgacaacaaaaatgtcccagctattggaagcccacaattccaactaggtaaaaaaaattttacagaaattccaaacgctcccatctaaagatcccaaatttcatcaaacaaaatcgcttgaaatgctaactcaagaggcccctagctaccttctgtcaaagggactcgtcattcatcgctaagcaatgagtctgtagccggagctgctccactccggcgattgagcagcggcgacggcggcgcatcggaaattgctccggcgactggatgcggcaatggtacttggagggggcggatcggcggaggaggagattggggggccacagaactacacaatagc

SEQ ID NO: 29185 - DNA, 17300 bp, Oryza sativa
atatatattcttttttaacttcacagggttcatataagcataattgggccctgggttgcaaacgtgagtagcgtgtagagctaacacgagaacaaactcaatcctgaagaaaccacccaggaatagccagtaacatgcatcgcaaactgcaagcaaacattaacatccacaagaagaccacatgttacctggatccagcggccaaaacttaatccaaccaaaagcattatcgtgatataacaggtatacatagaccacggtttacttatggtcaggttaaagaatccagaagaaaaaaaaaagagtaattatgcaagataccggtacagtttcctgtctgtcttgtccctctccaagaactcgcgctcaatcagagactcgactctcttcttgatcaccacagggttcggcatgaaacgaggctgcagctgcttcgtcacctctgtcactatgctgttgtgatccagcactctcctcgacttcatgatcctcacgatggccgcctcgatctgaggcttcctgtcctcctcgactctctgccgggtctccatcttctctggctcagactccttctgtgtcgccaccgtgccgatcttcaccttgaacagcttgctggtgaacttatcgttgacgtagaagttgtcatcgtcggagatgtccctgctcataggttccttgcgcagaacgttcttgcccttcacaagcgcgagagactgaaggcagcgcttcaggtccgcggatggtatcgctgtagtctgctcgatatcacggtaagacaaacagtccgccgagttgaacaacatgagaacacacatctggtaggtcgacacgtttagctcgtgcttgctgccatttccaaacactgctttgatgtctgcagtacccatgtttgtttgccatgtcagtctcctgccattgtgggtaccaaggtagaaaccccgaaacatctcggacacgccaagaatctcaagaggaaggttgcaggtgttacatggttgtgtgggccaagacccagtggtgagtatctggacagatatagtaggggcatcccccaaatcaggagtaccagcgtaaaatcgctgggtggtatcatgagaggtcttcaaatcattgaacatgccctccaattttgaagtgaactgatatccacattctgtcttgagcttcacaagcatacttctctcagaatcatcagaagcagccttcccagaaagaaggcgcttcgccaagtgttgcttgtagtatttctcaaacaaatctttttcttgcaagtacctaaacagcatcatcactttgtccaggacagtctcaacatcctcctcattggcctctttcattcctttacgcagtttgtcgtcaacatacagcgagatgaactcagggcatctattgtttaagttaatgaagtgctcaaaggaggaattcagagcattttggaaactcttgtcattgctaaaggaagtggtaacaatactgtcatacttatccttctcatttagaagcctctggacaaaatcaacagggtccttcagcctctcaggatccattaccatatccttcccggtttctttaacatgtgaattcatcacagatttaattgtcgagtgaccatcgggaacacgttgaaacaagctgtacatcatggtcaggtcttcatacttgtcctccacaagcatattaacaagacctgagttctccataagaatcaacctctgcatgtgattcgcaagcatttccttcaccacaacagcagttattttctcgtctgttttggcatccatgtactgtgaaacacgttccgcttcttcatcaagccgctgctgagccttcttaagatattcaccacaggaacaacactctatgaatttttgtgactcaccactataaaaactagcagacacctcaaggaatggcctttcaaaatcatcctgataaacagaagaacctagatccatcaacattttagttgtactcctcatcaaggatctgtttatcacctcacctgttctctctctatgtatgagatcaagaagagtgtcaagcaaccttccatggatcttgggtgaccgaacaatagtatctctccaaagatccaatccaagatcaaatacaggtgtctttttattggtgggaataaaaaccctgtccatgtacatcaggatatctctgatcatttgcaaagccttgttatggtcatcccatttcctctgtagttctaccaagaacaaaccaccttgagcagcctcaatcgatacgcgcatttcttgcaggtgatcttccatgttttctgtcagtttgtcatagagctttggcccatgtttgtgaagtaccagattataagcagtcctgccagaatataaggacaatattatgttctggtacgtaagaaggcttattggttccaaacaaataataatagtatactgtgccatgaaaggctggtagctcagacatgataccatgaaaagccaataataatatcgaaggtatttccagaaccaaaaagaaaaagaaaaatcagatatcacaataacacatcgcttaagggcaagcaaacagggcagttggcctttgtttctctcttaaaattctatttattgcacttttttaagagtatacaatgatgcaagggacataacaacaactacaaagttccattgaacaagttatgggtactgcagtaatccagtttcagtatgatagaagcactacctacagactacatgaatagtaaaagaccatgctttgtgattgtagaaatagagttcttatgtaaggaaaataacaattttccactgaaaaaacaatgatgtaaagaagaaagactttcataagtattttgagacactgttcagctaatcttgtttcaaggggataagagtttttttttatgcgcaaacaaatgcatagcatagagcacgcaaactctcaagtgatgagaattgatctgagatgaatttccctagaggtaataggcacgcaaactctcaagtgatgaatttcttcacaaattaaattttgtagaatcaatggtattttccttctaataaaacggagtattttccactttctcaaacacctcttacatgtggtttgcaacatccaaattgcttgatagcatggccaccaaaaaaggagccagaaaatgcaacagcactacaacatgacttaagaatccattgcacttaaatttatggagcaaaagcataacgaaccaagagacccatcaatgaaccgacatacgcaatctcccaaacttctaaaccaagttaaaagtatttaatgctctacaaattaagcagttaactgcatacgatttccatctggctgacaaagctccctaccaatcataatggggcgttacgtctacagcgataaccgacaagcgagcatcaattattatagtgaggttcaaatcccacataacagatcatgaatctaggagctgtcctaaactccatctgcaatatacaaccctaacaaacaaaatttctaattccttttttaatgaactatgtccaaatactcgcatcacatatcgccatctccgcattgttgtaaccgcaaaactaaatcaaatcaaatcaaatcaggcctcttatctttctttctgcccctgtacagcactgacagggagaagcgcgatgggatgggggatggggggatgggaaacctgtagagctcctcgaaggagaggccgctggcgttgtggttgtagatctcgcggatggcgtcgtcgagcttcctccacgccttctcgaagaacctcgggtccgtctccaccttgtgcctgaacggctcgatcctcgacggcttcttcctggaactcatctcccgccgccgcccgccgcccgccgcccggcggtgatccggcgaggccccccgcctgctgctgcggattcaggccgcgagcgctagggtttcgtatctcgcgggagatgtggggggaggaggaagagagagagaagggggaggaggagatgtttctcgaggatttttgtgaaattcgttttgtttgtgtttttaagcgaagatgagaagatgagggagagcttgaggtggattccagcttgggcagttggggatggagatggagtccggtttggtttgggggaacatctgattattttgaggattccggttcgaatttgttttttttaataaccacggtttgcgagcattactgatccagtaattttttgaaattgataaagacaccacggacgactcgttatcgacggttatatcgtctaccaccgaaaaaataaatagttatcaatgcgatcatccgtatcaaataatttgaaccggggtgagctggttccaccacaagaaacctaatcagttgagctatgcttatatttcgtaggttgaaattctaattgagttccatcactaattggaatttgcatccagtacatatttacgattgcgtttacgtcgacacatatctacgtattaaaatatgtatattaatccgaaatacctattaaaaaattgtgtaatgtttacattgatagaggtctattatttgaatttaaatattgttaaaattatgtttatattatttctttgtatttgaagggagagcatgtatcaatctgaactacctatctctcgtgcaattaactataacaaaaatcaagagattggtagaaaaaggcgtagtaccaccagatctacaagtatgcttgaggttttataaactcgaaatgaactcatattatttttatatgttgtttatatattaaagtattgtagtctgaatataagaaattagaacgatgatatatttcgacgcactagctaaaatggttggatatgtgtgtgcatattttaagtacgacggcttaaatttgaacatgttcataggataaattggtgagtttggtgccaagtcaaagaagtcgtcatacatgatttcttttatatatcgtattccgacagagctcgtggctcctcaccgggagaccgcgcaggcccccctttgccagttcggccgggggcttagggtgagatctcaagctctctctgtatgtagaaagatcgcgtgccaggaagaaacgcgagacacggacgatctatacaggttcgggccgctgggaagcgtaataccctactcctgtgtttttggtggatttgtgtaagagcaagttacaaaatatcaaccagccctctcctctcccgggaaaatccaaaatcccatccccctctccttgtgggcatggtcctccttttatatcttaaggggataccacatgcactcttcccttttcaaactggacttttcttctttacataaatggacggagatctgcacggttgccctccgaacgtccttctgatgggacggcacatacctacctccacttccgccgggggcaggcgcgtcgtgggaacgtggctgtgcgctgacgacatgagcagtgtcagaccggtcacaaatcggtcatccttgtccaccgcgtgtcagcttagcaacgtgcatgtttgcccttcttcacacaacatcttgcctgtaatggttaggatgaagcctggtattcatctaaccagggctaacgtgtcatctctaagaggtaacacgctagctccggctggagacgcgtgcctagaggctctcgtcttgacgggacggggcgtggcgtgcgtcagaccgccagtcgccacctaaccgttgatctgaccggtctgtgactggtcacagaccggataaaagagcgcgctgcattgcgctgcatgcagcgtgacacgcttgaccaaaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgtgatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagccatgggcggtctcttcaagactgccacatcacttgagcagcgctcgaatctggacgtgcagattcgtttcgtctggagatatggtaacgtcgcttcggtcggcgatcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaagacttgctcccttcctttcgccactattcccctttccttcgccgtttgcgccctaaactctctctttgctgcgcctcaccttcgccacacacgctcgttctcaaccctctctttctccgacgacatggcacggggctccgctctgctcgacggtagcgtactaccgccttcccgcattgtgggcgagaggcaggctgggctgccgcgccgcttcatgccggaatccgctaccggccgggagatagtgatgctgggcgaggcgcgcccagcaccagattacccggggcggtccatcttcttcctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccagtgttgaaccgctacatcccctgcgccctccgcaagaagtgggacgattggaagagcgactggttctacaccccccttgccaacgaagcgcgcctccgactcccaagccagcccccggtgccggtctccagctggcgggcgccagtagatctgggggatgactatgacgccgtcctcgaccgcctggcgggcctgcgatctcaggggctcacaggggccatggtgtacggcgactacctccgacgccggattgcgccgcttcagcggcgcgcccggagcgcatgggagtacaccgggtccgaggactacatgaggacccaccggggagtcagatgggattgggctcccgatgacttcaagatcgtggtccaaagggtgctgaatctcagctccatggaggcgtctcttattcctcaaggactcctccccctctgctgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcggggagcaaccgccctgccgacgcccgggggaagaggaaacagggaggaacacctcccccatctcctccccgagggggcggggcggtgcgtgccagcagcaggcgcccggagggggccgcgccgacatcacagcccgagacggagcgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccaccttgtttgtcttccggttttttcttctgcttcagcgatgtcccgtcgcgttcctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgagctcgccaagccgaagaagctgctcgggaggaggccgcccgagctcgtcaggctgaagaagccactcgggaggaaaccgcccgggctcgccaggctgaggcgatggcgtcttccgaggcggttcacgacaagaccgccagcgcgtcgctcgggcccactccctcgggtgacgctcaggcgacaacctccggggcggctcgcgacaaggccgcgggcgcatcgcctgggcccgctccctcgggcgacgcccaggaccaaacgggtccgggggacatccccgagctcagtgcgtcttctggcgggccgagccgcgtcgcattttctccaaggcggctcttcccctcgtcttctgccgccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcatcgccaccaccgcgatgattgaggcgcaggactccctccgccttcaacacgggagctgggaggcggagctaaagaaaaagctcgacgccgcccagggggtccttgacgccgccgctgcccgagagcagcgagcaacggaggctgaagcggcatcccgacggcgcgaagaggccctcgaagcccgtgccatggcgctggaagatcatgccggcgccgtggagatcagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggaatccgaggccgcgacacaacggctggcggacagcctgtccctccgcaaggcagcgcaggaggagcaggcgcgccgcaatctggaatgcatccgcgccgagagagccgcgctggagcagcgggctgctaacctcgaggcgcgaggaaaggagctggacgcgagggagcgcagcggcggggcggctacgggcgaaagcgacttagtcgcccgcctcgcagctgccgaacacaccgtcgcggatatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaattccgcgttctaccaatctggaaggcctcgccccgcaccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggatggcgctggaggagttccctcccgggaccgagggcgatgcgcgcgcgcggatccgggatgccgccaaccatatcgtccaaagcttcgaggggtcggcccctcggctcgcgttcgcccccagccccgacgaggagggcgacgccagcggtgaggacgacggtggcgacgaggccggcgacccgggcgcattggaatgagcccccaggcccccgccaatctccaactttttctttcttctttttgtatagatcaacttaatctgcaatcaaaaatgatgaaaaatttctatgttaactttattttgctatgcatatgagttgaggatgatttgtgccgtggtccttttgcatcttagcttgatttaagggctcgtgctcaagtcccgatcctcaaatggctcgggtcggggctagtgcctggggagatccacatgtcgagactggccaggccggaaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgatcccccccgtcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttctaagtagtcgaggtcatctctacgaagctgatcttgatcagcctcgcagtacatggtggcccggggagacctcagggtgagctcggatgggagaaccgcttctgcgccgtagacgaggaaaaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgattgcaacatacagatactcaaacccgcccggggcccgtttgaacggtcccaggatatcaagcccccagacagcaaatggccatgacagtggtatgatttgcagggcctgggccggctgatggatttgcttggcgtggaactgacacgctctgcatcgccggaccagatcgactgcatcattgagggctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggaccagatatctaaggacgtctccggtcggggaggtcaaagtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggcgagggtctggctcttgatagcgtggcgtggttcaaagtgcagatcgaactcagaaagctcgattgcccattttaccacccgtcctgtaccctctcgattatgcaagatttgaccgaggggataagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctttgctaggggccgtatccccggggcgttcttcattcaagtggcctttcggggcgcacttgtcttctgtgccgatgacctcggggtcggaggatgaaaggggcggccttccctcagtggcctcggggccgtcctgggggtcggaggcccctggcgtcgtcagacaagcgggcaaagggcctactccggtcgtcaggggcctcaggcctccgttcggctcaggggcctcttctccctgctttctcccgggtcgagtcagcacagggttagcctcggggccaaagggcgttaagtgcggccttcccgcagtggccttggggccctcctgagggtcgggggcacttagcaccgtctgacaagcgggcagagggccgactccggtcgtctggggccgtaggccaccgtccgactcgggggcctctgctccccgctcgctcccgggccaagttagcacagaatgggggtgcacgaaatgaggattgtcttcatcgcgctccacaaccaacgctgcactaactacttggggggtcgccgctaagtaaagtagcaagggctcatttggctccggggcgactagaaccgggggagagctgagatatgcctttaactgagtaagggcatgttcagcttcctccgtccaagtaaacggccccgagcgcttgaggagcttaaacaagggtagcgccttctctcctagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgttttcacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgtactttctgccggaccggccttgcgcccggccgcacggcgagacggtgctcaatcacctccctggggaccccgggcatgtccgctggtctccatgcgaagacgtcagcgtttgcccgcaggaaggagacgagcgcgccttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccataaacttcaccaacgcaggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgttacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgtgtcgcctcatgagtaggggccgcggcgagaagctctcgcctcatggccttgaaactccggcgagaaacgtgagcacacgctcccccgtcaacagtggcaatggtggccccaggttcttggaaacctaggtcatcatcaccgtcatcgatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccatttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacgccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataagtgccttgaaagttcatggtgaactgctggcacaaatcctcccaggagtggaccgacgcgggtggcaggttcattagccaaccccgcgcctgtcccttcagggccatgggaaagaaattcgccatgactctgtcgtcacccccagcggcctcaatcccggtcgtatagacctggagaaactcggtggggttgacactcccgtcatacttctcggtgatggtgggccggaaccttgggggccaacggacattccgaagactcgccacaaaggctctacagccgacaccaccagccgggggcatggagggctggtcctcacgtccctgtcgaggtgacactctggacgaagaggcgccctccgttgcgtggggagtacgccggctattacgccgacgctcgatgtcgaggcgggcatccggctctccatgccgatcctcccgagtcggaggtgccgacgagggagtggcagccgaatggcgtgcaacagccgccgctcgccgcgccctccgtcttgacgacgcggaaccggtagtggcggcgccggaggtcttggtggtggcggaccgtccaccagcacccaggcgctgctgtgccgtcatgaccaagttggccacgtcgtccagccatcgctgggctggagattccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgggctcgacggcgtgggtttggctccccgtcgtcgccgctcacactcggagagaggtcgtgcacctttgcttgctcggccattaggctgaacaagaaaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtatgtagaaagatcgcgtgccaggaagaaacgcgagacacggacgatctatacaggttcgggccgctgggaagcgtaataccctactcctgtgtttttggtggatttgtgtaagagcaagttacaaaatatcaaccagccctctcctctcccgggaaaatccaaaatcccatccccctctccttgtgggcatggtcctccttttatatcttaaggggataccacatgcactcttcccttttcaaactggacttttcttctttacataaatggacggagattgcacggttgccctccgaacgtccttctgatgggacggcacatacctacctccacttccgccgggggcaggcgcgtcgtgggaacgtggctgtgcgctgacgacatgagcagtgtcagaccggtcacaaatcggtcatccttgtcca

SEQ ID NO: 29186 - DNA, 13758 bp, Oryza sativa
agtagtccatcagcccttcttcacataacatcttgcctgtaatggttaggatgaagcctggtattcatctaaccagggctaacgtgtcatctctaagaggtaacacgctagctccggctggagacgcgtgcctagaggctctcgtcttgacgggacggggcgtggcgtgcgtcagaccgccagtcgccacctaaccgttgatctgaccggtctgtgactggtcacagaccggataaaagagcgcgctgcattgcgctgcatgcagcgtgacacgcttgaccaaaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacatattccatgttaaccgagcagacacaatcaattgtgtggagcaataagtcctccatgtagtttttgggaatggactagaaagataataatgcaattttcacgtaacaagcgaaaggtgattcttttaaaagatctttagtttccacgtgtgcctatatccaacacctattttattattatagtagcgtctactccacacataaatttacaactattcattatactattatacagatatcttttattccatatacaaatatatagctcttcattactatagaaatcgtatgctccatacacaaatataaaggacaagtgatagtatcgttatcaatatccttgtatttaacaacaaaaatagattattcaatcttacttctctcactcagttactaacttttacaaagttgtaattattgaactgctgctaatgttataaatcaatgatcatacagagtcgtgtactcatgtaaaaagacacctgactttgtctcaagcttaaaaatttgaagttgtagcccatatgttcatctatatctccttgaaaaaaataattcagcaatattattccttatagacaacaacaatataagtttcacatataaacaacaatataaattttataggtctataagtacttatcaatttctccctcgtcaattcgttaatcatatttctactaacctaaggtcctatttgattcagcttagaattattataatctggattattagaaataagctgaaacaaacatatagctatttgattcagcttatgattattataatctaaattattagaaataagttgaaacaaacagatagcttattatgatagattattataatttataagtaagattactataatatagtaatacactttaaagatgtttattttagattattgggtactaccagctaacaaacagcttataagtggacacatcctctttccatcccctacttctacagcacgcatcgcgtttacacgtaggtagccgtcggatccaatattttatccctaatcttcttatagcctgtatattctacatatgtatctgaccacaaacatttgttttgcacgaaacgtggcattaagaaatgaagatttttttctctctggaaagtcccagtaaacaggaccgacgacgattaacgctggaccctgaagaagaaggaagacgtgccatcgtcgtcacacgcgtacggcgtaccggcaccttcgatggcggccaccaagcccccgagctgctccacccgcctcagatctccggccaccaccgccgcctgcttcctcccggcgtccctccttctcttcctcctcctcctcctcctccgccgccctcccatgggctccttccctcccacaattccaggtataacactcaatcaatctcacatcacctcccttttttcttttcccaattcgtcatcttcttgccccttcgattctacctcttgtcgatttttgtttgagtcaaacaagtttgttcttttatttgtggatttttttttatctgttatgtttttttttttgtttcacttcaggtggctccgtgtcgtcgcggcgggcggagctgtacgggaggatggcgagggacctcgacgagcgcggcgcggcgttcttggacggcggcgagacgtcgcagtcgctcacgctgtcggagctcttcgacaccagggacggcgccgtcgtgcccatgctcaaggttattttctgcaaaatagctatagttatttgctctccactgtagtgattggcattgctgaaatgtcacaatcttttcttctttttttttcttgtcaggctgccaacccgccggtgcgcgcgaatgtgctctacctggatcctgagtttgcttccgtgatatcgtatgtattgaagttttatccgagctcctgttgtgtgaattgaattgttgctgaaatcgattttaatttagctgtagtagcaggacagagctggtagtgtagttttcttgttatgttttgggaagtgaggacagaatattggtgtattgattattcttgtgattgcaggaaggctgtgaaggaagtgtttcttccttattttaatcaaggtgaggttttgcttactagctctgcaacataatattattgaattacatgagtgactgcagtcgtcctaatctatgttcagtgtattcagttaaactatccgctggtattactcatgtgtctaaagaagaactatcggttcaattgcttgctgctatagattgcttggttaatctttcgtatctaaagctgcatctttgctgaagaacttgaccatttctgttgcttcttcgtttatctgaaagactgtaacccaaagctgtgctttttaaaagcctgaatttatacccttgctgaattgtccaatattaaagaaagcttgatcatgcatttgtgatgtgaagctgttctgtttctgaattgcctgctttttcttgatttctcggtttcttaacacttgaaactgtgcttggattatcatggtgaggttttatatatcttggttgatctcttttgccagctatctggttccaaaatatgagcatctaccacttcagtatgtttcacacgtcgcatcacctggaaccaattgtagcaactgaagatgaggtaaaaacatgccctggatgagtatgatgttcatgaaaatgcaatacaagtttttactgatgtatctgtgtgtaatactgttgagattgaagctgaagtggatgctgtaaaaagagtcaccgacgatgtttgtccacttaaaattatcttggatcaagtggttttgacatcaactggagtgcttcttggcctgtggcaggtgtgggcctttaaaaacaccttattctattgtacgctaatttcagcgaacatcctctagtatgcagagtttcagactgaactggtatttttcctttttgctgtttttaggttgaatctggtactgatcccgctgatatccgctcaagattgagagaagctcttcctcgtgcaccccaaaagcagcttgtaagagcaactcaaataaattatttgaaatttcactttctggaccaaatagagaattcctttctgcactaaatttaatgttcagagtctaggaagttcgaaattcaggacctactggctactgcagaatacaattattgattgctggttgttattgacctatcctacattttctatgaatctgttagtaaggtgttctttttcacttttggcagtatgatcctgttatgcttcacacctctttggcacgtattctgggacatccaaagctcccacaagaggtagcccgcatggaaatctgagttctaatttgttacttttaatattaatttcccttttagacactagaaagttgtcttctcttttcattcaaactgttgcctatcttgtgcaagatgcccataaaaagcggatataatatcttgctgcattatgcattacagtggatataatactttgagtttcaactgattatcaaccacttcaagaatattttgtttactgaaaacatacatggccaactactttccaaaaagcaaggcagccataagctgatgtttaaactcaaacaagatttatacttattgtaaacatgttttctgcatttacacttgtttggtatctcaaaaattgtctgctactctagtgtattatgttctttgttttttaattattcattctatctcatgtggcattgcttggtatgtttgctattctttgttgtagggtaatgcacagtctcttgatcatgtcaagttcttccatgacctggttgcacaggttaattcaaaaatccgtggcttccaggtaagagttcctgatttgtttaccaagcactatatttgcaactacctttatgcatgaactaaatatgtatatgtcaaccgctattcaggccacggtaaaagagctatggtttgtagaagagtatgatgtacttgcgctggcattgaacggaaagatgaaggtacggaggctccaattcggttgcaaagaaggtcaaggcaatggaaaaatatagagagaattaccgacgggaacagtgcaatatacttggagcacccaagggtaatgttgttcgaatggctcacctaaaacatcatccacgccgtcatttgatctgccgagctatacaatagatgtgttgggcgactgggaatgcgacaaagtgatgacagattgcaacacatacttgtgcagaaaatcgtatgcaaccatatgtatgtaatttctttcgctgtgaaggtatgccacattgtgttgtacctgtgatgttctctaattttttgtgtctatttatgctccattttctagcatatggagacagtgtaccaatagaaactccaaaatttgctgtacatttttaggggaagaaaggccattcaggaagacgagtcttcactttatatacagaattgttattcttcaggtgtaggaatacacaaatttctccataccattgggacctactaccacgaattacagcctcttaggatttgaacttttagttgagattatgcattctcaaatgcagcattcacaaaatcttgaatacgtaaatccgtgtcaacctggactcacaatggtagttaaaaaacgaactttcacaattgttggatctcaaaaacaacatgacgcccatgatctcaatcaggttaacaagacttgatatgagaactgaacttctcctttgtctgcgaaattcctacatttcaatgtagcatcgtagacatcggacatgaggcagcaccagcaggcagcagctgtgctaaacctatatagcaaacacagagaaggtaacaagcctagctatcattatgccaaagagtaatatcaaccgaacacccccaacatcacatggtcctatctctggagctggtaaacaccagcatgacaacacggcagataagaatatctcgaaaaacacatacaagcgcgggaaaactaaaaagggccaacttggtgttaaaaagaaaataaataaaacaaaaaacaatttacaagttgtattcttttatctatcgtccagcgagcttcgcagccttcgatggaccctctagtagctttggaacctctgatgaggcttctaattttttcaaaccatcttcacagtagttactaatatcaaagttggtcacagcatgggcaccacgaagctcgatggcagctaggtcataagcttcagctgcctctatctccgtttctgcaaattaagctcagtgactgatttgcttcaaacaagttcactttccacaatatttcaagtcacaaaagataaatgaggacaaatttaggtcactcaccaaaggtaccaagatagatgtctttggtgtctctactttctccaatcctaccaatccgtgcttgccatctaccatcctttcgcctgtttagtccaagggattaagttgcaaaattgaaatagaatattcagaatactttgtttaacatgattcacaaatcgttttctttcaactggagcaaaagggataagtaaataatgatttaattcatttgaccagataattatgggcttattctagcaatgcagagaatagcaccttgttacacccctatatgatgaagttcctcttgagaaacagctgctctgcctgtaataaacacgcagaacagttaaaagttaaaacaatcataacacaacggtgtcatatagtaatcactcaaatttatcactgaccttcttatgtacaccacaaattcatcttgggacatggtcttcatcctctcgatttctttctcataatcagaaacctggtatagaaataaaagctcttaatgccaaaaaataacaggtcccagaatatcacaaagaaacagacagttcttacattgaagttaagtttggtgtttggccctgcaccccaatatttaagggctgcaaggtcatgtgcccttgcagcattctcttcagtaacatagcttcctgtaatgccaaatatgaagttaattaaattataagtaagctaaatttatgcttcaaatgaattcattctgcaattaccacttgcctaggtacactgaatcaccagtagccaaaggtgccagattccccatgcacaaaatccaaagaagaatcaggtaagaaagaaattatgaagggaaagtgaagcataaggaagtgatagtctttcatagcaatgactatctctgtattgttcccttatccttgacctattctcaccatggtcatttaacaaattcaatgcccagagcttataggatgagccatggtcatctaacaaattcaatgcccagagcttggaggaagaagctaatgattgaatgtagctgtccaatgctatccctacctcctaagaagaaaaacagatatacttccttacataaataattaatcaacaatcctctaaatccaagggctacatgctccttactttccatatcgaaatacacatttcacaaattcaagcatcacattaatccttaaagtaaattaaaattacgaaaccacattttacaagtcgcttcattgaattcaactattaaatatatccatatgtgcaccctgcaacaaataaattgcatacggctatcaacaaccacctgttgtcaagcctctagctaaaaatctgtgatgatacgaaatgtaattggaataactcacagctgtttcgcatagctaccaagcgagcgtgtaccatctcggcactttccaaactaaactaaactaaactaaaccagtgctaatttcatggctacacagtgacaccaacaaggatgagagattttgcttgcagtgagcttagctaggatcatcaggcgtgcaccatctcggcactttccaaactaaactaaactaaaccagagctaatttcaatggctacatagtgataccaacaaggatgagagatcttgcttgcagcgagcttagctaggatcatcaggcgcatcacataccatgcttccccttgcgcttgcggccctcgacctggctgctgttgtcccagaggtgcgcctcgaacttgccgctccacttcaacctgcagccaatccaaaaattccaaacccaatcaagccaaaaaacagaaaaaaaattgagggagctaggattccgaagagagagctcccaaaacctcgtgacgccgtggtaccgcgacgaccgcggcgcggcgtacttgcgcatggtctccgccaccagcttccctcctcctcctcctcctcctccctccgccgccgcagccgctttcccatcatccccgccgccgtccgcgacggccagctgctcgtcgagcgccgcgatctcctcgccccccgccgcggccggctgctcctccgtctccggaggaggaggaggcgcggggtccgaggcggcgggttgcacggtggccatcgccgcgaggtgaatcttcttcttcttggatttctcctcggcgaaatcttcgagagctcgtcgcggcgcaaaccctagaagacggagcttggagaggactcggatgcgacgagctgcatgggcctaatttggatcagcccacacgggcccgcacgttcgcgagagctctgggccaaccttgtgggctccatctccatatgggccgtgtattgggcctagtttgggagaaaaggcctagggtttgggggctccttgtgtgcgccgtcgtgggagctttcgtcgccggcgagagtccttcctcccgcatttcatcgcctcaacgccggtcggcgagatctgagtctgaggtaaggccatctcaccccctgcagcttcattctttgacccttttttcagtatttttgttcttcccttttttggtttttagatcctgtttggttgaagggagtttttaggagggattgggagtttagagggatgaggctattaactgttttgtttggttgggagatgagaattttggtgggatggggatggggaattgaggaatgaacttcttcctttttaatacctgggtaggggcaggtaattgggagggaattcctcctttacttcgcctaaacaaatctcagccattcgttttcattaatgacctaatctctaactaaactccctcttaatttccaccacctctaccaaacaagagactggcatgaaaaatcaaattcctatcttaatctcactatcaattccctcgtgtaaactcccaatccccttcttatatgtctgatttaggtggagtaatgcatgttaattgtccagatctgatagagaaaatgatgttgttttagttgggtggtttggtctcctgtggatgtttttcttgcttcatgtttgttcagtaggagtatattattatgtgattatatattttgcaagatcttgttctttttcaagtttgtaggtctgagtatgtgttggatctgtcgtctcttgtggttggatgtatggtatatgtttgtgcttgttgcattccatgttttgatgcattataaatttgcaattcggatcctctgcattagaggtactaatgcagaggatgaacagtaccacgcattagaatcactgtggaccgtcggatcaagagtgaaaggaccagatttttgaatccacgccgaggtcgtggcggccgttgccgacgaacacgcgcgggagcggtggtggcccggcgaagccgtcgccgaggaggccgcggagctccgcccggaaggcggcgtgcatggacacgtcgcgctcgtcgacgcgcacgcggtggccgcgcaggatggcgcgcacggcgcggccgtcctcgaacgtccggcggacgccgcggaggctggtgaagtacaccaccaccacggcggatgccttcgtcacgcgctccggccgccgcgggggcggcggcgcgacgtcgagggcttcttcatcggccgccttggccgccttcttcttcttctctatcttctcgtggaactcgtcgacgcgcgcgcgcacgaagcccgtcacctccgggatgtcgcgagccgccggtgtgcccatgtcgtcgaacgccgccgccgccgccgccgcctcctcctcgctcgccttcggcgtcgtcggattctcccgctccggcgaccgcgagggctccgccgccacgatgccccggaggccggacatgattccctggtcaaaaccaggtaaagcccgcacctctgcctccttcgccgccgccggcggcgaggacgcgttgaaagacgcgcaccgtcgcgccggcgcggcgtcctcgagggcagccttgagcccacgcttagcatcctcttctccggggagcgcgcggaagtcgaagtcgacggagacatgggcgcccttcgccggcggctcttccagcggcaggctggagtacgcgtgcacggcgtcgtcgcggcggccgcggcagaaggcgagggaggtgagaaccaaggcggtgcgcgacggccgcaggctatgccgccggctctccgccgccggagccgccaccgccggtggcttcgccgcgccgccgcgcacgtccctcgagctcgagcaacccatcgccggagtcggagaagaagatgatgcacgtgcgcatgcgcttgccacgtgcgcacgcgtggttggctattatatagagcttggaagccattggatgtggagcgcttggtatttaaatatatttttttgtgaaatgaaactgaaattgaaatggaataaaagacaaatatggaaaatgagctggtaaatattatggagttgggtgaatgggttcagttttaattgctcaattagtcactagcaaatggataagtgtagtagtgtctatctatacagtggtacgggatgacgtggaaaattttgagaaaaaaaacaatttataatttgatgactatgagtttttcaggagcgggaaaaataagatgtcaaattgcttacagaaagtaaattagtatggctttatgtatatagctacagtattaaaactcacatttaaagcttttaatggtaataaagataactatgcgcagcaagagtctgtatgaggagaatttcatgatatatttttgcatgattccattgtagagaaatgaaaagaactgcatgttgtttagcgaagttattaaatgttagtgagagtatttactacacaaagtgaataaaacttgtaaaaaacactctaaaatttgatctgttctaaaccactgaaataaaatgttctgtaaacaaactaaaaaccttgaccaaaacaatgggggaaaacattttttgaaagaaaaataacaaggaaaaaaattaaaatagaataaaaggcagatatagaaaatgaactgtcaataacatggaatggatatgtattggttcatgtttatttgctcaattactactacaacgtccaaaaaaatgaatttctagctacgaatctggacacataggattggtcttttgttgggacggagggggtaagtggcatttaagaacaattaaattcccacgtaggtgtggtgagaggggatgtgatggaaatttatgaagaaattaatttatgattagatgactatgagttatttggaaggattagggatggcaattttgcctatgggtttggatatccacgaatacctagcccgatgggtacgggcgcgggtgcaattttttacatgtgggtacgtttgctcaagacctgaagatgtagtgggcagcaaccgggttttatttgttgtccatgggtaaatcagaaaaatatgtagtgcgaaccatatatgtagtgaaaaacttagaaactactgttggatctaaaatccacgtcaaccagagtaaaaattttactcccagatttaaccatgagtaaaaagtttactaggagtaaaatttttactcttagtgacgtagacaaatctcaagcgtccatttttaaatgcaacgatagcttgcaggtttccacttcatatgcacatattttcctggtaactcgtgcctgatgcaatacatatgtattagctgattttgggcatctcttaattctcacgccccttccccttgaccaatttgtgatgctagttggtgataacttgtgatgcaatttaaattaacgttgctaattgataatttggcaaattattgattttatttttctttgttaaattacctatctattgagatattattcatatgagacccaccgggaacccatcggacatgcctgtgcatatcaagtatgggtacatgcacggagttttgcccgctaaccctggtgggcaggtttgagtgggtgatgtcgggcattggatcgggcatggttttgccatctcttcttaggatggggaattcatgagaaataattggttaattttgtcttagaaaataaaatctcaagtagttaactagcaagctagaaagaccttctgcaagtagtgcttaaactttacaacagcatgctctgatttaaatatttaaggaaaatgtagatgattatatatgcagcaaaaaattgtatatatatgaggatatttgtatgagaaaaatattgcatgagttctttgtagaaaataaaaaaaaatccgtcaagagggaggttggacatttgaggttacatggctaggccacatgatctcaagcgacgatgaactcatatttgatataaaatatttttcagtctcaattataaccaaatgaaattatagtttttaaggtacatagctaacgtagcgaggtttatatggcatatctttaagagaaatatgggatatatatgtattcttagtattaaaattgtattactcatttgaaaaaaataaacggatggatatttaagttagagtgctacaaaatctcttccactatcttgcatactcctttgatttgcaaaggtgattttcagttagtttctaaccttttctggatacattttgaaattcacactgacggagcccgtggctcctcaccgggagaccgcgcaggcccccctttgccagttcggccgggggcttagggtgagatctcaagctctcgctgtgtgtggaaagatcgctcgcccggaagaaacacgagacacggcgatgtatacaggttcgggccgccgcgaagcgtaataccctactcctgtgtttttgtggatttgtgtatgaatgagctacaaagtgtctgcccacttctcccccgctctaggctctaaatctggcaagaatcaaccaatcccttctctatgggcaaggtcctccttttatatttcaaggggataccacatgcccccttccctttccaaactggacttttcttcttttcataaatggacggagatttgcacggtcgtcctccgatgggacggcacatacctacctccacttctgcctgaggcgggcacgtcgtgggaaggtggctgtgtgctgacgacatgagcagtgtcagaccggtcacaaatcggtcattcttgtcctccacacgtcggctcagcaacgtgcatgtttgcccttcttcaaacaacatcttgcttgtaatggttaggatgaagcctggcatatatcgatcggggctaacgtgtcatctctgggatgtaacacgctagctccagccggggacgagtgcctagaagctctcgtctagacaggatggggcgaagcatgcgtctgaccgcctgtcgccacctaacccgcgatttgaccggtctgtgactggtcacagaccggataatcgagagcactgcactgcacttcgtgcggcgtgacacgcttagccgaggcgcaataaatgcggttaggtgagccctgctgtgctcacctaacccatacacgtggagtacaaaacgcgaggggtcggggcgcctcggccctcgggggcgaggctggagtcacccgacccctccctcggggaaatcaggaggagggcggtcacctcaccctcgggcccgacgtccccgaaggtgccaggccacgtgggcggttgtgtctgcctcaagcctctagtcacgatactcccggtcccatatcaccgacacacacacttggctaaaactttattacagataatccttttctttaccaacatactacaaatattcctatcctatcatctgttgtggtgtaggggctcaatacctcgtttccaacattggtctcaaatgatggataagatgataacgaatcggggttgtgtatttatccatcaactggttatatatgttcatttctttactgtcattatcattattattgttccaagatatgtataacacttataaaccctgaactccctccctgtcctcccccccccctctctatctccttgtaatccattcatccctgaca

SEQ ID NO: 29187 - DNA, 3492 bp, Oryza sativa
agggaagcggtcgggcatgacgccactcataaagcatggtgacaggtgggaccggtctccgtgattgggcagaaacccaacggtctcaaaccacgcatattggtaacggtgtcttagccgtcagttatgggcggtctcttcaagactgccacattacttgagcgacgtacgaatctgggtgagccgatttgcttcgcctggagatatggtgatggtgcttttctcggagccatcagaatagcgtatagcatcttctgggcctgagggtatcgggttttggcgtcccggagggcctgagggtatcgggttttggcgtcccggagggcctcgctaacaaagtagacgggccgctgcgcctttcggcggggccgatcttcttcgctaggggccgcatctccagggcgctcttcatccgagaggcagcgcggggcgcactcggcttctgtgccgacgacctcggggttagagggcgacaggcgcggccttcccgcagtggcctcggggccatcctgggggtcgggggcgcctggcaccgtcggacaagcaagcggagggccagctccggccgtcgggggccttgggccgccgttcggctcgggggcctttcctccctgctctctctctctcttcgggcagaatcctcggctcgcgttcgccctcaactccgacgaggagggcgatgccagcggagtgggcgatagtggcgacgaggccggcgacccgggtgcatcggagtgagcccccaggcctccgccaatcttaatagcttttccttcttcttccgaggccttcgggccccttttttgtatagatcaacttaatctgcaatcaaaaatgatgaaaaaattctttgtgtcaattttattttactatgcgtatgagacgaggatggtctgtgccatggtccttctgtgtcttggcttgaacaagggctcgtgcccaggtcccagcctcaaacggcgcgggtcaaggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctatttcaagtcaagattcttcaaaaggaaacaaaagcacagacacagcctttaggaaatcgaaaatgcttttattgaaatacggaagagaaaaaagataagcccccggccaaccctgcacgccccgggggggggcgcggggttggcccgagcccgaaacctgacacccgacccccactaggggtagaagcgacgaaggtgttcgatgttccacaggttaggcagctctgtgccgtcgcccgtggccagccgaacggagcccggccgggggacgccgatcactcgatacggaccctcccacactggtgagagtttgctcagtccagcacgcgtttggacgcggcgtaggacgaggtcgtcgacgcagagtgatcgggcccggacgtggcgctgatggtagcgccgcaggctctgctggtagcgcgcggctcgaagggccgcgcgccgccttcgctcttccaagtagccgaggtcagggagcgtcggcctctttctttttgtcgctcgcaggcctcccctttcgggtggcccgcggagcgccctcgacggcgaggacatgaccctcgtcgccggaatggaccgacctcttcttcctcctcctgtcacgccgccctgtctgggcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgtgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgccctccgttgcgcggggagtacgccggttattacgccggcgctcgatgtcgatgcaggcatccggctctccatgctgatcctcccgagttggaggtgtcgacgagggagtggcggccgaatggcgtgcaacagccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacagatttgtcgaccctctcaagcgcctccccctgcttagggctttggcgcggaggaggtgggggagtacgagctcgacgacgtggattcggctccccgtcgtcgccgctcacactcggagagaggtcgtgcgcttttccttgctcggccattaggctgaacaagaaatacttggcgcacacggaagagtctgagagctcagaaaacacacactgagccccctacctggcgcgccagatgacggagcccgtggctcctcaccgggagaccgcgcaggcccccctttgccagttcggccgggggcttagggtgagatctcaagctctcgctgtgtgtggaaagatcgctcgcccggaagaaacacgagacacggcgatgtatacaggttcgggccgccgcgaagcgtaataccctactcctgtgtttttgtggatttgtgtatgaatgagctacaaagtgtctgcccacttctcccccgctctaggctctaaatctggcaagaatcaaccaatcccttctctatgggcaaggtcctccttttatatttcaaggggataccacatgcccccttccctttccaaactggacttttcttcttttcat

SEQ ID NO: 29188 - DNA, 430 bp, Oryza sativa
cacacattcttttctacatgcatgagatcaatgcaatgacggacatcaagatctttccagtaaggtagccgccaaaatatggattttttcttccacatacccttctcctttgtcttgctacgttttcttttcttcccaaactcattacttatgtccttgaccatattgtggacctcatctccggacaaatctttgggagcaggctgaagttctctcttaccattaaaaattttcttctttcttctaaatgcgtgacgtagcgggagccacctccggtaacccatgtataccatctttcgtgatttcttcaaccaccggcttcgtgtatgttccttgcaatcggagcatgccttctttccttttatagtttgtccggaaagattaccgagtgcagggtagtcattaatggtacagaacaatagaactctta

SEQ ID NO: 29189 - DNA, 530 bp, Oryza sativa
tacatcggctcttagcgtttagaaaaggaaactttgctgcatcaggatggggaaaatgaaagaatggtaataaaaattttctcggtgcattaattgcactaagagcatgtaccagacccttggaaggtaagaccagtaaaaaatcttatccattgatcaacagtaaaatacgccatgtatatattatgagatttactccggtccaacaaaaagtacctcgaggtaccggtacctcacggtatcaaattgtttccgatcgttggatctagctgggtgggttgggcattgttagatcatgtgaagcaataccttttccattcccttgataagaaaatatccaccaaaatcatactcgcattcgctttcctgaagtttatgcagccagcacaaatttgacttcaccatgacaggtaacttgccaatagtgacccatttagtctctttcattatatcttttctttgtatatatgggtcctcgccagttttagctttgtcgcttttgtggagtgaatagacctgatacagcaaaa

SEQ ID NO: 29190 - DNA, 1009 bp, Oryza sativa
cttatagacattttataaaatgtctcttcgtttgtagagacaattcaccataagacacttattagacattttttttaaaatgcctctataatattgtaaagtcatttgaaaagtgcctctacagtataaaaaaatgtctatgcaaagctttttttcttgtagtgtttgtagatatagcatgaaaggtttaaatgcaagggaggaagagaagatcatttgtagctcagaattaacaccactttctatgatacgcattcaatagcatgtgtggatattgtggtcctaaagactatgttgaaggatgcttttgaccgacaatcgtgtggaaggatattttttgataaaggacatatgtacaaaagcaacaaatgacccgatttataaacttgacgcatagatttttgttttgatatggacgagagagtgtgggaagagacaagggggattgactttgacccaacattcgtatgggagggtacttttgataaaggggtatgtacaaaaacaataaattaatggaccgatatatattgctgacgtgtagattttgttttgagatggaggacagagagcgggaaaagacaggggagattaactttcgctaagcatcgacgctatgctccaagtacgatgaagtatgcaaccttgaggaggaaccatgcgcaagaaaaaaaaacacttgcaatggaatcttagatccactgctagcgggcatgtgggaggggcaaaggggcaacatggatgatggagactatgtaaacagtcaaaggtagttaaaccatacaaggtgaaccgtggagacataggcctctttggtgaccacatgtggcgaagccgttggtgttggtggggtggagggcaggttgagtcagagtcattatggtgtaccggtagtggtgaagatactaggagagccaatgaaattcggaaatattaggtatgtgagatctctgcgaaaaagacgaagggaatgaaactatcaaataggggtaaataaatattatttaga

SEQ ID NO: 29191 - DNA, 4311 bp, Oryza sativa
cttggggttgaaaccacacaccccttgccactgtactatcaagcattatgaaaaaaaaaaaacataatgctaacctttacttctcatttcaacatacaagggtaactctcctgcttgctgatggttgataattccttatagctgacatgcttcttccttttatatattctttcactagttttagttactaacttgtggctcttgcattatcattgagatgtacaggtgctttattgttgttgacgacatatgggataagaaatcatgggaactgataaaatgtgcactgcaagatagtaattgtggaagtatagttgtcgcaactactcgtatttccgaagttgccatgcatgtcggtcatgtttacaaaatggagccactttctcttgatgactccaaaaaattgttgtatgcaagattagctggtgctcaaggcaagtgtctgaatataccaccagctgtggcatgtgaaaaaattttgaacaaatgtcatagtgtgccattagccataactacaatagctagtttgctggtgaacaaaccagaagaggattggtctgaggtgtacaattctattggttttggtcatgaaggcaataatgatgtagagaatactagaaggatattgtcttttagctactatgatctgccttcacatctaaaggcttgcctattgtatctaagcatattttctgaagatgttgagatcgataaaaatattttgatatggaaatggatagctgaaggttttgttcaagacgaacaagcagcaggggtagagttatttgagcttggagagggttgtttcaacgagctgataaacagaaacatgatcatgccagtggaggtacaatatcaagggtatcaatctaaggcacgctataatgaagggtatgtatatggttgccgtgtccacgatatgatgcttgatttgatctgttcattgtcgaaggaaaaaaattttgttaccctggtggacagctatgagcaagtggaacttccgctgagccatgctcgcaggttagccatgcagagtatgagtattaaagagataaaccgtcttcagctgcctaatatgggcatggagcaagtgaggtcctttttggctaatcgttgttatggtattagtttggcattctcagactttcgagtgttacgtatattagctctagaatattgtcagggcaaaattaatttgtcgcatttcaggagtttatatcacctgaggtacctggggctagtcaatgcggaaattacagagctccccaaggaagtgggagatctgatgtttctccagacattggatctacgagaaacttctatactggagctgccagaatctgtgggtctgctgacacaactgttatgcctatatgttgatcatcgtacatgggcgccagttgatctgatcgggaagctgacgtccctgcaagagctgtgcataaggcctgcttatgcgtacgacaggttctacgatgacaaggccaatggtatgagacagtttgtgaaggcgttgggcaggctgggagaattgagggtgctccagactcagattgatatattggatgatagcatggagaaagatttgctagagtctctagacaatctgcagaagatacggtccttggaaattttgggggcatcacgagggttgaacgtcgaatggactagaacaggattcatttcccctaggcatctccagcgcctgtatttggaatgccttgagttttctggactgcctgcatggattaactcgtcacttcttccaaacctctcctatctaaatatgacaatggaggttgtgcaagagcaggacatggaaacccttgggatgtttcctatactctgttacctaaaattatattcgcgttgtacaaagctagtaagctttaagcatacaagcaatgcaggctacttccagaagttgaaatccttcaagattgttggttcatcagtcaggtttgatctgagtggctgcgacatagaatcttctttcatgccaagccttgaaacctttgagactgatgtccatgtacgcttcctaaaagatgcgaacatgcttggtttcgacaagcttggcttggagaacctccctagttcgctaaagagaatcattgttgtaatctgctgtcgagatgccagtggtgcagaggttgaggaagcacaggcggcattggagcatgcaactgacagccatgccaacagtcctaaacttacaattatgagatatggagtacaaattaaacggcccttgtgaggtatgctgatgatatccctgattatgaggtatgtgttaatagcgtaatttggcttatggttaggtcattttagacaagccaaattatgtagaataacgggtgtaattgtctagaaatttgtttaagaaaatcaattcagtttatatgtgcagtaatatgtgatgcaccggaggtgtacgagttgctggggagctgcagcgtttggatcagcatggtgatgcatgtgctgcgctagctaccgtgctacgactgaggagttcctgctgtgcattctgtacatgctagactgatttgatcatatgaatgtggtattactctcttactccttcgcacgcacgggaggcttcattagaacggataccctcatctcaatcggacggtaagccccatctcaatcgggcacagcgtccgtcacagactagaagtcactgatgtgaagagttatctcaatcgggcaaatggccgtcacgaatgaatatatctcaatcgggccctaagtaaaacctgtcatcgatagctttgacccagacgaccaatcaaactatagcccgtcacagatgacctatctctattgggccacaactagcgcccgtcacagatgactactaacatttatcgggcctaaactagagctcgtcacagatgatactcatctcaatcgggcctaaactatagcccgtcacagatgactgatgacctcaatcgggcctaaaataaagcccgtcacagatgactactgacctcaatcgggcctaaactagagcccgtcacagatgactacctatgttacctagatacggggatacggatacggatacgcgatacgtcgatacggcattttttgaaaaacatggatacggggatacgtctatatatatatatataataaaaatataaatacttacttcaactcttgtaaatttggaaatatgcccatatacaaatacagacacacccacacatgtcaatgaaatgggataagtttgctgcctgcagcattaccagcctgcaactactacactaaaaaaaagaatgcacatgtactctatggaaagaaaagaaacaacagcaaaaagtatccggcagtatttgggctgtgtccagctgacaacggagacggaggcgctgggagctgcgtccatcagctgtggacgagcggcggcggcaccatacccgacggtggaggtgctatgtccactgacggccgcacaaccgacgacggagggggaagagccatgtccggcggcggcgccagcagcgccacgcccaacggcggaggagccgcagcgtccggcatcggcggcttttgaggtatggtgaataagattgagaagctcatacggtggttggcttggatctgtacttctcttgcgatttcaatggatcgaactgacatacgtgggattatggggatgcatcgaggcgtatccaggaagtatcggatttattttgattatttgaaaatcgcaaaaattatggatacgtacccgatacgtatccgtatctgacacggatacgcgagatttttgccgtatccaggtaacgctgataactactgaccacaatcggacttaaactagtgcccgtcacagatgaccttatctcaatcgggcatttagttatgacccgtcagagatatccaatatccccagctccccagcatcacccattcatatacatatgcattcacatacacagacatcaacatatttcacacaacgacacattcacagccagctcatatttcacatccattcaaatatttatcatatttcacctgcaaaaccgagttaatttgatcaaatatttatttagcaagccttaacataaacatatgaaatatatacataaatataaacatcacagttacatcatcacagttgcataataagtgttcatcattgcctaaacataaaagttcaacattgttcatcattttagtttaagcctaaacattcctttggggttaattatttcgcggaggatgaagctggctatctcctcgtgaacctcctcaaagctggtaggcagagacttggtgatagactactgt

SEQ ID NO: 29192 - DNA, 1606 bp, Oryza sativa
gtcacaattgagaccaccgacctcaaactcagccaaagtcttcaccttttctctagacagaaggcacatgttgtggcacacatggaatccgcactggtcacctatttgttgcttcaccgggaagtcttttttgtggatgagggtgtcatgtcctgtcttcctgaggcctcctctttgcacgtattgggcccacgcttcatctatcgctagttgaattggggttcaatcatatgcgttcttatcaattctggagttcaggtagtgacatgtactccacttaggtgttatgacaagaagaatccaatgggcactgcggcattaatataataaaagttaattaagtactcaaggaatgtgtcatgctgttgtgtatatttagttaacacacttactattgattataggcgcacataatgtactccttgtctcggcgggaccacaaggtgtcgtagatgtagttgaccattccttaacggtcattctggagatttgtgacagtgaccacttgtggatcaaggaaggcaacttccggtgcatgcttcagacaccactgccaacttaacctacacacaggataaacgatcttgtaaacaagttaaaccgattgttattaccagattgagttgggcgacaatacttacaaggagtagcacttaaggaggcttgtgtccaccactcggagcctgtagaggttgaaaagatccttgaagtcgaccacaatataatttgttgaccaaggaatggctttctatcgtgctctccaaggatatcggtagctttacttggcttcctggcgttagatttctccatatagtataagtgaaggtccttgcaagcggtgcccattgcggcaagcacgtcatctccaaccaatggcatgcctagttggaactcctgtggagcgacgtatttcttcttgacctctttgcccttagtctcttcttggcccttgcccagatctagcttccttggagctagaagcgaggcctacacctttcctccccttcctctcccctttgcttcgggtttatcgagagtaattctctaaggggaagagtgtgccttcctgctcttcttcatcggtgggggttcatgaatcgccttgctgtcggcctccgttcggtcctccccaaaatccgtgtcgtactgcaactgcaaatcgtaagattgtgcatgacgatcttgagcaggaggggctgaaggagcagaggcgggtctctttgatggacgaccgcctggtgcagtggttggcctcgctataaccctgatctcaatgaggtccttgggccattggatgaaggtaccacgggcattttctagtgagaggacctcgtcgttcggtggatactttagagggaacagctcgtattcgggtttcacgagtcgacttgaactttcgcacagtcggcccatgagttgcgctccatgcactcttgtctctggggtcggcttgtacgcaagtccctcggctgctggaaccgtgaaggtcggcatcaccctaactatgagggtgcagctcgttggttcctgcgatagattaattgatttttttaaaatattatatatcatatggattcgttaagtctttcatgtattgagtaagttc

SEQ ID NO: 29193 - DNA, 731 bp, Oryza sativa
gaacgttagccaagcaatgtccttctctgcgcccggcatgagcttaatgtcatcttgcagaatactgaatttctgcctccctatgaccccgcagatagatctaaatcggctcaatattttccttggagatgtcggcaaccctacggcgtccaccgctgttatgtggaaccgttccttagggattttgttccctgtcctaggagtacgtgcccttgaggacccactagttgtcgtcgacatgagcctgcgcgtacgacgcttgatcgggcctaattcttttccttccgattgtgccaacacctgataaccttccctcgtgacgagacgctggaactccgataggatcggcatcggacatgtagattatggttgtattcttcttcatcgacgacgttgtcaactcctacaattcggcgctttccatccctcacgatgtgcatcttcttgtttgaagggtcttttatgtagaatatctactcgacctgtttcacaagtacaaatggttcatcggcgtatcccccttagatagatcaactaaagtgaaaccttccttctcggctttgacaccagtgcgtagattcacccaacggcagcagaacaaaggaaccttgaacttgacgtaatttaactcccagatctcctcaatgcggccgtagtatgtgtttgacccaacttgatcctggaatgcatctatacggacgccgctgttttgcactgtgcttttgtcatct

SEQ ID NO: 29194 - DNA, 744 bp, Oryza sativa
  unsure (1)..(744): unsure at all n locations
catttatattatattgctttattggtcaggctgcccatgaccacctaaatccatagtatctacatcagaaaaggagacttcaaatttttcatcatatgcttttttcatttcttcaaatttatcattcatttctttttttaattcattaagtatttcttctttcaattcttttttaatttggggggatgcttcttcaaatttttcaattattttccaatcgatatattcgccatccaaaggatctactcccttagtcaagcattccttatacgtaggtttttgggatgatccttcattcttaatatttgaacaatatgggttctctggagctttcttatttttggcttttttgcatttttgtatatattcttttgctgctggttccaagtagtagtttattcctaatatttttctggcctgagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29195 - DNA, 875 bp, Oryza sativa
cccactgagtaataaaactttaagtttgccagcccagaagtgccggttgatgattacaacacagatccaaaacttccatcaagaaatcttttgaaattttaactgaaaaaggcctacctttctttgccctgggacgcgattcgtagctcgattcgatccgaagcttgggattttagagtagcttaatggttaagggaagggaaggagtcgtcgttgcctcgtccgagagcagctagctgtgcgcttggtagcagcgagcagcagagggcagcgataaaaaagactgaagagaaggttgagcagcagaggacgactaaggccattcctaacccaataattagaatagtatctatagcattaaataggccgccccacccactgtcgacaccggatctgacacaagaacgaccgcctcgcctgccgccaacatgaccgatactacccccgcccattgccgatgccgccaacactgggttcgctgcaagaacggccgccttcagtttctcgcccaccactgatgctggatccgccgcggaaacggccggattaatcacaggaacagttgtcccgcccgtggccgatgccgcgacgccacggacaccgtcccacgcggagaggggaggagagaggtggagccaatgcggataatttactggttatttaatttccaaataattaattactataaataaaaattggctggaaataagataaatcttatctaactgtttattggtcacgtacagtagttattaggtggtaatagtaaaaatgatgatagatttaccatcaccactacctgcaaacagaaattaatagtgtatatgcaccaatttcctggaatttacgttcaagatattatataaagcaagttg

SEQ ID NO: 29196 - DNA, 2370 bp, Oryza sativa
aggtctaaaggttgaaatgatggatcaattaaattgtaaacatgattggattagaggaaagggtgactataatatcaaatgtgctttttgcatatattaccctagtcaagaaaatagagtgacttgtagtatatgtctaaaacaagcttgtgctgaatgtataaaagcaaataaacaaaaatggagaaaagaaatagaattagaatcagatgaaaagactttatctagtagagtacgagtgttagaaaatagactaaataaactagaagtagaattagagaacctaaaaaataattgcgatattaaggcattaccagagaataaggacatacaaaacaccgaatttaaagagcaattgataacattaaaagacagtaatactgctaaaataattcaactaagagaggccataactaattttggaaaaaaatatatagtaagattgcctttcaaagaaatattaggtataagaatccctgttaaaataaaattgacacccaaagtatcttataaaatattagcactagtagacaccgggtgtaaaaagaatattattcatgacaaatatttcataagatgtcctgaaatagttcacacaattgacgacaataaggcagaagtttccacagacatgtccggaataaagaaaattcataatcagttagcttataatatggaggtttacattaatgcaactaaatatataatagatgagattacaataagagatttgtcaatgattaatgatgacataataattggcctaaggttccttcaacaatcagtacaaaccacagtaatacatgagcaaggaattacttttatcccatatcaaaataatgttccatatatctcagaggtacgaaagcgtggtggagtctcccccaaactcgacaacttagaagtacccaatcttgagcctaaagaaagaattaatgaatatgagcttagtgagaatatagacaactattatatatcaaattccgaatatagacaactattatatatcaaattccaacatagagtgcataggactacaagcatttgcaccaaattggtatagagatattaagtctaaaagggatatagaaaaaaatattcaaagattagaagatatccaaattataggagaaattcctatgaaatattgggagaaaaatgctattgagtgtaaaattaatataatcaacccagaatatatcattaagactagcccaatagaagcaacttcaggacggagtatatatatgtgtgtgtatatgtatatatatatatatatatatatatatgtatatgtatatgtgtatgtatatatatgtgtatatatgtgtatgtatcaatatgtatatatatgtctatgtatctatatgtatatatatgtgtatttatatatatgtgtatgtatctatatgtatctatatgtatatatatatatatatatatatgtgtgacggagcgtggggctcctcaccgggagaccgcgcaggcccccctttgccggttcggccgggggcgctaagtgaggttctttgccctcgatctgaggaacgtcagcgagagaggaagtgcacaagacacgggcgacgtagacaagttcgggccgctgagaagcgtaacaccctactcctgtgttctggtggatctgtgtgtgaaggaatacagagagccggagagcgagagagagttcaggctctagaacccatccgccagagtcccaaccccccctccctttaggcctgggcctcctttttatctggtcaggggtcaccacatggcctctagctacctaagaagggaaacatgctttttacaatgagggctagtctacagccggaagtgacctctgataagcagagcacacgcctcctgccccactcgcccgctttccccgtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggcctcctgttgccacctaacccgcgatctgaccggtctgtgaccggtcacacaccgcgaccggtcacggaccggataagcgcgcgctgcgccgcattaaatgcggcgtggcgcgctagtccaacccgctataaatgcggttaggtgagtcccgctgtgcttacctaacccacacacgtggcgccaaaaccacagggggtcggggcgccccagccctcggggccgaaacgggagcggcccgacccctcggggagacagagggaggggtggccacgtcaccctcgggcccgacgccc

SEQ ID NO: 29197 - DNA, 6976 bp, Oryza sativa
cccccccccccccccccccgagggggtcaggccacgtgggtgaccgcggctacccaagcctctagtcacgatacccccggccccatgtcaccgacaatatgtatatatatatatatgtatatatatgtatatacatgtatatgtatatatatgtatatacatgtatatgtatatagatgtatatacatgtatatatatatatatatacatgtatatatatatatatatatatatatatatagatatatatatgtatatatatatatatatatgtataatgtatatatacatacatatatatacatacatatatatatacacatatatacatacatatatatacatatacatacaaacatatatatacatacatatatatatggcaacatatcctatgcacacaggccctcacgtgtacacacgtgcacaccaactaaaaaatgtcaccaaaaaatctagaaaaaatcatacatatactttcaattgtattacacccagggttaaaatcttaacgtcaaattcattatattttagccgtaacaaaaaaacaaaaaaactgacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacacggtgtgtacacgcgagggcatgtgtgcataggatacgctccctatatatatatatagttagactattctatacccccctcccctcccaatttccccccaccccacgcgcctccccctccccacccgagtgctcctcgcgattcctcctcccccccacccccggagcgctcactcctcctccctccttttttgagagaaaaaaaataaaggaaaaatttgccttcaatgggaatagaactcaagaccttcaactcaaattaacacatggcactaaccaataggctatttcttagttgtgatagagttttcttagtaaaacttatcttctcatacatcacgaaatatagtagcgcgtccggttactacaaatatataggttcttattacagccaagtgactagtattgctgggttaaagcctcacatactaaccatatacttgttactgcacaaaaatagaagtgttactacatgataggtgcatgttaccactttcaagtaactatgttactgcacgacaattgtagttttactatgtcatttttacgagatgaagatcgaataggtgggctatatgtaaagtctgtaggtggctttgagcgaggtctgattgatgtatgagtgttttgaataattttatacatttggtaaaaccatgttactgcatgtatatgtccttgttattgcaaggtacacattctgttactgcatgtggaggattaaagttcaaaatgccaatttttgaaaagcaatatctcataagatatgtattattttttaaaaccgttttcacaatgatactatagttttactgcatgtggaggtttaaacttcaaaatgtatctacatactcctctcctcaagaaaccgttattcctccctcttctcaagaaaaccggttttctccctccaatatagtgttactgcatgcatgtatatgacgttactgcacttttaatagtaatattgtggtgaattgcagtaaatcaggaattgaaataaaaatatatgggttcaaagtctcagatgctaatcatatacttcttactgcacaaaagtaaaagtattactgcacagcatatacacgttaccacctgacatttacacattaccgcatgtttatgcggtaacactatccaagaactgtagtaaaacactttgttactatagaacatatagaacgttattgcacctttggcagtaacatcgtgatgaaattgtagtaaatcagaaatcaaaagaaaaatatgggttaaaagtctcacatgctaaatatacttgttaccgcacaaagtagaagtgttactacatggcaggtacacgttaccacatgtttatgcagtaacactatgatagattaattctagtaacacgctcggttactggaaaacacatagaccgttactgctctctagcactagtgtcactacacaattttaactagttgagcgttgtgtccgcataggggattgaccaagaataacctatggtagatttattctagcactatcaaagatgcaaatcaattctgttacatacggaattatagtaacatgcttggttactacaaaacacacaggttgttacgtcatgtaagaactattgttactacacaattttcacaagattaatgttacttctgcttaacgattccatagagatttacttgatggtttacctctctcccctcacccacccaacacgccctctattcgaatttttgtttattgtgaaagcatatgttactacaaaatatataggacgttattgtacttttgatagtaatatcatggtgaaattatagtaaactaggaatcgaaacaaaaatatatgggttaaaagtatacatgctaaccatatacttgttactgcacaaaagtgtaattgttactgcatggcaggtatacgttaccacaaagtttgtgtagtaacactattcaagaattacagtaagatgctttgttactgcaaaacttatagtatttaccacactttcacagtaacatcgtgatgagattgtagtaacgtacagcaggcagtagtaacacttatgatatagtattattacttgtggagagttgaatttcaaaagaccaatctttgaaggttcgttctacccttgccccacgagtaaagcgagccaattcccctctctccatgttattgtactttttttcttactatatatatcgttgcagtaacgatatcaagtaattacagtaatacactatgttattgtatattaatatatagtatagcctacttgttgactgtaaggctctttgcagccttctcttagcccgcccactcatataatagttagctgtttacaattaatacatggcccatttgtctctctcatagagtttcttggttcttatgtccaagccagctgtaagtttacagcccgcttctcctctcttctctcctccacctcagtatttagtcggcttacagcctgctattaactcttaagctaaaataaaccagtaacctgttttatttaacttatataaataagttcacaggttggccactatacccctatccccatgtacagattaggaagcaactactccctctgttcttagaaaaagcaactcatcttaggcatgtttagttctaaagttttagttctaaagtttttcttcaaacttttaactttttcatcacatcaaaaacttttctacacacacaaacttccaacttttccatcacattattccaatttcaactaaacttctaattttggtgtgaactaaacacagccttattactaggttgattttttttgacaaaaaaagtagtagtataaaacaacggaatctgctgcgttctaacctcaaggttcccaacctttctccctcgttttccgcgcgcacgcttttcgaaatgctaaacggtacgtttttttacaaaaagtttctttacgaaagttgctttaaaaaatcaaattaatctatttttttaaaaaaaatagctaatacttaattaatcacgtgctaatagactgctccgtttttcgtgcggaggggatgggttcccaacccagtagtagcctagtagctgtgcaagcactatactccatgtaaaagcatggcatcctgacgatatccggcgcttcaaacgtgagaaggttgtccttgtcacgacgacttggccagtcggtcgtgcaagtggggattctacgacgtctttgcactcccttccagtggcggatccaggatttcaacaaagggtattcaaagttgaaaaaaaattcttatagagctcaaaaggttggagtggcaaaatttaaagtacaaatactagcataacaatatagtagtaaactgataatgacatgtttaaaggtacaaacagtagcacaatggtaaaaatgtctaaattataaaatggtttgaatgaattacatgaaaactgaaacaaattacaatttaactttgcgggtagccatggcttggaagcgagaaatgatgtcatcatctgttacttgcacaaaaagatcacgctccagaaaggttactaaacaacattcaaatattgttctcccattctatttcttagcttgttcttgacataattcatggaagaaaacaccctctctacactagcagttgccacaggaagaattaagaccaatttgagaagcttgtaaacaaattcataagcggtgtgcttctttgttgcaacaagcatggtggaaagctcaaccagatttttcacatttttaaacctttcatctttacgaacaaaattgataaagagagtaagctgaaagggaagatgtaacaactctgtttctgtgaagtcctttggataaaactgagcaagctaaccaagttttccttgttataagcagcaaatgaatcgataggattgaaggatgccatgcaaagaagcaactccgtgtttagaaatcttaccacgggctagcaggcagcagcacgggtagcagtagcagaccagccgccaatgcctgaacgccatcgcgccgtcgccggctcgccgccaacgccgcaaatcggcaaatgccgtcgacgcctcgcgagttcgcgacctcggctgctcggcggcgctgcggccggcagcctcggtgtcggcgatggcgtcttggcgacctcggctcggcggcgtcacgccgaccacccaggcgcccaagcagcgagcgcccctcgcccgtcgccgtcggccgtcgcagccgcagcgtgcagaaggcagcagcgccgcccttgcgtctggtcctctggctgactgggattggggattgattttgattagggtttactcccgtttcgggccaatggacctatttgctgggccaaggtggtgagggagagggaatctacgggctggctgctactgataagtgggcttttcttcctttgggctgcacatactacacttattatgtatgattgtatatatatatatatatgcatcacatacctatatataattatttttttggaaaattctatgggtattcaggtgaatacccatgaattacattgcatccgcccctgctcccttcttctcaggcacggcagagttctagagagcggcatttcaacatcagcaacaccaacactcccgaagcttttttttttttttggttattttccccgagcgtcaaaaattctgtggtttgcagttttccacgtaagtatattccaactttccaatagatgtacgtcaaccctttgctttctctgcagctgcagagttgcaggtttgatgaatgcagcttatctacaaaattcccatcagagggaacacagttacagaagaacttggggaagtacagactgcaaatccacaaggatcttctttagaaccgtatatgtaaagggcttcatggattggccactatatgggtgttatcctcaatcgtgaatctgcaaggtcagatatcaatatatcaaatgcagattgcctcattgcagattgctgtggattgttcaggttccaggttagcccagtcaccagtcttcactgacattagcccgctgtagttacatcagatagtaacaagctgtcaagctcctccaccatttcggaactcagtcggtggtaaggcatcggaaatggcatcaaaacaactcttgctgcctacctgaatgtatcacgcagggacagataatattaattttgtggtccacttgccaattacacgaacgcctcattataagtgaaaaactcacctttcagctatccgtgctgccatcatcgtcatcttcatccccagaagcttcataacgtggctgatcatacttctcacgaagctgcttgataggaatgaagtccccagcagtgtcctcgccaaaaaacagaaattcaatataggggtgatcaaatcttccctgtaaataaagggggacaggcggacagcattagttcaatttgaccaaaaatgaaaaccaccaagcaaatgaagaactcaaactcactttctctggtatttcagcctctgcaagattttcttctgcaactgaaattatacagacataacatgtctcaaaatggcacatcatagacataaaacagtaagtgaagatggatttgatcatttgactactgaattagcctactatcttgccttcttctgccattttacacaaaacaagattgctcattaaaagttacagatctcaagatagaatttccaccagtggtcatgtctatcaaaatagtggaattattttgacatgagaatcagcacatagttgttcattttcactgagcaaaggtaatttataaactgagtagagaacctgctagtttatatttttcaggtcgagtaaaaatatagtgagctgtctctggtgatttttctgaacaatagcctgatgaggcttctttaataacagcataactaaagataaagtcgtaataaatctgagttagcatatggaaataaatgttttatgtgaaaatatagctcaaagtcaactgcctcataaactaagtgtaaacagtggaaaagaaaaatcaataccatatgcaacaaggagttctggatcagcatatacatcaacaaggacctgcaagatttcggcaatgaatcacagaggatcactaagcatctcaattctcaaaagactaaactatgcaaacacatcagtatgcatgggcaatatcatccaaaagtaagcattagttgcatagagaaacagtcaatcgcaggctaataaaattgcatcatgaacgtcctgattataccgaacaaatccaaaagggaggagaaaaaggcaatg

SEQ ID NO: 29198 - DNA, 10316 bp, Oryza sativa
tgatgttacatgaaggaaatgatatttctatgaactatgggcattgaggaactacttaaattggaataagtcaagcagcatttacttgataaaaaggttgattcggtcctttggacaagttttccacatttgctgtctccatccatgacttggattcacagcacacatgatccatgccacaaatcacagctctatatccttcagcaggtgatgtaaaattaagaagataaactaaagcatgttcactgaagtttaatatttgatacaaagtgtgctttaacacatgcaaatgttacatttaaggataatgacaattatgaaaaattaacttcttatataaagtttgaaaagaaatttgtagtagttatccattttctggatagcttcagaaataatgtgtaaacaataatacgaagtgggtagtatagcagtagtactcaccgtgtaccttatggcgtactttctgccctagtcgaaatgcatatttcacattttgatatgcaagggccttagcggagactgccagagactctgtctacatgatgtttgaagttaatatgttatttacacattaccatcacatggccggtgcactacagttttgctgtacctcaagtttagcaatttcatcacgcagtgcagctgccaaagcatagttttcactgtcaacggccttttgcaaatccgcactgaaacaaatggataaagctaagtgacctctcaaatgaaccaatgctacataacactagaacgtcatggagaaatggaaactattaacataccgcacgcgtaaaaggtttatagctttgtcctgagcttcagtctttgatgagcctcttttagcttcacgttgcctaattatcactgtttcaatctagaggaggatattttctttagcaagtctcatacaatgaattcatttatcttcaagtgaagtcatttggtacctctgtgagtttttccctcaattgttttgccacatcaaattgctctatattcaatgcatactagtaagaaccaagaaattcaatagttaggctggacgtgcataggtaagtatcaaacagttgcatgaaccagtgactagcaactaagaatgatgcaatgatcatgatagtagatttagttagccgattgctactagtctagggaattgatccgtgaaaaaagaatagctgccggctggattggtaactttattcgctttagaaaatgatggtaaggaagcaacaactcacctgtatccgggtttgtaggtccaattggaagtagaagattaagatgtcttcgttagcagactcactgcgttccatccttgcattactactgctacggccatctcctccaaatagccatctagcattagttctcaccgtagtacccatttgccttctattggtcctcatatgtagttttttcacacaccaacgccacgagtacgctccacaggttactgaatttattttgtaaaacagcctcagatcatccactgcaagacaagctggtctaaagcatgatccatgggccgaggaaattgaaccacatgcaaaaatgccttgcattgtattagtctgagacttgaccagttcaattcccacaactgatgcagtccaatcaccacactgacagttgcaatcagcaagtcagtgggatccccaactgcgcagagatcaagaacattttgcttaaaactagtacaaaatgcactgggtaactgagaaaggctttgaattgtggcatctaaatgattacaaactactattaactaacaaactaacaagcagtgcttggaatcctaccatatcgtaaatgtgcaataaacattttactatcttctttttttgttcgtagatactgatcaatctattttgaattattaaaggtaaatcgcacctaacgtgatccaggcaagtaggcaaagaaaccatcaaactctttggaaataataaagtgctagtacacaccagtgcgtttcgtttcgagtaatatctatcagtgctctctattatcacgcaaaaaaaaaactcaaaaactaatgggttatacgggagaggtaaggggttttgcccgcaacagataaaatgctagaaaaagctacgaaaccaatcaaaggagccacagttcatcaccaacggaagaaacgaaaccaatccaagtcatttcagaaagaagaaatcactcaagtcctaatgggactccgggctacgccgaagaaacgaaaccaatccaaatcatttcagaaagaagaaatcactctcaagtcctaatgggactccgcgctacgccggccatgtagcgagcgtggcgcgcgcttcggtggaaggaggagtccgggaagcgtcgacgagaggcaaaggaggaaggaggaaggggccacgctcttctcggccataactaccactggctcaagtgtggcggtcgtcgacgcgataccggatagaatgtgtaacgcctggatcaggtgcagtcgttgcatcgactgcaggttaagcagttggggtgaaactagaccgtccaagaaccaacgaacgtctaggattctctaacctcgccttctcctcccgttcccttcaggtgaaggatttagttacaactaaggaaaaaaaaatgggacttttaactatttgccactcttacgagtggtgcttaacaatttgccactaggcccacatgtcatagacaaatgagagcccacatgtcatagacagcgagtggcaaatcattaattgccatatcccaaaagtggcaaatagttaaatttcccaaaaaaaatatccgtgcattgcaacagataaaaatgtttcatagtgataccaccgtaattaggaatcaagtaatgaattgaaacattaggatcactatacagtttaattaaaaaagttaatgaaaattttccttagttcttttccttagttttgggcctaaagtccattctttcattcctttttagtcctaatctagttcgctacctccctccactcagcacacctctcttcagtttagcccacaagttttgaaccaaacattaatggtaaaaaaaaattcagagattcagaagtaaaaaaatgtgaaagattacctagtgggcaagttttgaaccaaacattaattgtaaaaagaaaagaatcagagatttggatttcatagtaagtaaaaaaatgtgaaagattacctaatggcagcagctagtaaatcatttaaaaatatccgtgcattacaacggatgaatacaatttattttaataattaatttgtcacatggtaaatcatccgttttacttattgatacttaataaatattacaaattatgtgagtttggatgagtacaaatgatgtgagcttacatttttcgttctaatgcaactattctaagggtgtttggatgagattcagtaaccaaattacatccgctaaaaacaaaaatcaaaattaacaagttgaaagtaggtggaactgggcagaacacctgatgaggtgtgggaagggagggatgctcaccggcgagcgatgatgcggtggatgcaggaggacgccgggcgaggagacgaaattcgaggacgaggccgaggccggatgggatggattaggatgctcaccggtgagcgaatgcagcgggagcaggagaacggcggcgccacctctgctggcaggatggcaggcgagggcggcgggcgaggagatgggacggattggggagggaggcggaggtgcagggagcgctgttggtgcggcaaggcgtggcgagggatggacgcagggagcacgacgcgcaggcgcaggtagcagagcggaggcgcggagcggcggacggccactcgatctggattggagtttggagatggatgacaaggaaggggaagcgatatttttctcttcggtagacttttctattgacgcatgctgtcatggggcctttgtttatgggccatggaagtcctacagatttatctcgattttttttcttttttcttttttattgtttaaatatttacaaaaatattataccatccaaaatatttacacaaatagtcccttgccgctctctacaagggctgcaagagggtagtccgtccctcacatcaccctgtcgctctccccgagggcggcagggtctacttctgtaaatattttctccggcacaatatttctgtaaatattaaaaaataaaaaattaaaaatgaaaaaaatttgatttatctctacatgtaagcttgttaagcctcgcgagcaactcgtgagccagctcgagctggctcgttatgcctaacaagttgaaattgcagctcggcttgtttcaaaaccataacgagccgagttcagtcgagccaagctggtcacgagccacgagcttttcgtccagccctatgggtcatatgcacaggcccatgaagctggaattttttcatcacccaaaaaaagttcatctaatgtccccttatcgttgagttttaaacggtcctgaaccctctaatcttgtaaaaccggatcacttttgataccaaaggtagtattgtttttcggttttgttgacgtggtggctgagtcccacgtggaccccacaagtcaactggcaatcttcttccacctcactccccctctactcccatctcaacccaaacctcctaggcatccgccaatgggtggggagaagggtgtcggtcggcgaggaaaagctcgacggccgggagcgctcacatcatggacttgcgtgggcgagtggtgcagcgtgggtcccaactacaactgcaatgtcgtcttcacatgcacgcgcgcgtgctagggtttctgcctcgtcacgctggccaagctcctatccctcaagctcatagtcgccctcggagctgttcaaaagccgatgtgtttaggtgtcaccgagctccgcctctcgtccgcagaggagcacgcgcggttccgccgcattgtcttcgaggtcaactccatctgcaccacattgtggtcgcatcgtcctcgacgcatgtgcccttctccctgtcgttcgccactgccaagcttcttgttagctgccagccttctccccacccatcgccaggcgccgttgtcgggcttctacctactgccgccacccaacgaccaccacctttctccctactggtcaccggccaccacacacctctcccgcgattcagcgtccggcgtcctcttcatgtgcatgcatggacactcatggagttagtggtgctcgcgactatgctcaggcatcgcaacgtacttcatctcccaactgttggggatcctctcgccaatcccgatggtgtggctggcatgcgaccacgatgcggacgcggcgtagatgcgtggcaagctgccacgcaacgatgtggcagtgtaacccgaggggacgacacaggtccatgacgcaggttcgcgctcttcgccgtgcaggtccatgacgcagccgtcagtcgccactcttcttcccacctgttgtcggctgcctaggaggtttgggttgagacaggaagaaaggggagataggtgggagaagattatcggttgacatgtggaacccacatgggccccacgttgactcagccaccacgtcaccaaaactggggagcaatatttccttgggacctaatgtgacctgcttttataagattagggatatgttatatctggtattttagttcaaggacaattttgaaactcgatgacaaagaacctcaagtgaaccttttcctttcatgtctctcgtttcgatctctttcttttaagaatagcaaagatgctcgtgcgtttgcgataggaaatccaaattacatatgttatttttttcatgttcggtggcggagagttagatgatggatatttcgggcccttttttcatcaacctgagtgggtctcatgcacgtcatggatggaacatatgatgggtttcccttagagataatcaatacctgaaggtgtaattacttattggtgtggtataaagattttattttttgctgcaagggcacttatcactataaaaaatgattttcgcatttggctaaaatatctatgtaaaagaggagggatatttttgcatacggaccatttaagaggtcatgcggccccttaagattaccgcatggaaaaataggctcatttttacatgccgctctttaagagtaccacatgggaaaatggatttctgcatgcgagtctcttaatgagccatatgcgaaaatagagctcgatttttgcaaacgcaagtagttacggttcgcttgtaatctgggttctcgtatagaaaaatcattttttagtagtgtgaataatcatagtggcaagagctcaccaaattaagtcgttcttaggctatctaacacaagagaatatatcaaaaccatgactaccattttcaaaatgaggaaaaaaagcgaaagagcctatagcctagtggttacaagagcctccgtagcatctaaggtcctaggttcgactctccataggagcgaattttctaggatttaacggcgttgtgctttcagtggtaggcgacgtacccttcgatagcgaggcacctgtggtgacttcgtcaatctctccaggaagatttgccggcccagtctttgaagatgtttataggggtagggtttgcatgtgtgtgtttataggggtgagtacgcatgcgttatgagcgtctgcgttgtactaaaaaagaggaaaaaaaaagcaagaatagcacatcgatttgaaccagctacatccctttttcttataatcaggcaaagattagtacaattcagcaattcaagttggcgttccaagtgtaaacacgtcttaaaataaaaagaaatgggagagcgcactcgctaacagggatatgatataacacaaaaatatactccatccgtattttaattattttaatatatgacggccgttgacttgttatcaatgtttgaccattcgttttattcaaaaaaaagttatgtaattatcatttattttattatcacttgatttatcatcaaatattatttaagtatggcataaatatttttgtatttacacaaaaattttaaataagacgaatggtcaaatgttgttcgaaaagtcaacgacgttatacattaaaatacggagggagtactatcatgttcaaggcagtataaaaaaccatttttacatgcggccaatttcacatgcgaccagcacaaccgcaagcgaaaatctcaatttttgcatgcggtcaccaataccaactgcatgcggaaataaattcgacaaaaaaagatttcaaaaaaaaaacccaaacactagcctgccggctggccgcttcagccgctgcctgtccgctgttgccaatcccgaaggcgggagtggcagatccgcccgctgccgccgctcccgagagctgggacggtggacctgcctgtccccattgttgccgtccaccacctgccgatctacccgccgccgtcgctcccgagggtggaggcgacggatctgctcgcccccgccactgccgctactcccgtggtcgtgggcggtggatctgcccgcaaccaccaccactgccgctcgctctcgcttggtggtggagaggagaggaaagaggagaggagaagagaagagagagaggggggagaggaaaatattagaaggagagggatgagagaggtggtggaaaaaaattgaatttggtgaggagggaaagatagatgagggaaaaaatactatggagaataagaagatattttcgcatgtggactagttaagaggcccgcatgagaaaatatattttcacatgtggccccttaagaggacgcatgcgcaaatagacttatttttgcatgtggctccttaaaaggtctgcttacgaaaatagattttttatacgggtctcttaaggagtcggatgtaaaaatatcgatttttgtagatgtgaccagttaccgttcacctacaacctacaggggtaaaaaatagtttttttaagtagtgaggagttaggtttgacgcccttgtagtgtttgcaaggtttgtagacggtatttctcttcttttttagatgaatgtagacggtatctaacatttgttaattaagtcaacgaaaaaacaaataccaacatatatacatatgtttgctttctaagttgaatgtagtgtacacacttgctgacttggagaagttttcacatcaacgcgcacacggatgcgtacaactgcgatactaagctagtgtagtctttttttttttttgaaattctaagctagtgtagtcaaaactttgaccaacgattgtcgagtgaattggccatgacggataattttgtaaatctaacatgtgaagattgttgtttggcatataaagtgccacatatatacatttggttcatcttttatatataacaaaaagtttcattagtaaagaaaaactatatttgttttatcatctattttattattaatacatgaataacacgaggcatcactttcaccgtggagattagacatttccatattaaccagagaataagaaaaattagaattcaattagatatataatttaataataattgaaattcagaataaaaaataatcaatattaaaagaacgatgcatgtagaacaccaaacgagattaataaaattcataaaaaaataaagtccgcaattagaaaaataaaaaatagagttcaagtacaaataaagttgaaaaatatcttaaattcgtaataaaaataaaaaatattaaaagaatagtcacgaggaacgcattacgatattaattaaaattttaaataaaaaattaaattaaatttgaaattagggaaaaataaatgttcatgtaggaatataatttagaaataactaaaatcaaaataaaactaaggaatgtacaaagaagaaaccatttggaacacaacacaagattaattaaaatttaaaataaatgctgacattagaaaaaaaaagagagttcatataaaaatataatttagaaataattaaaattcaaaatgaaaaaaataaaaaagtcaatgtagaacacaatacaagattatttaaaattctaaataaaaatagggcatttaactatttgccacatttagatttagcgtttaaccattcactacccatatgccaatgccatgtggtttctcttgtgtctatgacaagtaagtctagtaacaaataattaattgtcacatttaaaagtggcaaatgattaaatatatcttaaaaaatagattccaaattttttaaaaagagaaaaaataaatgagatatcaagttttggaatacaatttagaataataaaagttcagaataaaaataaggaatattagtaaacaattcatcaaaaaacataaatattgcatatgataataaagaggggttatcaggcaaaacataaaagagtagggtcacggtggttgatgggacatctaatctaaatatactatcttcgtatcagaatgtagctatttctaacacagtaacttgtcccaaaatgaagctatgtctccacctatacctcatcctctcaaccaatcacaaccattctccttcacctactttcttttttcaaccaatcacacccttttcttcaattattctcatctactttcttaatactcgtgccaacctaaaaaatatctatattttgggatggggaagtatgtgattctgtggtgtggtccttgtaaacttttatgaatggtaaattcgcaatggtttgtttcaggggataacgggatatatgttgatatattgatatggtgtgtggatgatttgttatgtattatagagcatatgattttaaaagcatctgtttgttttatgcgggaaggggggattcacggggattaattcaccgtatgaggatggggatggtaaaagttttatccctatcatgattggttgggacagggtcggtgaaatttgaacctcacattggcgaggatgcagggagcaacctctgatggaaaatttcctgttgccatctctacccctagccctaagcgtgcctccttgacagaccccgtcatgatgtggtccccattagagacttagggtgtgcgttcgtttgaacaacaaatgagagtcttcgtgacttagggtcgtttgaacaacaaatgagagtcttcgatttctgtacacacatttcctgaactactaataatatgtttttagaaaagccataagaatgttgctctaaaaataatattaatttatttttaaaattttaaataattaatactaaattaatcatatgatagttgctcacattattttacatacttttttttctcctcttaaaccttctatttgtgcctaccataaggcacagggaggtgtca

SEQ ID NO: 29199 - DNA, 23167 bp, Oryza sativa
acatttaaatacgggagggagtgtttattagcactaactaatcttgtgattaacactcatcacataattagtgtcagcgcgtgtgggcgtcgcacacgggctaattaaattcttttttctctctcacccaaacagagaactcgcgaaaaaaaaaacatcgaactacctatttctacgcgcgcgcgacttgatctttctgcgcgtgcgcgcgtattagaagcccccacatatatatatatatatatatatatatatatatatatatatatatatatatatatatatatatatatatatatatatttccagtaatttaattacaatgtatcactgacacatggaaaacacgaataccaaccttacaataataagtggtgctacaatacatagcatatatcctagacaatgtccgatatcatactccctccgttttgagatgagcacatatttgaccgtttgtcttattcaaaaacttttgtgaaatatgtaaaattatatgcctacataaaaatatatttaacaatgaatcaaatgataggaaaagaattaataattacttaaattttttaaataagacgaacggtcaaatatgtttaaaaaagtaaacgacgtcaaacattttgaaacggagggagtatatatttgtccaggtttattggctagaattaggttttatttagggtggagggagctccacatatagatgacacttaggccttatttagttggagaaaagttttaggtttggttgtcacatcggatatacggacacatatttgaagtattaaacgtagtctaataacaaaacaaattacagaccccgctaggaaactgacgaatttattaagcctaattaatccatcattagcaaatatttactgtagcaccacattgtcaaatcatgacgcaatcaggcttaaaagattcgtctcataatttacatgcaatctgtgtaattgattttttttctacatttaatactctacgcatgtgtccaaatattcgatgtaacagtgtgaaaaattttgttttgggaattaaacagggcctaaatggttgtaatgtgggccgcttcctggctccagattgtaccctaatagtttagctttgatgtgtacatctcgtgccggaccattcgtcttctccttatcaccgtcgttagtatcagccgtcacctctatttgctgctgcaacaatcaaatcataggtaactaattactcttttcgattcatagtattgtcgtttgaccttttttcttgttaaacatatttaagtttaaccaagtttataggcaaatatagtagtatttgcaatacaaaacaaacatgttatcaaaatatatttaatgttaaatttaatatataaaactaatttagtgctgtagatgttgctttttttctactccatccatcccaaaatataaatttttttagcatagtgacaagtcaaatatttttaactttgactattaataaaaaaccaattaaaaaagatcaatcaagtaaaattgatgctactatatttattattaaacaatctatcagaatatgcaacttttttaaaaaatatcttacttttatagatattattagtcaaagtagcatcttgagtccaaatatgcttatattttagacaaaggaattataaatttagccaaatataaaaaacttttactaagaaaaaagtcaaactgacatgaaacatgagcgagtaactatatgaaacatgagcaactaattaagttgctcgtcaattacttcttcctcccatgtaaatatttggcttttaccccatagagtcagtcaaacttttatatttctggcatcgataatttctcaaacgcttactttacggacaaaacaatagtagcaaacatatactctttgtctaaaaaaatactattatatataattgcataaatttattgtattttgcaagcttgttctagtatatataacttaatttatgtatacacactactgttataatttatattaaatataattttgttatatttaatagaacgcatatgctatcgtatataatattatattctcatgatagtatatatatgagtaaatacattgcattgacttactggagcaccgtggttgtcgcaggatgacggaggagaggcaccggcggcagcgtcgccgccggagttctccttctggatcagctcgtcttctagggctccggcggcgtggtcggcggcggacttctcgcccgcggccgcgttgtgcttgagactgcggctaccgttgctgccgcccaggaatggagaagaacaggctagacgaatcgcgctgccggcgccagggacggggaggcggtgagcgtgagccgggcggcggcggcggcgagcgtgcacaagctgctgcttgccggcgccggcggccaccgtcgagacgtcgaggcgagcgagcgccgggcgggccgccatggatgagctagctagctagttcgctatggctgctcagcaactatgagaagcgctctatttatagcctgcctgcatgtcgttaaacaacaacgactagattaattaatttgcatgttgtatatatatgtttaacttgaaagtttggcaccgtaaaaagtaaattataggtcccggcctatatcttttcgtttagacatatttaaatgtatatataggtatcttaatggtaatctcgggtggtatatattactccctccgttccaaaatataatcatttctagctataaatctggacatccgtcccaaaatataagcattaaattctagctatgaaactggataaatatgtccaaattcaattgattatattttaggacggatggagttatatcaatagaagtacatggaccattgattatgagttctacgtactcccccgtaaaaaaaaagcccaacatttgataggatgggatatggattggatattttctaatataatgaatctgaaccgtctttgttgttctataaaacacatcccatgcatcatatcatatatagctaggttgtctttttatcgacagagggagtatgtactattgctaggaaaaaatattattcatgctattgatttgagttgaggtgtagtataaatagaataaactattggattataaaaaaagatgaatagttatcaatggattccattttaaaacatcgcatgattcaaatgtgacaggttccccttttagttgtactagcaattcatttatactacacaagtaactaaattttgaacgcgtggttagattatatcctagtctctccataaaaaaaactcaacttgaaaggggatgcgacataaaatgaatctggacaatcatttgtctagattcattgtattccccctcctaggttaggtattttttacggaggaagtacatcatatatagcctttttagactcgcacatttgttcaaatatcatcgtacatgtaatgttctattacgtcacaaatttattcgaattttatatgtcattccaaattaatttggagccctaaatcacttggctatgtcgaattttttattcaatgttcaccgaattttaattaaagttcgacatgatgattgaagtggtttatgaatctgaatgttggatgatatatataaatttccgctggggctaacatttcagcccaaaatgagattgcacaccggtttacctttaatttcttagcatatgattttcttttgccactactaatataatatagtgaatccacaccagagacgacacacaacagacttagcttgtttgaagtcaaatttttgtattatttgacacaagtttcatgttaaattaaacaatgcactattcaaacatattgatttgggcatatctatttgcaccgtgacctttcttcgtactacaccaattagaaggaactagtcggtaattaacccattagtacacagttttgctgtactatgtacctaattaagtcattcaatccgcagctagttttggtcacctatatctaactaacggtgatgtatgtaaaaatttgacggatctatttattagtctaatccaatcatagtgacatgaactcacaataattaattagcacttaaaatgtcatctaagttataacccaagcgagaccactcgtcttattaaaaaaaatttatgcaaataaaaaaaataaaaaattgtgcttaaagtactttggataataaagtaacaaaaaaaataataattccaaaaaaaaattaataagacgagtggttaaacagagcaaacaaaaactcaaaatcccttatattatgggatggagggagtaaaagatagcacatctaaattataatctggatgaaaaaaaaaccatttgggtagctttttgttctcggagaatctacagctaccataagctccccaaacaagtcccaaatccttacttaagcagggagattctgacagctgctgctcctctttcagaatttccaactcactcaaacaatccagattctaacctagattcactactaaaaaaatgatttttcatggcacttttcttttatattttcagataaactaaaaatagtgccgccagtgaaaataacgtttatttttaccaatgaaaaccacataatctttactggtagatgacatacgcatctaccagtgaaaatcgatgattaagttgtccaccggtgaaaatcaattttataaaaatatgtacttttacctaaatttttcataaaaagtcaaatgaaaataaagtttagttgaaaacttttatgtttgaggttatttagagttcaaaatattcgttttaagattcaaaatatattttacaaaatttcagatatatgattcaaataatctctaatggacacatgatccttgtcaaagttgagctcaacgagatctacaactttgtagttcatgacatgttttcatttggaattatttagagaggcaaataagtattttaagttttaaacaatggaaatcaaaacaattaatagcattctgaatatacaaaataagtgcttcatagttgagatggtaatgtaatatatatgtgtgtagagaaaggacttgagatcgaatactacaaaccacacatttgtgaatttaatcccaaaaatgcctaaattgtcaattaggatgtgtagttgtgttatagatacccgataaaaatcaaaatatttttttcattttattttcgcaccggaaaaatcaaaatgataaagtggaaatcaattttcgttggtgtatgtgttatgtcacatgtcagcaaaaatcattttcactggtggttggatgctgtcaatgaagatcattgattttcactgaccgttaaagttggcggaacgtctagctgccaagaaaaatatgttttagccaacagaaaaaaaatatgttttttagtagtgattttgagaattatagaatttataattgtatgaaccaggtaataatcgaaaagccagaagctgaacaactcagccttttcttgattctcaactagctagttgcttcccgaaatctgaagctcgactaaatagggcgtaaatttacctcaagcatgatacataatcaggcagaagtccaataccattcaacaagtccacttggcgttgcaagtgtgtaagcgtgttaactagctcaagtgtggagaagacactaagctcgctaataggcgatgaatcaaataatatatatatcttcgacgatgaacatgtcaacatgaccttatgtccttataaagttgcaagtgtagacctaatcttaattattagccaagtcaaccgaaaaataccaatgaaaacatttacattttaacttaaattacgaatcacaccctgccgactaatgaagacatgcttccacatcaacacgcgcgtggttacacacacaaagctacaaataatactaccagctagcttgctatagtgtgtgaactttgacaggcaattgctgatcgtgtcttagtcatgactcacttttacgactacgaatcatcttctcgtattagtctcctaaaacaggagttagagatgtcggacatgttttacagcaatacctcaaatgatattctgtgtgcttgtaaatatgcgaaaaaaaatattcaagatgcaattatttcacatatacatatataatactccctccgatttttcaatgttggttgcggttgattttaaacatatgttttaccattcatcttattaaaaatatatataattatcatttatttattgtgattttttatcattacaaataaattaagaccttaggtcattggtgcctgttccataaccgacacccttgagatgcattggctcaattcgagctgatgctttgagctaagaacttaatctcaaatcatcacaaatctaaccaaaactaaatctcaatccaatcaaaatcatcctaaaataaatcacaggacaagagacaatccaatcgaaaatcacaaaataaatcacacaggagatgacaggagagggaggggcgagcgagaggccacccacattaattaggtaaaaggtaatttagggttcaattattaggaatacacaatttgaaaataaaaataactgaaattcaaaatgaaaaacaaccagtattgacaggacgatgcatgtagaacgagactaataaaaattaagaataaaaagtaaaataaattccgaatttataaaaaatagaaaaactgagttcatgtacgaatacaattgtgaaataagagacattcataacgaaaaataagaaatattaaaaagaatactccatgtagaacacaataccagattaattaaaataaaaaaataaaataattttcaaaattagaaaaattaaaaaaataagagttcaagtattaatataatttataaatactaaaaatcagaatataaataaggaatataaatagaagagaccatttaagaatccaacacaaaattaattataataaaaataaaataaatgttgaaataagaaaaaaagagagagagttctagtaggaataaaatttagaaataaaaaaaccgtaataaaaataagtgatgaaagaacagtcgatgtagagtacaatacaagattatttaaaattcaggataaaaataaaataaatccccattttttagaataaaaaaaatgagagttaatgttggaatataattttaaaataataaaagttcataataaaaatatttaaaaagttcatatataacctaaatgtgaaaagtaacaataatgaggggacaacgggtaagccggaaaggagtagggttgcgacggttgatggcacatctaatctaaaaacaaatgctcaatgacaattaggtttgattttttttaaatcccaatgactattaataagagggcagcgggcacaacgtgacgaagtagggtcgcggttgacatgaggtcgataggacttctagagaataataaaagaaactcaataattatcatgttcgatttttaaaatctcaatgataataaaaggggatagaatgagctgtaaaagaagtgccatggtggctttggtgagacttctaaaagtacaaaaacagaacctaactataaaaagactacaaaggtctgatatttgaagattttatggagaatatggagaggataaattaatagatgttatgtcggaccgggcaagtaaataattaggcggcaattcggcaaaggtcctagggatgatgtttggtgtgacttttaaaaactgtaaaattagaaattccattaaaatcctaagacaacgcctaagacaacgggatgactggatgcatattttaaaaaaaaataaaaaatcgtgagtaaaaaaatgtagataatattatatggttgttagctgcgcaattgtgtgggccacccatctagctgcaataatattgtagtacataatccgattaattttttgttgaaaattagtaacaaaataatcgaaatgatatgtggtagttcaagctttcaaattggtccgattccgcgcgggagttcggacgaccacgacgacataataacagtagtagagagattaaacacgggataatcctccctaacacggctcctaatcggattcgattcaacgcgcgtcactagcatataatcacccgcccggattagcgacgcataattaatccgtctacgtaggattttgcacacgattaacatctagcattatcgccaacgatttgcgatttgatcgtcgtctcgtctcgatctccggcgaaatcaacctacggccatggcggcggcggccgccggcggcgacgcagaggaggagaagcagcagcagtcgccgtcgtcgtctacgttcgagaggctgcacggcgagctcgtcagggaggccggggagctcgcggcgtcgtgcggcgccgacgtcaccgtgctggccgtcccccccgcgcgctcctcctccttcgccggcggcggcgtcacccgcttcgtcggcggcggtggcggcgccgccgcggtgccccgaccggaggaggtcgcgagcatgggtcccgatgaggtcgtcgcgctcgacgagcggctgcgatcgctcaggctcctcgtgatgcggaggatcaaggcggaacaagagaaggcggcgacgaagccatgacgtgttaattagctaggttgattgtttgattctaggtgtatatattgtcacatgtcatgattaaatttgtgttgttccaatattaaaacaacaggtcaaaatttctacaagtaagaacatacttgtgtaattctccaaaaaaaaaaaaacatacttgtgtgtgtcaatgtgtcatacagcgtttaatctttcgatttgtacgtatcggaggtgccgatatttttttttagataatgtaatataatatctcggcctttgctcaaaaagaactacagccaattattataaagatccactccagaagagagtgtagttcaagacaaattgaacaccccaaacaagagaagagaggacccaaactgagaaaagcaaaacaaaatgtggagctagaaggcctcgtcaaggactaggactgaagtttgaagcccatgcatagaccaatgacaatatccttgcatgaagaggtttcttcaaagcggtgcccgcaaggaggatgcgacgtggatcgctgccaccgctcgttcggaaccgaagcaaagtttttacccggagaatatggtagggaaaggaaaggggtatgctaaaacaacgcctccaaggaggggaacaacgccaaacggcgtcgccgttgtcagccagccaaatggcttggcaaggctttcgcccacgattccatatgcaaacccacaccaccaatccgcacaagaaggatcgtcatcggtcaacaacattatcccttcagcgattcggccaaggcaccgcccacagttgttcccgccgtcgatggcgcgcccgcacccggactcctccttccccgccgccagaccccttccccgcctccacataccgccgccgccgacgacgcaccgtcagccggatgatagccttcaaccattgccgccataggtaccatcgtcgacagccgatatgatgagtacttcacttcatcggatacgcacgtggcttcacacgtttcaatgattgttttaagtccaagtccagttcggtctccagggaaagcactgactacaaacggactagtgtcttcatgccaactttgatttgggtgatcttggacttgatgaaaaaattatctcgctacctttcaaacgtatccggtctcatatccaaattcatttttgagtcaacggaaattgtcaaaacaagacagtgttgttgctaaaatagaacttgggccttggaacctgtaataaataagcctatctcggaagtttctattttcctctatctatgtacgccctctacaacatttgggttttatttagttgaatttcaccaagtgtcattcatcttgtctctagtcctcactcgattagtcgacgactacagattcagagccctcaatagttggtgtgttgatttgccgggtcgattagatctaccactttaatctcaactatttctttgtgcgtaatcacctatatgcaatatttagattgcatcttatctcgttattgtagtgttctcttatttgcattgcagggatcatcaaccgtgcgtcatagttggtacgacatcatttgtggtgtagtgattgcacggcgtcctggacttgttctgttggttggtagccacatcgcaaacgtcgcactcgatcaaagcgagagttatcccctcaccagaaaatcgggccacgagatagatcgtcatcacgatataccgaaaatttaaacaaattttaatcaaacttaaacaaaatgttgctaaatttacaaaaagaaagtgaaaaaattaaaaatgtccggttttttttttgacccgaatgggtgggcacgacagctgtgtctagtgcgagtatataagcataaatgtaatagggagaggtatcgaatttgaaaacacaaaactattccctagctaattaatacatctcagttcttttcacttcttttcaaatcaatctactaactatgtcctataataattatatttctattatttgaatttgttacaaaatacttatcacaataaagtactaatggtttcattaatcacttctcatttaagtttctctctattttatccttaattatccttccacccttatctatacagtatttaataagggtattatatgtagtttttttggttaaatcttaatatatactaaacaacctacaattaccatttatataagacggagatagtgaattccttcctcggtacattagctgctttctattcggtttacctgctcaactgggcctgtagaaatacggcccataaactcaccctcctcaatttccctcttacattttgcctaaatacgaccaaaaaatagtcaacactatttttcttatgcaaatcttaatcaacactaaatcctaaccctaatcctactcggtttattagtctcaaactcaatgcttagtcatctcggattttaacgccaccaagctaatataatcaccagattagcggccgcttaatccgtaatcccgtctcgattttgaggtttttgttagcgatttggcgccactcgcgaaattagccgagcgatttcgatctcgtcgtgttctagaacgcacccggccatggcagcggccgccggcggcggaggcggaggcggcggagagagccagcagcagctgttcgagaggctgcacggcgagctggtcagggaagctgaggacgtggcggcggcgtcgttcggcgccgacatcaccgtgctggccgtctccccgcgctccggcgagccgcgcgtcagccgcttccacggcggcggcggcggcgccggcggcgaggagttggagcgggcggtgggcgtcagcacggaggagatcgcgcgcatgggtcgggatgaggtggcggcgctgctggagaggctgcggctacttcggatggtcgtgctgcggaggatggtggtccagaggcagaggagacggcgactccggcggcagcggccggcggcgccgccgcggagcatcatggtcgtccagaaaagacgacggcggcggcagatctgctagctataggtcgtctgaaatggttgattatttggttctagtaggtgtattaattgtgccatgatctataattcattgtgtaaataacaacgattgatcgatattatgattgaatttgtgtgttagggcaagtacataggtagagtctctactttaattaaagactatcacgttacaatatttaagataatacggtctctaaccattaatgtaccaaaatacttttttactggtcacctttcctttattatactcaatgcaacgaaaaatttcctaataaatgctaagagtcgactctatgccgttgtcatgcgtagcaattatctttctatttccttcttcctctctctttcacgtcaccaaatatgtttgcatgataatagagagaccgctaataaagaccattatacatgccctggtcaaatcatcaggtctggtctcttctactccctccaattaatgcctccatttcatattataagatgttttagtctcatcatgttttagattcactgatatccatataaatttgaacatatatatatgaattacatatatgaatacatgaatgaatctaattttccacgcaaaaaaaaaagaatgaatctaatctaaaactaaaaccgttgtagaatgtgaaacagactcatggtgtatagcagtgtatgtgcgtatgcgtttcatgggttcctaatgacaaggcatatctaaccctcgttgggattggaaaaacaacggttgtggcactagctcgaagatgagaggattggccttaagggtgtaagtggatcaaccacaaatccattcaggctaaatatactcatttacttaatctataagtaggtttgtggctatcccttaactagtctggttgacaccatcaagatggatggcgtgtggtgctttggggtggggccggacaagtggcaagagtgaccaagctgaatgagagtggaattaggcatataaatagcaacatatataattcttagggcaatcctgggtcctgaccatttaaaactcaaaccatcgtagaatgtgaaacagagacctatgaatagcaagccaacatgcatgatagtaagttgaaagtagttttttttattattattatttggcgtgcattcctctttttttttttcgccgacgatggcgtggcctctgtctattacgaaaaaaaaaaataatgctagtgaaaattagccagcaagtagaaaatgctaccacgagtattcatcacccagtctctatggcaacattggctccactaccgatctctcgtgtattcttcgccccgttcgactttactcaagacgaagacacatataaccagaaatcccgccattagcacataattaactagtgtttttttgcgacataattaattgagtgttaattattctaaacttaaaaaaataatgtatctaatattttttagcaacttccatataaaaaagaagtttcacacgaaatacaccatttaaccgtttgaaaaacttgcaaactgaaattgagacaagatttgtatcttactcagaaaatatacgtatatgtattatcatccgcgtgtaatcataaaaaactaaaacaagttcatactatcgaatgaacaaaaatactacctcgtttcatattataagtcgttttctaagacaaacttctttatatttaagcaaatttatagaaaaatatagcaatattttcaacacaaaacaaaaaaatatcaaaagatgtgcaacattagatgtaatgaaataaattggtgctataaatgttactacattttatataaatttggtcaaactaaaaaaacctataatatgaaacttaaggagtagaaaagaccgaaattttacctcctatgcttttcgattttgctatatatttatcgataatttttttctaaaaaattgactgatgtaaatatagtgcaatcttaatgtatttacattgtaatttgcatgtaaatacaatgtagttttaaaccgttcgatttgctttaaaaatcgtgcaagggaggaaggcaaaaaatcacaacccactgttaacgaccaaagttggtaagatatgaaccaggttcgacaatagagtcgaagcggattcggcaatgagatggattcgaagaacagagtatgcatcggctgcgaaggcatcggctggagtgtgcatcggctgagatggatcggatagaagacagccgatacagccgatagagatgaagcaaccgattccgacagtagtggcttcaaggctgtttctagaatcaatcgacgtgcttcacaaggattaccacgatggagataaagctcttagataggcaattgtatctattaattaggatatcttatgtaatttccttagagatatgtttgggcaaaagtctgccgcaaagacttatggtatcttagagtttgttagagataagaatcgtgtccggcaaggacatattttgtatctcgggtataaatatgacccgaacccatgtaatcaaacaacacatgttcaataacaaattcggcgcatcgccacccttttattctattttgacgagttcttgctttcggattgagttgcatcgattcgatcttcaactagaggtaaacttgtcatggtggcttgcgttctcgggattagtgcttccatctttatgacactctaatcttgtttatgtaattcgtcgagttatcatatgtactatataatctttgttagtttcgttacataacttgtcatcggctggtttttactgttagaaagtagccgatagagttaaatctcgttattgatctagattatatcgtatgtctaccatctctcagagattttcatcatcttgtttagatcttacagttattttatatgcttaatgctgcattggttaagttcgatctattaagttttatctatagttgtgatatctagcttgttttatgatcatctatagagatagcatcggagtttcagccgatcttacctaatttagctattctaatatcatatgcttaattgttatgctaaatctgccctttatattaagatcttgttgctttaaagttatattaagttcttatttgatatatcttgcttgtttcgatatcttagtatagagtagtatcggagtactagccgatacatgctaaatctatctgatcggctatgctataaacatccatataatctttgctttaacgtatatttcgacttaagtgattcatactgtctcggcatgacggccgatctatcccaatcacttagtttaagtatacatcgaagtaaaaactgtatgttgttaatatctacagccgatcgagtagatttagttttattttatctattaatcattgccgatcgattccaacatgacatcggctcaaagataaatgatatgtcattggcacctagccgatcggctatcgtttatggatttaaccgcagtttttcttgtctttattcttattgattgcagaatcaaatcaacaggcacgctcacgaacctaaaggcgagattttggacttgcacaggagttaagcagatcttccaggccagtgtgtgtttttcacatcaacgcatatgtgagggtattcggtactattacttatgttttcactgaaatagcatgccacctagggaatttcaaaagttacgacatagttacatacaagttacaacgtaattagaacatgattgtacaaatttttcagttgaaatttaacgataactgtatagctagtccaaggtttaatatttcggtttagtgttttgtatcggtggtggccgaaataccgaaattttaaaaatttcgatccaaaactatatgaaattttgaataaaatttgaacaaaatattaccaaattcatgaaaaaatgaaaaaaaattcggctgaaataatatggtatggtgaagggtgggaggggggggtccgatagaaccgaattttcgaaatttcgatccgaaattgtgaaccctgagctagtcagtcccatcctttttcatgcaaagtgataagaatggcatgggcgcggcaaacgcgggcggtcccaagctccgggcgatcgacgagccgccaaaaccgcggggcggcagctcatgtctcgcctcgccgcgcacatgacattgataataacaccgtcgtcagcgctacccaaattcccccaaggcgccgcaacgttccccgacgccggccggccgcccacggccctcgcgcgcatgggcggcttcgctccccaccccgtcgtcgtccccaccgccgccatggacgggaccagcagcgttagcgcgcggacggcctcgtctctgtcgtcgtcgtcgtcgtcgctcgacgacggcggccgtggccggcctccgccggccgggtcgacgctggagctgccgtcgcggaagcactaccggtacccttcccggtcggcgaggctgttccagaagctgcgccgctcgctcccgctgctgacgctggcgccgcggtgcggccggatgcaggtcggctcggcgagcgaggtcgccgcggcggcggcgtccggcggaggaggaggaggagcagccgactcgcacctgatgtcgcacgtcgtgtcgtcgttctccggcgcggcgcggccgatgcggcgggtgacggggacgctgttcggccaccgcaagggccgcgtcgcgctggcgctgcaggagacgccgcgctgcctgcccaccctcgtcatcgagctcgcgatccagacgaacgcgctgctccgggagctcgccaaccccgccggcgcgcgcatcgtcctggagaccgagcgccgcgcgccatccacggacgccgccgccggcaagcaccggagggcgccgccgctgctggacgtggcggcgtggaccatgttctgcaacgggaggaagaccgggctcgcggtgcggcgggaggcgacggacgacgacctcgcggtgctggagacgctgcgccccgtctccatgggcgccggcgtgctccccgcctccaacaggtcgtcgtcgtcgtcgtctcagtcgccggagaagggggcggcggcggcggacgacgaggtggcctacatgcgcggctgcttcgaccacttcgtcggctcgcgcgactccgagtcgctctacatgatcgcgccccagggcggcggcaccggcccggagctcgccatcttcttcgtcaggctatgaccaccaccaccacctactcgccggctcgccggcgatgcaccgatcaatccatcgccaccgccatcgcgcgcgccatgcaaagcaagacgaagggcgcgtcgtgattcgtgcagccctcttgacggcctcgagattcgtgaggagcaggcgagccacctcgactccctacgtcagagatggcttagcttaaatttaatcatctgattaagcactaatcttgtgctcttagtgggtgattaggttgtgaggaggtcattgcataaatcgggtttaatggtggtgcccaacacctcattgcacacacaatctagtggagtacggagaaaattatattaattaattaagttgcttgcttttgctttcttctctctcgcgtttaattatcggatggtaattttgcataatttatttgtcagtgcaaagaatttgagaattacatataaactccattttggtttagattaactaaatttttgcaccaaaaaattgtacatatatatatatatgtcacatataatctctatctcttctctactattataaaaaattaaagatctttttgccgatattttgatacggcatccgtgtttgagtcggttcttaagttggttccttttagaaaaaaaatccgtgtttgagtcagattttaagttcgtttgcatttggaaataaaaaagagttgtataagaaatctcttttaaaaaaaatttgcatgctaacttgagatgaaagttggactcatgattgcagctcatgattttctaaaaaaaataatatccaagcgaattcccccagtgaatttcacactaagtgaactgtttctttacctctactattataaaatttgaaaatgtgtttgtcggtactttgatatgtcatccgtgtacgaatcaatttttaagttcattcgcttttggaaacacaaatacatattcgagtcggtttttaagttcgttcgcttttgaaaatacagaaggaatcgtataagaaatctctgtaaaaaactcatatgctaacttgaaatgatcggactcctaatagtagctcatgattttctaacaaaatatatatccagccgaatttaacaccgtaaatttcaccttaactaaaccatataacaacaataaaattaaaatagccttcacccgttgcaacgcacgagcatttttctataaaagataaaactgagaaaagctccatccgctcaaaacagaggaaaattgtatatatatgttgcataaaatataaatttgagaaatttggtaaaaaaaatctatatttttttacaggtccattaggtatttaggctaaaaattaacataattaaccaaaaattccacattttcctagccatgatccacggatactatatgttagttgagcaaataaaatgtactccatccatctcaaaatataaaagtatttttaaactttgacatggtcttcgagatactattttgaccaattatatctacaaaagttatatgttttaaataaaaaaattgcatattatgataatttgtttaataatatcaaaattacatgattaatctgttttattttttactattaatagtcaaaattttaaaaatttgacttgacgctattctaaaagtaattatattttaggagagatgtttaagccaaacgacatatttgtaaacgagaagtaatttgtgaataaaacttttatatatatattcttagcgacctaaaaacaaatgctacaaaataaacttcgatgagaaatcctcgaaatcagttaaaaatttaagattgaaaatttaaattttagctgataaacatatacataagaaaaatatggggcaatatggggccggtagtagtattgtgggtgtctaatcaatcaaatcgaaacgtctggatcgattcgtcattatggaggtagtgaaggtattaatcatgccacgtagacaaaaaaatgtgcaccaagtttggctccattgtcgaaaaaatatcaaaaataaatgtgcaccaagtttggctccattgtcgaaaaaatatcaaaaatccggcttcctttacacgcattaaagaatgcaattcgataccatgcatgtcttgtatacactgtttaatctgaactcaggaatacattcccaccgattcgaaatagtattatattcgattccaaactgaactgtgcaatttgaaattaattaataatccggataaaatttctacaccctatggtcaaaaccaaaagtacaattactataacgttaatattatctcttaaagtcaatgcaatactcattttagtcaaacatacatggcaccatcaaatttttgaaactttaagatatcaaatttagaaatactttgtatggaaacataaaacataaaaaaatatactacatccaactcaaatatatagttgacgtcctaaattatctatagttgaacttcaaaatgttatgtcgttaataatataaagttattatgatttaatatgtgaaaattaatattaataaatttatcatgaaaaattttgtccgagaagtgggaaccagggccaccggtctttgggcgcgcggggtgctgtgaggcccaccactcttagagtagggcaatcataaggacgcaggcagttgccccgaagtataggaaaagaataactagcccgagcaatgagccaaggccccgaggtcgatcttggggctggaggattgtcctagctacaccaccacaattaaggagatttgacccccacgttgcctctcggtgtcattctgcgctaatagcataatgatgtgtttcctgtggaaaaaacgtgggtgataggacgtggcatccttctcactcttgcccacaacggtcttgaaaaaggtaggggatagtgaatgtgctgctgggcgacgtgattgttgcttcacattgcccgctctgatttgttgtttgttttggcccccttcccagcatcagtagctgacatgtgggcccaatgatgatcaaagtgcaagcctcaatcatcctgcgccacggggtcggaagaaagggtaggcactcgcattggacaaggcttcaccagatggaccaacgcaagaccaaatgtgcccactccaatatgttgggcctcacctatgtttgtatgttttaagatatccctttgctattataaaaggaggaccaagccatcgaaaaaaggattcgaaatttagacaactcaagctcactctccaagaaccacaagaacaccctgcaagccaaatagctaagcaaaaatcatatcagtagggtattacgtttctgaacaatccaaagatgtatacatcgtttaatgttcattgtttccacacgtgattcttcgcactcgagctggaacacctataccctagcaaaaactccaaaaggagggtatctagccttcccactagaggagcccgtgctacgacatatatatttttatagttgtatttgtttaatattttttatgaatagttaaatatattgatagagcatatgtattggagattgtgccaacgtttaaaacgtaagtaggaaacaacgctaggtagtaacagtaaatgtagatttgtctttttaaaagatgatttcttatcctcgtgaacttagtaaaatttacaaacttattcagataaaaacaataataaaagctatattccaaagacccaaaaatatcaaatgccatgtattttcgaccgaatagtgaataaattaatattacgatatactatatacaaagaccgtgcgttggaatagagacgtgaaacagaatccactatagattgaggtgacaactatgtggggaatttatatattttctagatatatagcctttttagctgctggaaaccacagaagatgtgcttaaatatgcaaacaaatcttagtggaggtggttaattatatacttatatgctactgctatacattattgcgccagctggcccattatatatacgagctaggttgtgtggccattagattagcttagctagagtatatacttcaattaagctcgccatatatagctaagctagctagctccacagctgtgagagtgtgagctttctgctacagctagcttagctccggccgccggcgccgccgctcgccatggccaagctcgccgcgcagctcaaggacaagttctgcggcctcatcggccgcatcaccagctgtggccgcgccgcccacaaggacgccggtaagtatatatacttattgttaattctatcgcatcagattattttgtcgtgaattatttattttgttttttcgtgtttttaaaaatatgtttggttaaaaagttttttcttctgtatttgttgagatcccttgttgtaagctactatttgctaagtttatcttttctaaaagtatttaatttgtgtctaattattgtcgtgaattatttgtttggtgtttatgtgaatatgttttgctaaaaaaaacttttttcttatgtattgtttagatcccttgttgtaaggtactatttgttaagtttatctttttaaaaagtatttaatttgtgtctaatttaattatgtacataggaataattcatttcaatcgtcagctaaaattattataccatattcagtttgtcgtatgcttcaactcggccggggtaaaatttttacccgacgaagcgtgtgattactaattttgctatttactcggataattaattaattttgctgattgcatcatgtcttctttctttcagcagctggtgtaaaagagacccattcggcttcatctcaggtactctagctagctcgtttaatcacttagttacgatctcgatctgattaatttggtacgatcggttattgctgatttttccaagtttaactcggtcaattaattaagggcgattattttttcataatttacatatttttttagaaaataattgctgtttccgttggtcatttgcgcagcacacagagataaggtcaaggggacttccaccgtctgtgtcaggagggtccaagccccataccaattaacagcgacaaattaccattgatcaaaatcgatagatctctctgcttaataattaatcaacgtctactcgttctaatactgtgtggtaatgcacaattcattgtgcaatagctatatgaagcttttcttcttctactatctgtttgctgtattttgagaattttggtgttgaccagttcacaggtgtggtcttcagactaaattaacttgcgaactcggggcttattcggttaatccctttaccatgtgtgaaattaaccgagcaagttaatttacaccggggattttaccggggttaacccccggctacgaaatgtatacatgtatgtgtgtatgtttagtggggttgtacagaaaacggctggttgcctaagccctccaatctcttccttaattagcatcatatatagcatgtgtgtgcatcataataagtgtggtggagttgtatgtgccatgctgtttagataatgaaaacaataagtgtattgctattttatttttttttcggtgtaagctagctctttggtaaaatgtttttttagcagttaattttgtaagagtctcatgtccccatcgttggcttatttcctaataagccaaaacggcttattaggaaataaaaataaatttgtaggtgaaacttttataaatgtgcttttttacttaaaagccaatgttgaaaaagaaactacgttgaaaatatctcaaaatcaatctcaaaattaagcttaaaaatttaaaatttggctttttctttggctgattaggccatccgatgggagcctcaccgttaaataattgagattatgaattattgtgaataaaaattttgcaatgtgactagctgtctacctccttgtgcattgagaaaatatccaagccattcctgaaataaatttggcacatggaaagacggaaaggtcttgaatgtaacgaagaggaaactaggaagcacatgcaacatttgtgaatctctgcaggttttcgatgtgagaggagtttattttgccttctcaaattacaactttctccgtttctttttcctcctcttaattattaacctcatcccacttttcccaaatataatattgaatgagtagataaaacctagcggaatggatgtggacaaacctctctgtccagattcattatactaggtaggataacatcaagtcatatttgttattattcagattctttgtactaggtgatttaatcttagttactatatattgggacggatgaaagtagtattctcttttatgagtaaaatgcattggcggtccttaatcttgtagggttgtgtcatataggtccctaaactctcaaaatgcatattcaggtcccagaacttgttaaagtatatcatctagttcccaaatcgacacatctcctctacgatcctacgtggcgctgatgtagcatgtcacatggacgtga

SEQ ID NO: 29200 - DNA, 12360 bp, Oryza sativa
taccatggctgtgcgaccatatctcaatcgggcgaaacttcggcccgattgagattacttccttgtgacggcccgcaaattctagtcttgttatgggccgtcacagatggaaggatctatactagtgtttgtgtttgactaggcatgattagcgtgtgcggttgtgaagatagagatatattttctgtttctttttagtttgtttccttttgggtttaactttcctatttttgtgtgggatcggttcatgtgtacgacggcatgtatatatatgctggtcacggatgattagatggacccccgaacaaattatcaatctactgtttttcccgttatttacttttccgctattttttattttactttcatggctgagatatggcaacgctagaattcggttaatctttgccgttttgcgctgaaaaacggtcgtgcttctccataaaagcgaggaggttatcctttgctagtttgttcaaaaactagttgttcgtcatcacgtaagtacgatatctattttctttgctaatttgtgtgtaaaatagtcgcttgattccgcgaaagtgaattattcttgagaaatcggtttcactagccgactatcgattttggcgactctactgtttacaccgcaaatcattatgtgaactagtgttggccacgaaaaagcgtcaacagtatctggtgaatattctcaatctgaatttcattctcttattaagtgcactctggccagactgttctacttgtatgtactgtaaaactccgcagaaaggatgatatactgctatcatgttatccggactgcaagggaacgagaggtcatggtgaacttgtaccaaattatcaaatgaagtgatatgggccagagacgttttcgtgtgtgttgtttggagtttttgacatcaaatttgtaaataggatatgttatattgctgcacaccaaattgaaaatgtaagacacaaatcctaaaccttcactccgtttgagtttgtaaatatggctgcaagctagggctgccaattttatccatacccatttcaaaattagcttacccataaaataggtattattcagtggctatgggcaatactcatgtggatcccacatgtaaaatttgctcaaaagtttttggtattccaaccattcatcctccggttggtttagttttaaacttatgggtgcaagatgatcaaagataacttgccttgctcgagatcttaaccttcctccaaatccatgcactgcgagtcttcaggctttgaagctacacgtgaaacaagacgactcaacaaaaggccaaaagaaagccctattcatgatcaaaatggctttccctcaacagagcgttgatctcgttaagatgttgtgtagaagtacgaacaagatccatagccccctgcaaagtcgagtctagtgggttgagattgcttggagcacctccgtcgataacgttcacattgcgtggagtattggatgccgaagattcttgatcctccacactgtgtagaactgagggttcattggcggcaatgccaatgaatcccacgaatcgatttggagacccttccgtgctctgttcctctgcaatgtgtcgagcttgaactcgtcgttgttggatctgagggctcgaagatttagttgcgtcaagaaagactttgcagcgactttgcaacctgaaagctcatgtttttcttgacttctcgatcggacaccaggtagtccttgttggtgaagtacgctaaatgtttcacgccttgcaggcctcgagttcagccttcatgtgttgtaaaaccttgcagttcgttagggagtgattggttgtcttgtgaatgacacatcaagctgtagatctctaaggagttgtcctcgtgggtacttgattcctagtggataggtgggttttggccgcctgaggtcttctcccatatgttgtcatagtcggcagtctctcttctatcgggataggaagaacagccggagtgttgtcatttcttatagtcgtcgctgcgctgttctcgttcccgacagaaacggcggtcgcgtgcaccagcgctgcctccactcctcaacttctacggcatgggcaccacgacagttgatatcaactttgacacttctgatgaatttgttccgagatgggcggagttaagcagctcattgaaaccagataggccagcatctttaaggatccacacatagacaagaaactcgagatatctgaggtttgacatgacagccttttcttcactaaacatgataccatgcagatcaaaccggacatagcaaaagggtgtgttgaaaactctcaacttttgaaagtagccaccgttaggagtcttcgtgctgcttactatacctttgtattttgtatacatattcgaaggtaacgtagctctggtaaccccccccccccccccaaagggcttcaatgtcctgcccgtccaaaacatttattttcaattcgagatatgagaggtttggaagaagcgacaacttaatcaccacaggcattatatgaaacgtcaaggacgtcaaacacaaatatcggatgagttgacaggaagcgaatcctgcttcccacatgacgccttaagaccctgtttagatgggactaaaactttccctatcatatcggatgtttggacactaattataaatattaaacgtagactattaataaaacctatccataatcttggactaattcacgagacgaatctattgagcctaattaatccatgattagcctatgtgatgctacagtaaacattttctaattatggattaattaggcttaaaaattttgtctcgcgaattagctttcatttatataattagttttgtaagtagtatatatttaatactctaaattagtgtctactccctggatccaaacaccaccttactttcatcacgatcgtccaaaatcttcacggtctggatcttgtgaagattgcatagggaatccaaaaatgcagatgtctcatcctgtccatgaagacaaagatggttaattcgaaggatccttagttccctcagcttgccaagcaacttcacaaacagcaatgtatcaccaccgtaagaatacaccgacaactcctatagagatgtcactgggactgttatgaaaatagatacacaacggagacaaaaatttaacgtggaaaacccttacgggaaaaaaccacggatgtcgaccagcaatgatcgtgataggggagttggatacaaacgtaggagatacattgggctgtcgcaccctccctatgcggcttacaagggatatataactaggagccctaatagacaaagactcgaagtcctaatagaaaactaatcctataatgagcatcttttccatccttgaggaggtaccatgaggtacgaggtaccaatctaatctaaccgttgatttaacagaggtatgattgggctaacaaaaattaggtctctcttccacactgtcgtcgcccatcgagcccaccgccaccgtcgtcgcccatccatgccgctgtcgggcaccccaacaccgtcggccatcgaccgccgccgccgtcgcgcatcgagcccgtcgctgccgtcgagcatccagccgccgccgtcacgcatcgagcccttcgccgtcgtcgcccatcgaggttgccgccatcgtcacgcgtcacgcatccagccgccgttgtcgcccatcaaggttgccgccgccgtcacatgtcacgcatccagccgccaccgtcgcgcatccagccctccgccgccgccgccgccgtcacgcatcgtggccgccgccgtcagccatcgagcccgccacgcattgagcccaccgagttgctgtcacgcctctcgccggtctcgccgcaaatcctcaatctcactgctctccccgatttttccccgtcaaacagtaaaggacagaaatacctttccaccaatgatactgcttgaaagaggaggtgcagtaccatgaggtacggacgatttctgaccgttggatgatgctagatcaacgatcaggatttggtactgcacaacctcaaggacagtaaaaaacctctcctataatacaaagtactattagaaaactaatccgaatatactgtgggcctaaaattcggatcacatatttaactggaactataggcctggggatgtcgttgaccgtgtacctgctacgccttgcagccacctccaccaagagcctcctgttcatcttctggatgtcaccggcgatcttgcggcgagcgttgctctgctcgaacagtttcctaaccttcttcctaagccgtcggagcatgtgcgggacagccactggttccatggcgtcgacgcgcacaaggaaggtccatgtcgtacgacgcctccctgaggtcgtgcgcccacagctcgacagtcccgtcgagctgctccggtggcacctcgccgaccatgcggaggacggcgtgcacatcctcgagctcacgtgagagagactggatcttcttccttatgcccgtgtgcaggtcgtactcgtccttgagcatctggccgagcttggggagcagcctacccatcgccttcatcagatccatgattgcaattgcaagcagagctagcaggttaagctgatgttaattagaaacaacatatgatgagctgccaagcgtaaattgttctttatttgtgtgaaaactgtcatttatatatccgaacgaccaactataaatgaaaagctgaaattttttatctcaagtctctgacaactcccaactagctagattaatacagcagttcaccttcctgcccagtgacaaaactttcagttggaacttggaagcccacaagccccaactcccatgtactgataaccagggtttaatgtttcggtttgctgatttgtatcaggggtggccgaaaatttaaaaatttcggtccgaagatttagaaatttcggtctgaaaatttatgaatttttaaataaaatttgactgaatttaaacaaaatattaccaaattcacgagaaatgaaaaaaataaaaatttcggctgaaattatatcgtatcgggcggtccgatagaaccgaaatttccatccgaaattgtgaaccctgctgataacaatattcagaaattccaggccttacagctacatatccgaacacattcatatcaagaaatcattccaaattttaaccaaaagacctacttttttttgccaaggtgatttaatggttgccaaggcgcagagcggcgggggtggagctactgcaactacaaggacagattgggatggaggggatcgatcattgaggacataatcaggagatggaaccacggaaagtgaaagagggtggtatgcctgcttggttactccggggtccgggctttcccttcactttttttttttttacagattgattcctttgcagaacaaaaagaaatcatgcagaccgtttatcaacacgttttccacggatgagtgactttttgtcacaaggagtgacgtcttctcggtgtgcaaccaacatgtttaaactttgataatcaaaactttttgaataattattccaaaataaactttttgaataatttcggttcaacattttaaaatggtattgttaaatttgtcttaaaaaaatagtataactttggctatgtatcttgacatttctttatccatgtatataaaggtaaaagttgttatattttagaatgatggagcagtaataaataatataacatatctagcttactgtgtcaatatttaaaacatgactgatttggggtccattgagagtactgtactgtttcaatcatttgtaaggctatgtttagatctaggtgtgaaaagttttgacgtatcacatcggatatatggatagatatttgaagtattaaatatagactaataacaaaactaattacagaatccgcctgtaaactgtgggacgaatttattaagcctaattaatccattattagcaaatgtttactatagcaacacattgtcagatcatggagcaattaagcttaaacgattcgtctcgtaatttacacgcaatctgtgtaattagttgtttttgtctatatttaatactccatacatgtgtttaaatattcaatgtgatagggtaaaaaattttgccagtagatctaaacatgccctaacaccctatcatgctgtcggtgactcggttcagtcattgcagaaaaagcttgtcatgccctcaataattgcctggaatttacccaccggcaggaagagctgttcacacttcacatcacacttgacccatgcaacaagttgataaaaaaattaaattcatccgcaaggatcctcagaaggagggattggaaggtcctctctcgcgtcgccctccctaggcggcacgagcggcgacgcctcgtcgccaccttcctccccgcctccctcctcgtcttgcctcgccgccgcctgagcgggcgtcggcaaagccacgcggccatgaaggatggcggaggcggagcctcgtctcgcccatcccacgctcggcggccgggggaggctgtctagggcagcggcgatggtggctagatccgggccgagtctggctggatctggctggggagtggcttgcggcgggggctgtagtagcagtggcgacacctggtggcgaatatggcggcgacggcagcggagccccgtccaaatccacaccaccccggccggatctgggcgggtggtgactgacggcggggatgagtggtggtggcggtggtaggcgaccgtggtggccgtggctgtgaagtttcggtggcaggccgtcgcggaggcagcaagtggcggcggggtaggaggcatgggcatcggagcggtggagggcaacggtgttgctgaaaaacacgaggcctgggagatctgcttaactccagtgcaggtccaaactcgccttcgggtatgctagcgtgccagttgatttgatcctgcaatcaacaagaaataacgacaaaggaaccgtggttaaatccataaacaatagccgatcggctaaggggctgatgacatatcatttatctttgagccgatgacatatgtaggtcgatcggcggtcataaacaagtaaaaagggactaaatctactcaatcggctgtagatattaacaatatgtattccttatatcgatatatacttaaatcaagtgattgggatagatcggtcgccatgccgagacagtataaatcacttagattgaaatatatattaataataggaatagatatgttcatagcatagccgattagatagatctagcgtgtatcggctaatactccgatacaactctatattaagatattaaagcaagtagaatatatcaaacaaaagtctaatatacttaaatgctacaagatcttaatataaagggcagatttaacatgtcagtaaagcatataaagcaaatatagttaaatcaggtaagatcggctgaaaccccgatactaccctaatcggcatccaagaagcagactagagattgagattctaatcacgactcataagatcaaacaactgatgcagctaaaagtatgaaaagaaggacaatatctaaacaatcaagccattggaagtttcatagagtggtggataacatatataatctaagccaacatcgatatttaaccttatcggctggcctctatcaatagatgctagccgattgtaggttagatagcgatattgtcagagattatataagatatatgataactcgacgaattacataaacaagattagagtatcataaagatggaagcactaatcccgagaatgcaagccgtcataacaagttttacctcttgttgaagatcgaaaccgatgcagctcaacccgaaagcaagaactcgtcgaaataaaactaaagcaaaaagggtggcgatgcgccgagattgtattgaacgtgtgtgttaattgattacatggggttcggggtctatttatacccaaaaattacaaactacgtccatatcggacacgactcttatctctaacaaactctaagataccataagtctttgcggcagacttttgcccaaacatatctctaaggaaattatataaaatatcctaattaatagatacaattgccttttcaggactctatccatgcgtggcaatcatcttgaagcatatcaactcaacccgatgtcgtacaccaagtcgtgatgtcggaatcggctgtatcacttaacccagtctgactcggacttagccgattccaatcgtagccgatccggactccagccgattcctactctgtttccgtaaagatcttcatctttgatttcgcttcaatctaatcttcatctccgatgctgatattaccaaattttgtcattgacaaacggctcgcagcaagggcgagcgtccaggtggcggcggaggccgacgtgggcatgtaggcggcaatggaggccgatgaggggcgaccgacgcgtgcaggggcggcggaggacggcaaggcacagccggcacatgcaggcaacggtggaggacgacaaggcagcgcgtgcaggtggcagcggaggctgccggctgtgccacagtggtcgtgaaagttggcacggcacgaggaggtgtggtcggtgacggcggaagccagtacggcgcaaggaggcacgacaggtggtggcagtggcttgccagctatccggtggcggcgagtgggaggcctacatggaggcagtggaggctggccaactaggggcgttggtgcagcgatgttcacgtactgacggtgaagggttggtagttggagcaatggagaacagcttttgatcagcaggcggtggacgacgggtgaaaaccaagcccggccttggccgggccggcaatggtggcgttcgagcctcctgagggcgttgccgtgccgtctcaccccctctagtgtggctgccgggtgaaagccagtcttggttctctttaagaccttgatagacggcggcggcggttctttcgtcgctactttccttggagacgtcttctaggcacccccttgccaaaacctcccaagcaatgggtgcaatctcgcactagagtcttatcctcttgtgtcggcgtcctagcttccgcaagttggccacgtcgaagggcctaggggggagagcggttccattattctctctcatgctctctccctcattcccaagtatttggatagagcatagttatgtgttagtggtaagggttgggttttgagcgatctcggatgttttccgttgttggcttagcgccggtcggtcccgcttggcggcgaccggtctggggctagccttctcctgggtctgtgtgttggcgttgtcagtgtgtagatggtggtatactttttttttttctgattacgacctcctagggttgtaatcttgtatttttctcctgctatacaatagaatttcgcactgtctagtgcgagtctaaaaaaaagggactggaaaccccttcctacagcatgcaaaacaaagcatggattaacgaataactaattatgtaaatattcgctttaaaattataaaatagattaatgtgattatttaaaacaaatttatattaaaaatatatcgtttaacggttcgaaaagcgtatgtgtagaaaacaagagagtcgagattggaaagatagagtaaagagcacactctaactggggagtagaggtatatatataaatagacatgttgcaaattgtacagtaaccgtgctaactagtctggtaccatttcattctgttcaaaaaatagtctggtaccatttctagggacacattttaatcaagactgcgcagcaatcgtgccaactagccatcaatcggaaataagattgagcttacaagtacattttattacaggttgcagagtaaaatttgcggtgttctcaaataaaatggaagtcaaaatggtgttctgatcaggattacatcaaatgttcttcggctcgatctgcagtgcagcggctccctgttctgctcaagacagtactgagactcctgtgctaccactttgacaatcttgactcaaaacaacatggtagaatttcttcagacctagagatggtattgcagaagaggcgttgaaccaaattaatgggattcacagtaaccaactagggattagaatcagataggcaacctggggtgcatacctgttggtgttggccagacaacaccatcttatcttcaccatattttaccagttcaagtgtcgggcggtttgcgtggaagtcgactgcatatctcgcagccgcctctgctttctccacctcctcaagacatgcattttcacagttgatggagacactgaatttctttacgcatggattacgctggagcatctgtccgaggacaaaacgaagatcgtcgtcctttctctcatgcgcattgagattttcgacaacaactttaggaaagaagctgctaggctgggaaggagaagcaagtggccatcaagaaagaagaagaaaactaattaatatagagaagaatagatgatacacagctcaatcaccaaaaatgggagccagcggtcactgaaagttccaagaagtgttttataaatataatgttcttttactaacggtataaacgaatttaaaccggtatttatttatactgccacaccaagtactagtcgaatactctttttctaccagtactagaagtcataaaccaacagttgagacgtcttgtactgttgataataatagtagtgcgtagtataacagtaccaatagagaccatcggaaaaagtccgattgattaatcagcccatcatttcgcttattcgtggaataagtcaaacgctatatttgcaaaggaaaaataatatgtgcataaaacgtttatataagtgttcttagcgatctaaaaacagaggctaattaaaataaatttcaatgaaaaaacctcgaaataagctctaattttaaacttaaaaatttaaattttagctgataagtataaacataaacgaaaagatgaggcccatttgtgtgagcgtacctcctcgtgagggggaagcatttctccctccgaaaacttatggatttgaagggttggacggttgggatggatggcggctgcgtgtgccaacgccgcctccgcttcctcgacttccatggcacgagcaccacgacattggatgttaacttggacttgttggagcgaacttcttccaagatgagcgaagctaaacagcttgtcaaatccaagtatgtcggtatcttttaggatccgcacataaacacaaaaactgagagttttgacgtttggcatgacagctttttcgtctttgctgcacatgatgccatgctgatcaaaccggacatacaagtagggtgtgttcaaaaatctcaactcttggaagcaggcatcaccagcaccggcaatcttcccgatgcttactatcctgtcgcagtgtataaacagatggaggtatcgtagttttggtaacctcccaagggtttcaaggtctagctcttccaaaaaattcactctcaattcaagataagagaggtttggaagaagcgaccaattaatccactctggcattctatgaaacctcaaagacaccaagcagaggtatcggaggcattgaggggaagtgaatcctgcatcccacgtgacaccctcatttggattaagatttaggtcatgtccaaagtttggatcttgtgcagattgcatagggactccagcagtgctgatgtctcgccctgtccatcaagcttaaggtttttagcatgcagcaccctcagttccctcagcttgcctaggaccttcacgaactggaacgtatcatcactataaggccacaaatacagctcctgtaaggacgtcagcttctcgatcacaccaggcgacacccttacatcaatatcaacacgtagggacagcaattttgttagcaggcccactgactctggcagctcgtgtatgttagattccttcagatgaagtacttgtagaaacctcaaatttctgaattgctctatgagaggaatagaatcaatacaatctagatggaggaacctaaggtgaagtaaatttctaacatgctgcaggttaattttaccatcaatgttccaccaacggccttgcttttgtatttctagtacacgtaaaacttggaagctcggtaattgcatgttcttatcaaagcactcagtcataataagggaccttgtttgcttcacacccatattagccaactgattcctgttctcttcaaaactccaatgttgtagagctaatctacgggcatttttccatgaaagttcatgttccttactgccatctactacagtgacaaagttttcttcacctgacaataagaggatcagatcaagtaccatgtcatg

SEQ ID NO: 29201 - DNA, 982 bp, Oryza sativa
ccctcaatgactacaaaacacctggtacatatatccacacaacaatgaaagggaatagagttagtaattaaaactagtggaagaacatgtaaaagcaagcagaacacaacaaccgcagaaaaccatcaaccatattacagtagcatgagattttgttatatatataaacagaagtagtaaggaggaacgacatgaatctgcatcaaactgtagcatgcaataatttggagaaagttaattgttattgcattctctaccaataggcgccaaaggtttggtgattatattcctacctctttttttggaggaattcctggagtttgttgatgagttgcctttcgtccagcagctttagatttaagtcattgtatgactgcttgtcaagatccatgagaatatccctaaaaactttcctaatattaggattctgaccgaccggaatgaaagccccagaatcaaaacttggtttaagcttgtcgtagactgctttggcaagagtggtcttgccaagtcctccaaacccaaagatggataccatcttcggttttctaacggacacatcgatttcgatcttcctcttcttggtcggcaaatcaatatccaacatcttcatgagctcatccatgggcccctcaattccaacaagctctgccaatgttttgtacatactcaagagacgaggatcgacagttgctgggcctgcaggattgatggcaatattgtcgattgtgtacctcgcatgcctggtagccacctcctggagcttctcatcgatttctttcattgcgacaccgatttcatggctagccttgatcttgttgaactggttggtcatcttctccaagaaccatttgaaccagtgaacttcacttgcctcatggccgtcgacgcgcacaaggaaggagtcgatgatgtcctccatgtcatacgacgcctccctaaggtcgtgcgcccaaagcctcaactcatcgtcaagatgctc

SEQ ID NO: 29202 - DNA, 1019 bp, Oryza sativa
gtattttgcattgaaattaggtatgtccatgagacatgttaacaactcacttactccgtcccaaaaatgccaacctatgctagtataacaaatatgtccagatttattatattaataggggttaatgtgtttaggttggaagcactcaagatagatttaaatatcgagttttaaaatttcatgccaaaaatcataataaaaagttagaaaatattttctaacattgataacggtgtcatctgtgggtctacaaaattgcagcctaaatatatagcctatagaaaacaaaaatgttaggcatgagggagctgagttaaccattttcaatagtatatataagggtaaaataagaaaaaaattaatttaaggtgttcgatccaatgaaatagttagtttgaatagttagtttgagtggacttttttctttaagaaaatagttctatatttaataattctaagaaaattgggttgtcactaatttatgaaagtcctggaagcatcgaaggacctcattcttatgcttaagcatataaatccaagtcatacgagtatgacaatcaataaagatgacaaaccacttgaaaccactcacagaagtaacagggtatggtccccaaacatcagaatgtattaatatgaatggttcatagctatgaaggccaagcccaacatatgtagagcgagtatgtttaccaagctcacaagtatcacacaccagtctatgcatatccactctactaaagaggtctggatacaacttactcaaaaccccaaagatggatgtcctaactaacaatgaagcaaaccgatctccttctaaacatctccaaccaccgcagctagtaccagttcctcatgattgatgtaccacaacccatcacgcctgactccagtcccaatcctcctcccagtcccttctcctagaacagacaagaattctcatcaaatacaacaatgcacttgagttgatcaatagccgaacaaaccgagagaaggttaactggaaaggaaggaacatg

SEQ ID NO: 29203 - DNA, 1137 bp, Oryza sativa
gaggatcacagtgatcaagatttgtccataactgctgcaactcactagcataactgttaaatttgttgtattccatgtcctccatgcttggctctccttatcagagggctcttcacaaccctcttgcaaaaaatgatccaccccttttgctctcaacattatgagctctcctacaccaactcaaataatttttgctcccttccaacctcaactcacttggcatcacttctagtttcagtttagaccctcctgctacattcctctgacctatcatgcccatcttcaacaaatcctctagcaaatccttcatatcacccttagtgataagtgaggaagcatctacaacctcctttccaaccactgaagacatttctttcttctccttctctcctctcttcagcaagcagcaccaaatttactagcagcaagcagcaaccatacacaacaacaagatcccaatctactagcagcaaccacacacaacagcaaaatcccaaatttaccggtgatagtactccttcctcctcctcctcctcttcttaaatcaaccacacaaaatcccaaatctaccggtgatagtactccttcctccttctcctcttcttgctgttctcttccttcttcttcttctcacccttctccctctttttccctccttcttcctctcctcttcttcctgcacgcacgcgcgctgtggacaccgctgcctcacgcacgcgtgcctggccttctgctcgcgtatgacgctgccactctgggcccaacgcctatgccgccgccaaccacctgctccgggcccagcgcggcccatgcacacgcgccgctgctgccgcctcacgcgtacgatgccgctgctctaggcccagccgccttcctcgcgccctcctcctgctctgggcctcaccccgccccacagatcgccggtgagctagggtttggctctaataccatattgtagtttggttttggggcaatttctcagggggcttcaagcctacacaccccttcatcatccttctattcttaaaaaaaaacattttacaagtagaccctcgtatacattacatatttacaccaagagatataataggaaagccttcagatgtgaagtcagatcatagtagctaaaagactatc

SEQ ID NO: 29204 - DNA, 2269 bp, Oryza sativa
ttcctgcagcccatttgttcaaaattttgtcacatgccacagctggtggtcaagtaagacatttgccttcagcattagctattcttgtgtacaaaatttttttcagagtcatcacgagaaagtggctccattttataaaacacaacccacatgtgtggcaatttcaaaaatacgagtagttacaactactctacttccaagcttactatcctgcactgcacatctgattaattcccatgatttcctatcccatatgtcatcaataataacaaagaacctgcacatcacaatgatagcacaagagccataagttagtaactaaaactagtgaatgaacatgtcaacataaggaatgatcaaccatcaacaagaagcccaggggagttccccttaaatgatggaataagaagtggtcattagcgttacatttgtcccatagaattagccaaatgtgtttgtacaatccggtaattgtgcatcgtacttgtgtttcaatttaacaaccagcattaaatgcggcaggcagagcgcctgactggtcgctatgaccggtctgtgaccggccaagtgattgataggacgacggcaacatgcccacttgctgcccgtgtgtcaggcggcgtgtggcatgccacgccccatcccatcgatcatgatgaggagcttttctactcctcatcctatctggtaccggcctaactactccagctgtacccggatttgtattcccgatgcatgcatgcacccaaagtcctcatccattaaatagagaatgacgcgggcgtcccctgtgtcggccggcctgatgtgatgggccctatacagcagccgacgtgcgtgtggcttccaagtcaaggcacaagacacacatttaatgtaaagaatatttttccttttccctaggtagcttttcggacccatgtggtaacctcttgaagtataaaaggaggtccatgcctagtgagaagggagatcccggaggaaaaggcaatctctggaggccaactccagtttatactccagagattcagagactttctaagctcagaaaaatcatcatatataggagtaggatattacgctttgcagcggcccgaacctgtataaactccttttgtctcatcttcttgaggggctcgaccccctctacttcaccattccatccaaatcctcaattctcacctgctgcccccgaccgaactaacaaagggggcctcacagtcccccgcttgaggagttcaccttccgacaactgttgtgcttgtaagaattaaatcattataataagatctcacatgattatattttgatgaaaaattataaattatttttataatatatctaaattacttttagatttcactaaattacttcttagacatataaaaataaattaaataaaacataaaattaatttgcatatattatagaagaaacttaaaacaaaaagaaagtaacttgtcatgacattagaataaatccgttgtgggggtaactatgatatgttgattaaatctaatttctagagacttatgtttttacctccacaatagatttcttttaataccgtaacaagttactttactttttattttaagttacttctataatatatgtaaattactttcaggctttattaaatttacttttatgactaagaagtaatttaatgaaatctaaaagtaatttagatatattataaaagtaatttgtatttttttataaaaatataatcatgtgagatattgttataaagaattaattgttacaaacataatggtgtaatcggatcataaattagatgagtaatttaatagaaaattccataagaagaaaaaatacatgcacttttgggtgtacaagtaacaatagatatgagattgaggtagctggttataacaatacagagaacggtctcgttgtagacacgtccttgcgagtgagaattgaggagacggagtctaggaaagagaggctttccgctcactgcaactacctcctttttcattgtcacaactacgacaaaaactatggaaacatagagaggcaactcagaattaatttattttttaaaacttcatctattcttttgaacctcaaaaaagatagggagcttatgctttcattaagtaaaagagagttgaccaatagagaaaaaatgggtccaaaaaacttacaactacgcagcatacaactggtgaaaatcagtaaaaacccatgcatagaagcaaagaactaaaaatttcggcgtcacgactactgaatttca

SEQ ID NO: 29205 - DNA, 5454 bp, Oryza sativa
tatatgagaaaaaaaagttaaataagaagtactctctcattccctaaatatttgacaccgttgacttttttaaacatgtttgaccgttcattttattcaaaaacttttgtgaaatgtgtaaaactatatgtataaaaaaagtatatttaacaataaatcaaatgatatgaaaaaaattaataattattttttcctaatcggccacctctaatatatctgtccttttggtccctcctctttatttaaacaaataattttccttattatccaactacagagaatcctacttatgcaaaaagcttgccaagccccaataattacccagaatttctgctccacttggccaaaagcatactaaaagaaagcactccctccgttctaaaataagtgactaactttatcatgtatagtctaaattacaaggaaagctgagaggtaaatgataccccttattaaatgagggatgtatatgtgtgagagggtagttggaggtaagatatatgagaaaaaaagttaaataagaagtactctctcattccctaaatatttgacaccgttgacttttttaaacatatttgatcgttcattttattcaaaaacttttgtgaatgtgtaaaactatatgtatacataaaaatatatttaacaatgaatcaaatgatatgaaaaaaattaataattacttaaattttttaaataagacgaatggtcaaacacgtactaaaaagtaacggtgtcaaaacattttgaaacggagggagtatatatacttctattcattatcttaaaaaaatatatacttgtgaaaaaggaaagattcagttattacggtatgcaaaattccccaccttgtcatttggcgtgctttctgcttccgccttcgacgtcacatatcacgatgcgcttgcgagactgaacaaattaagctggagtactatattatcatgttgtttgcttgacgagatcagatagatgcaccgcttcatcgatctgtttcgatgaatcgcgcgccgatcgagacgttgcccgatctccctcgtgtgcaaatttcagctcaagcactgcaaatccagtttgcgaattgcctgaaaaatttgcaaattgagctcaaacactccgtgtatagttcttcaaattgatttgcgctggcacgtaagatgtttatattccccagcccgcttcgtcgttcatttgacgtattccttgctcccgcctccgacgccaccgtacatcgcacggttgttgatgtaccggatgcatgaatggcttggtcgctctccctctctccatttcaacccaactgcgtgaactaaacttaatttgagcgcgtcagatatcaagctcctacttgatatcgagccggttagcggcaaggcgttggcgtggtggccgcgcgttgaaggtgtacagttagtggtggccactgttttcagaatgcaacggcaacacgagaaggcagattacaggcacaagtccaaccttgttgggccagcaacggcgatgcctacatacactgctttcccattggggcgtttttacgtgaactttctcaaccatgccacctggatacaagaacttctccgaggaattacttgcatgtttcctcgtcgatcggctggatgactacttcgctagaaagaacaagatacatgacaagcgcgtgaaaccaatcctggagttggtaaaaaaaaccaatcctggagttggtaaaaaaaaccaatcctggagttggtaaaaaaaaccaatcctggaggagcagagaggatttgcaaggagtacaaggaggaaggctatgccgagtactggatcaccgacgacgaggacgaagcagccactcgagctccggcgccgggacggaggaggggtcgacgaggggtcatgaataagaagcataccggaggaactaagaatctttaagtgaataatagaacaaagtttagagatatctgtgcactcgatgcaggtttgagagcttcttatgtagtactcccttgcattttaatgtatgatgtcattgatttttttatcaacatttgaccattcatcttatttaaaaattttatgtaattatcatttattttattgtgatttgatttattatcaaatgttctttaagcatgacataaatatttttatatttgcacaaaattttgaataaaacgaatggtcaaacgttggtaaaaaaatcaatggtgtcatatatcaaaatacggagggagtaacaaacatctggtgatcatctagttaaaaggtagcccgcatctcccaagtgttgttttcgttgtgctatgttggatggttagctagtataactaagtgcagtagttaagtgcttttacggttcttgagagttccgatactttatagtgtaaaatttggtatctaccgagagatactaaatttgcgctcaaaattttggcacttcttaatatctcttaggaactataaatatttcgcagtagttaattcaatttgcgctcaaaattttggcacttcttaatatctcctagtaactataaaatctttcgagtagttaaatctctaatcattgagaaaatttaatttgtgcccttaaaaatttgctcaatcccttatgtgtccatcaaattttgcctcatatcttacacgccatcgagttttcatcttgatcttctctgtactcattttgctggttgaccagcaatttttttttcaaaatgtaacatgatctaagttgaaaaaagtcattgtaaaaagcaaaggggatagaattatttaaccacaaatttgaaaaaaaacacaaaattgttaaataaatttcagatcaaccttgatgaacttcgttgaacattttcaacaaaatttaaacctaaataataaatttaaacttcgctgaaacaatttggtaccgtgaggtacggtatctcgagatactttttgatgtactggggcatatctcttccctacactaactaatgccaacacatcatgattaatcatcatatctttctaacgcttcctcctcctgacaggttcttcttcacggcgactccattgcggaaccttctccggctaggggagcagcaactcgagcaggaactttattgtctttgtcgtcgtcgtcgtcgtcgatgtcgacctcgtactcggcatagcctttggtgaagtactgcctgaggatcccctcccgttcaccccggatttcgttctgcatctttatccaaaaagccttgtcctcttctcggctgtcgtcgatcgccttgagttcatcgatgtagtcttgaggacaattcgcgaggtcgtcgccgaggatctcaatgatactcggcatgttgtcgtagtcgggcatctcctcttccttgtacgtgatgcagttgttgatctgcgcttgggtaaaccgcaccatcttcgtcttcgccttcttcttcttcttcttcttctccatcaccggcgccttgccttcatcggaggtaaccggcgccggcgccggaatttgtccgtcactttttttccccgagggagcttcatcggaaggatccatcgttgtcgatggaatttggctttgatcacatgttcccttggatgtgctcgccattgtatttcacatgttcccttggatataggctcttaatttttatggaagcaccgggtcgatcagaaataggtaggattcgggatcacctcgtagttcaggttcagcaggagtccatgagatgcgcgactcatgttcgactctgactcttcttctttcatggtggatttgccgtacgtagttcgtgcgtacggatccggccctatggcagccagcacgcgcggccgtcgtggttgacgccagcggcgccgggacgctcgagctcgctcctaacggagatgactaacccatctctctcgtttttcgtgcgcacgcttttcaaatttctaaacggcgtgatttatacaaaaagtttatatatgaaagttgttttagaaaaacatattaatccaatttttttaaaaaagttaatgcttaattaatcatacaataatataagcttcgttctgcgtgtcgggaggagtcccgaaggtaatttgacatgctgccatgcatatgcaccaactacaaatttagctagtagatccgggtcctcctgtgcacgcgcgcttgtctaccgcgtcgtgcggtggtgtggcggcggtgcgacgcgcgcagccggaagcgcggcgatgcacgcggcgcgaatgtcgtcggtgccgtggtcggtgccgagcgcgcccgcctgcgccgagggccacttcacccatatcctacgccgataattgctcggctatttatagtgtagtcttaaaactactcaaagtgataaaatatttttaaaaacaacctattaagtagcattttattcttgtcattttaatgggtggcgttttgtcgaaaccacgtgaaaaaagagtgccatattgtcctttttctccaatgtttggtatgccgggcagccgggcacactcacagtcacagacggcatcgaatccggaacctattcggttcggagtcggatacaaaacaaacgggtccgacgattcgcggaagcgattccgaaaccgagttattgttggagttgcgcttgcgctgcctatatatattccggcatctacccgaacccgataactctatcgcaatcgggtcttgggcctcaatcgagaggagactcaggggaacaattcatcaggggcgcagctggccttgccttcgtgggcttaggattagatgccgcaccttttttcattcagatgttgtgatctgatgcgatgttgtatcattattatcatacaaatgacttagctctttcggttcggtttcaatggtgacggaatttcaggcgtcggggtgatggatttctccaagatagaatttagtgaggcgaagcggattttggcggcggcgctactaacctccgacgacgaagatagcaagcctccgacgacgatggagaagaggaagacgaagatggtgcgctttacccaacagcagatcaagaactgcatggcgttcagtgcggacatatccgacgacgacgacgaggaatccctgcccaagctctcggaggtgctcagcaaggatatcctcgatcgggtgccgcccgaggttcttgacagcttgatagagttcgagaacacccggggagagcgcaaggctagatgggagaagctacgggacgatcttcatgaggaacgggatgctatcctcaaacaatactacacgaaaggctacgccgagtacgaggtctatgatgacgaagatgatgatgaagatgaagataataaagttcctgctcgagttgctccccctggccgccgcagaaggttccgcaatggggtagccgtgaagaagaatcggtcaggaggaaacattagaaagatataagctgaatgatcatgttcagtgttggtccatatccatcttagttgtagtgtagggggaattatagtttctccttc

SEQ ID NO: 29206 - DNA, 1156 bp, Oryza sativa
gattccaatggactaaactttttgacattgtcatatgagaatggcaccctgttaccatctgtttctccaaatgccaatgcaactaggatcaacaccggaaatgaatgagtcaggcaggcagtgtgcttgagacaatcagacataatattttcagtttagcttcgcatacattgagttggttcccccataattaatataccaggtcttagttggtccccatagagtagttatcacttactggtatggtgcccgtgcgttgcgatgggacaataaaaatatatgcacacggggtaaaattatgttaaatagtttgagagtacgtatattgtacacgatccctatcacatatctcccctataaatacattgccattgtcataaatcatcaccaattcacgacaaacaggatcgcgattgccctttttctttcctgttcacttccttttgaaagcaaaacacaaggaaccatgatcagctccaagaagcaagctcagtttcctaataagtggcactgaatgggtgccatcaactccattgctgactacttatgttcacttgtaacaatcttctggacaccataaaaaatcatgacatagtcaacaatcttctgttcaccaattcacgacaaacaggactttatcttatcatacgaggacgatgaacttgagacatttgacgaggatatgctcatgtaccaggcaatgatccggcaacagattgagaattttggctatggtttcctccatagctggagggaagttatccacactgatagtgaagatcgaagaagatgaccccgtgtccgatgatgatgaggaggaggaagatgacttcttcaccaatgatgatgatgaccagcaaaatgacgaccaaatggctaagagtatatatcattggttacttctatactataagtaaacaggtgggtgctttcatttgaatacgaataattagacatagctacattatctgcttctatcgttcgtgtcctccaaagaactgatcagaatagtagtagcacacgctgagttgcaggtaatttcaggaaggaaaaaaaaaaaccttgggtcagaccaccgttgtcactgtggggtaaactccagaagacagagaaagctaaagatatgtcctaggtatgttttctctaggaaactagt

SEQ ID NO: 29207 - DNA, 337 bp, Oryza sativa
ttgggtagcaccatcttatcttcaccatatctcaccagttcaagagtgggacaattgggatggacatcgactgcatatcttgcagccgcctctgcttcctcaacctcctcaagactagcattctcgcagtttatggagacacagaatttctcgacgcgtggattcatcaacagccatcggagtccaaatggtctccgtcgttctttcgcagattgacatcacatctatcaactttaggattggtgctgcttggctaagaacaaggaattaagatgaaatggacaggtaagccaagccatgaaaaaaaaaaaaaagaaacaagtaactaagctagaag

SEQ ID NO: 29208 - DNA, 818 bp, Oryza sativa
  unsure (1)..(818): unsure at all n locations
nnnnnnnnnnnnnnnnnnnnnnnnnnnnnnnnnnnnnnnnnnnnnnnaaaccagatttcgattgtggggcttttgttccggtcggtcggaatcctgacatgaaaaaagttttaagggacattctgattgatcttgacaagcaaaactatatgcattcaaatacaacgacgacattggatgaaaggcagctcatcaacggaatcaaggatctagtcgagaaaaagaggtgctgatatataattatatattcagttattcaatcaggtcgcaaagattggtgtgattgttagttttggtagctttagtatgcttactttatgcctaactagtgttatgtacacttgtaataattctactccctccaagtaataattccacaggtaaccttgcaaaaataaaataaaataaaaatccatagatgaccttttgccaaaaatatgttatgctccttccctccgaatttacaatttatacttaatcttgcacaaagaccaaggaggtattgaaatttgaaatgaggataactacgtttattatttctaaatgctagtctaaatggatgtgcctataaaacacaaagtaagactgtttgagtatggaaggaataacacacctaaaacaccttggaatatgaaataaaccctctaaaacaaggttgaaaggatacacacattcactttataagggttagctagaaattatcacattgagagatgaaaaactaccacaccggtaatatctacgcacaacaaaaaaaaaaagattgaagttttgttttactaggaattcgtcatctactcaattttttcattgcattt

SEQ ID NO: 29209 - DNA, 1120 bp, Oryza sativa
tttggccacctttccggccaaagccaactcggcctgctgtttgttgccccagaggaggacaacggggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggtttgaattcatgggt

SEQ ID NO: 29210 - DNA, 496 bp, Oryza sativa
acaaggtggctgagatgcaactctcctcctccacgacgtcttctacaccaagtctgagattacacacacttggtatggcctttgcatccgagtgctttcgtctctggccaccaccgctgcattctttctgtttaatatactactagtctggggaaatcatcatcagcataagctgaatggttacagcagagcagatgtcattgttacatatgtcctctttgttggagccgtcatcctggagactatgtcacttttgagggccatgttctcgagctggacatgtgcactcctggtaaagaagggatcggaaggaagtaatgtgtgtaattttcttgctcacatacccgcctgtctccgccggctggtccgtgcggcatattggaggaggaggcgcagctggtcacgctccatggggcagctcaacctgattcagttgtgcgtgcacagcagggccagccgatgcagcaagattgcgaggtggatgggagaccaggac

SEQ ID NO: 29211 - DNA, 558 bp, Oryza sativa
catttataataactaaatgctatcttaagcatctagtttgtacagttgaacttgtaacaatacatgaatgcataagagttcatatccaagcaccctcttcattgaaacatggtgttttggtgctatctgatattctgattattttcatgttatattgaattgtttataaccattaatgcatactatgaataataataataataatatgatctgacccgaggttatattctgattacaggttgttgatgctagtgcacgtgctctgagaatgatttatcaatcgaaactagctccaaagtttgatgtcaccaataatgagaaaaacatggaatttcttcttacccttttgaacagcgagaatgaaaatgtcacagagcttgctgccaatattatatctcactcttgtgatagcactacagaacaattagcactatgtgctgctggagttccgcagagacttgttaaccattttggaggctccatgaatctacgggatgcttgcttagattctttgactgcaatcataagaaataactgggaagttgcttcaagatttgc

SEQ ID NO: 29212 - DNA, 6644 bp, Oryza sativa
atatatttttttagtatgattttacttaaaatttattaaatatctatgtcgttgtcttaagattttgaaaatccaaatcttatcatccctatatttctaattatatagtttttaaaagtcacaccagttgctaccctttacttctgtcatatgcttctttatttgcttgctcaatctaccactatttctatttattctccctgaaacctttaaaaattgaattttgtagtttttagagtttaatgttttgttgggtttcatttttataatttctagaagtcccgtcaaacgctgccattatactcctctatggcccgtccactgtcttttctctttattgtcattgggattttaaaaataaaacataattatcgttcgggttcattttttactttatagaagtcccgccaaaccgtcagcggctttgccattgtactcctttgtggctcacctgctgccttccttctttattgtcaccaagattttaaaatcgaacatgattatcattgggtttttttattttttgaaagttccgaacctttaaaaattggtccttatagtttttagagtttattgtcttgttgggttttattttttataatttttataagtcccgtcaaacgatgccactatactcctccacgacccatccgccgcctactctttattgtcattgggattctaaaagtcgaacataattatcattagaattcattttttattttttattttctagaagtctcgccaaccgtcagcggctctgcaactacactcctatacaccccgtctgctgcttctccttttgattgccattgagattttaaatatcgaatattattatcaatgggatttatttatttttaatttctagaagtcccagcaaccgccttgcccgttagcttcacggtctgcctgtcgttcctccttttaatcggcattaggattctattttgtgttttattaatagtttttgtatgtcgtatcaaccgccaccactctacttctttatagacctgttacttaatttatctcgtcatgtgttttagatgatctttttttttcaatagtctttattttttatcaccaatttttagttatttattgtattcctaattgaaatcttttttatttttctaatttcataatttattttttttatttttgaatttaagttgtttaaaaattgtattcctacttgaactctcttttagtttttctaattttggatattattttatttttcattctgaattttaattaatcttgtgttgggttcttatatggattcttctttcaatattgcttatttttaattccgaatttcggttaattttaaattgtattcctacttgaactcttcttttttttttgttgctaattttggattttatttttatttttactagcaatagtgcccgtgtgttgcaacgggaaaaacaccgtttgatggtgtgacaccttgaaaacctcaaatctgtaaaaatcaagtataatttgatatattaacaaataggtagaaccgagtctaatttgatcaattagcataggatttaggatttagttttagatttattttttgagcctacttagcagtttatccgacggactttaatttgaaaaatgtgagccacattgtttgatcaaatttgctttcgggccaagccttcccaagccggcccaaacttgggcttgcccatctttggcgagttgagtcaattcgacggcccacaagctgagcagctaagcgcgacctacatatgcggggacggtccgatgcacttccgcggcccattgggcgtagcataatcaatggcggcgacggcccgacgctgggcgaatctaagccgtccgatctaatggacggctccaatcgtccccgcgccgaatgaagcaccgaccggggagaggggcaaaaccctagctcccaaatccctctcatgatcccatttctctccggcgacgagcgagtggaatgacggtggtccggcaagctggtgcgcgcgtgcagcgacgaccgccgagcggctcctgcttcgccggctgggggacgcaaaaccgtgccacgacgtcggcggtccggctaggtgggcgtgcaaacggcgacgagcaccgagcagcctggacctcgtcgacggtaggggtgacgccaagctgacgcttcccgtcttcagcaaaggatggtggaggggtgctccaggacagcgtgcgcgcagggaacccgacacgactgcgaggaggtgaaggtgcggcggtgccgcttcctggaaagctccggtgagctctggggcttcaaatccggtaagtaacccgaacccttaacttaattgatttggatttgactcttatggttcttacccgaaattagagttcttcgaatttagagaattttgtcgggaaatttcaatctattttattccctctttacgagttaggggagtttcaatatcgtttaccctcttttaattttggaaacttcaatctagtttatccctttgctcaatttcgttttttttttgctttggctggcgtttcatcccgcgggtgaggacggagggcaccgctcgtcccctcggaaagattgagattaagataagataagattttcacggacgacggaagtaaattgaatcgaactttcttttatttgttctaatgttttttcgcccttttttcattattacggacaacagaaacattttaaatttttaagtagtagatatagataagatagagatatatagtaccgtgtcaaatataataggattcaattttttttaccgcgtcacatataattctttttttttttggaatcagacatatttgttttttatttctttcgctctttttttaccgcgtccacgcagattcatttttttttgctggtctttttttcacctggtttttttcgcccttttttaggaattggacagattccttttttatttcttttcgccctttttttaccttggaatcgggttcgtttttcttttccttttttttcccttttttgatcggacagatttggtttttctttttttttcacccggtttttttcgtccgtttttttcgcccgttttgttttggatcagacaaatttttttcgcccgtttttttacggacgacgaaagcacctcttatttttgttttggattagactgatttttttcgcccctttttttttacggacgacggaagaacctcttattttaagtagtagagatagagatagagattctgaatattaattaatctcgtattaggttcttatatcgactcttctcttaatattcctgatttttaattccgaatttcagttatttttaaattgtattcctacatggactctccttttcttttctaattttggattttattttatttttattctaaattttgattaatctcgtatcgggtttttatattgactcttctctcaatattgcttatttttaattctgaatttcagctatttttaaattgtatttttacttgaactctcattttctttttctctggttaatatgggaaattttagtcccccacagcgaacgtggtgcctcattttaaagctgtttaataatataatagattgaaaatataactttttttaagattttgcatttatatatatgtatgggaaagatttgcacaaatatatctctttacggcatgatgggcacgcgggagcgctacgtaattgcggcgtagccacgcgagacagtcggctgggtcgttcacgtaagatgagcgtgcggcaccgctttggtcccgtaggccagaattgcggcaccgcgtcaatgctgcggcctgggtgtgcggcaacgtggtggagggcgggaccatgtcggtcccgtggcatccatgcggtaccgccaggggcggacctaggattttgaaattaggtattcgaaatggaaaggggtaaaaaaaaaagttttacaacacaagcataatatttggtatgtatgatcaacagtatgatattttagtactgcttattgaattagaacttgcgtcaagattttcagcaattttcttgatttattgggatatactttatgaaaaaacatatgtagtacaatctaaaaaataaattgggttcagatattcacattaaacacattgggagaatgtagattgaacgggttacctattgaatcgaatcggaactgttcggcgaggcgatttggtaggggcagtagggggtgcagtggtgcaccgcgcgttgtgcggaagcggccgcggcagcgcgaccaacggtgccggaggcgtggggcgggccatatgacgagagagagagagagagggtttgaccgagcgagggaagggcgtccgcgacctgttgagggtgaggcctcgataggcgtcggcacgccgcgggctactccacatctgcgcgtgcacgacggcagcgcggcgttgcgttgatgagcaagacggagggacatgttgcgacttggaagttggaacaaccaacagcgaccagtggtggtctaggttgactttgccccttcttttgggctattgggcctacataatgagaagataagacaggtgggatgagggagccagtgtgctaggctttcttgttaggcttcttttgatcaatagtatttattttctttatttctctgcacagatacaaaatatatttttttaataatggaatgaaataacatccggacctttactcaaaagagttacagccaattattacaaactagcactctgtaagagtgcagtccaaatgaaagcataacacaccaaccaaaattagaattaaaaagaacccaataaagataaaataccattatttcagtgtattggtaaatctccatccatgattgacaaacagttgtataaccgtcgtttcaagcatacgacacacaacaattaggaattcttcatcttcatcatacttttgtaactgtgcccacagacgaagccaatatattgccttgaaaataacctgcatataagtaattgtaggtgatttgtcaaaaaccctatcatttctactcaaccacaaagcccaacacaagacagaagctccaacaagtatcagtttactctttttgtttacaactccctaaagccgatcatcaaaaatatgagatatgctagtaggaatatataaaccaaaagaaaactgaactgctctccaaataaactttgcaaaatgacattcaatgaacaaatgttggatatactcatttttcgtacaaaagcaacatcttaaattaccattcaaatttcgtcttgctaaattatccttggttaacacaactcccttaagcaaataccacataaagatcttgatcttaagcggcatcttaagtttccaaattaacttatttctgtcaatgtaaccattgttaattaaagctaagtacatggatctaactgaaaactggccattctgatgatagtttcatctaaaacagatacgaaatatatacctcatattgtattttttatctaaaaatcttgggtattcatctgaatactcttgaattgagctaggcccgtaccgcagcacagttgcgctgcacagagtaggaatccgcgctgtcaatacaatgctctcaaactttgagcaatcaagcacggtgaaaacgtcactcttttcgttcctctttcttgctcacctcacgccatataagaagaagagagtttgcaccagacgaggtgctcatgccataaaaaagagaagagaagagcttgaggaagagagaagaaatgaagaggtaatggtccaagccaagagggatataagtcgaagaaaatagaggtaaattttagtactttaattattatgaagtatagatttagcgatgatttatgtattagatgaaaatattaagtgttggataagtaataattaatgtagtgtgcatatattacatataaatagtttagttatgtgagaagtttagaatttttaggtactatgtatgttaggactcaagaaatattatagtatgaatgtagtagaaatataaaatggttttagtattatgtttcattatacataagacatgcataaattttattaatatataaaaccgtgtgaaaaattgtatatatgattaaaattttctttagttgtgtgtacgatttttgaacgagtaagagaaatgaggaaaatatatagtatgaataacaaactctatcagttatatagccgttgacctgaatcttattggtttcggttaggcccacaattccatatagaccgaaatagccaacgggtcattttaatctaatctatctgtattttatcttgttagttgtatgatcaaactaactaacacattctgaaatccataggacctatactaaagctaagcagaactcacacgcttccgtctgttcttttagattttacgtcaacaactgcacatcatttgtacaatatttttaacatgcatgtttctatcattttgatagtagcactactacttaagggcaagttctattaattataggtaacaaatacaacatatcacatctaatacacaaacttcaatattggtttattaattctcacatcgtcttatattttcttaaagattgtgtggaggttgcctcttgtatgaggctggcacattctctctcttctaacttctctccttcatatcatc

SEQ ID NO: 29213 - DNA, 1035 bp, Oryza sativa
gagagagaacaggaggagatcggatagaaaggggtagttcagtggaattttggtgaaaataccctaaaaaaattaaagggtagtgtgtcttttggggtggagtggagctgtgaagcaaaaaacccagctccaccccatagtacaattttgtggaacagctctgccaactccgctctcaaaaatggaggatctggactatttgtcacagctccggctctagtaagttggagttgggagctagagctgtgccaaacgggccatagtatcttgagttgggaatggccttagcaagtgtagatgatatgttaatttttttaggtagtagttggttatattataaaacttgctttaatagctacttcactagtcccatagtaagatattttttagttcctgacattgtccgaaataagttcattttaaagtaatcattgtatcgtagtttgtgaaagtagcgaataattgtgttggaagtaaataaagtgagtaatagttgcattagtatctgataaagtagaggtatttttgtatttgtattggtatgtgtaagatgaatgaaaaataaacttattttgaaaacagaggcagtagtagttagctctactattaaactagaacaacttacccttaggctgcgttcttcctccattttcccaacccacctctttcatttttcacacgcacgctttttaaactactaaatggtgtgttttataaaaaaaattctatatgaaagttgttttaaaaaattatattaatctatttttcaaaaaaaattagttgatacttaattaatcatgtgataatatgagcttcgttttgcgtgccggagaacacagccttagtttgttagggtcatttgaatgacagaaaaagaaaaggttgtctttttgtgagcacattgctcgaattgctaaactatatatgttttttagaaaaaatacgaaagttattttagaaattatattagtttgttttttaagtttgaaataatcaatactcaaatattatgagctagttgctcatctcgtttct

SEQ ID NO: 29214 - DNA, 613 bp, Oryza sativa
gaatagctctaaaccgaagtttaaattaacttgtacaaatactaatagacttggggacaagatgttgaggggaggatgctcgcttggtgcattcctcatcgaccggcaagactcgcctgctgatggcactggcacgctagagatgatctgccaggtgtgggcacagatgctgtgctgctgtggggaacaatgcagcacagattctcatgtcaagcagctcagcagtggcggtgagcttgttaccgtcactgcccttgtcgcaaaatacataggtcaagatgttgtcttggcactttcagatagattcacatagcgtttagcgaatggtaaatagtagggtaaaggtgcacacagcagcaaaattttgttgaagatatgtggacaccattaattatgttattggtgaagatggcatgattttaaatgctatttcaagacagctgaggtaatgcacatatgccttaggagtgtgcatacaggtcagtattccttaaactacagtatactgacttaccttatctatacttttttttttcatatgtgtttttaaactatggagggcaaaaagggaaatatttccaataaaacagtgtatttttttttttgttttcat

SEQ ID NO: 29215 - DNA, 2950 bp, Oryza sativa
gagatcttgttgtaaagattaaattgttacgaacacaacggtgtaatcggattgtaaatcgaatgagtaatttaaaagaaaattttatttgaagcatagatgataggaatatttgttctacttgcttgatcaattagtactatagtaaagtaagattcttcgagacatatctggacaacggctgattggatgatagggtcgctcactgtgactaaattgagagcgttctcgatttagattttacgttttatataacacaaatgatatcctaattagggatggtaatgggtttagttggacaccggtagagcagaatcatgtccgacccaatgctcctagctgtcgtctgtcgtcgtcgcgcaaacatggtcacggcggaaacatgcatgattgtaatcaatccctaattcatgatttactgtaattaaaggaagaatcttcccatcgggcgccagatgccaaaaaaataattcggtcggtcaaatgtttcaattaaccaacgagtgaaacatcaagttatatatggtgaaacaaaaaattagcaattgaaatctttaaaaatcctatgaaacatggtgaatacacgttgaaacatgccgctatcacatatgaaactagtgttaatggtttgaaacatatatttttctttcatcgcaatatagtcatgcgatatcttgttgcaaagatttaattacaatgaatacaacggtgtgatcggatattaatttaagagaaaaatattttgaagctcgttaaaatacatgcatgtatgcatggaccaggtgaaaagagaggagagagagtagtggcagtagttttaggaattttgtgaaacacgctcaagacatgcattgaaacatatcattatcgcgtatgtgttaacgaccaaatttggtaagatatgaaccaggttcggcattggaatcaaagtggattcggcaaagagttagattcgaagaacggaatgtgcatcggctggatactgcatcggctgagatggatcagacagaggacagccgatatggccgatacagccgataaggccgattttgctagaggcagttatgaaactgctttaacgtgctacacaaggattgtcatgatggagataagctctcagatagtcaattgtatctattagttaggatattttgaatagtttccttagagatatgtttaggcaagagtcagccgcaaagccttatgtgtatcttagagtttgttagagataagagtcgtgtccggcaaggacatatcatgtatcttgggtataaatatcacccgaacccatgcaatttacaacaacagttcaataaaactttcggcgcatcaccacccttttcactttcgttctatttcgacgagttcttgcttttcgggttaagctgcatcgattacgatcttcaactagaggtaaacttatcatgacggcttgcgttctcaggattagtgcttccatctttatgacactctaatcttggttatataattcgtcgagttatcatatgcgttttgtaatctctattagttgcgctatataacttgtcatcggctggtttgtactattagaaagtagtcgatagagttatgtttcgttattaatctagattatatcgcgtatctatcatctcttagaggttttcatcatcttgcctagattttatatttatctttatgcctaatgctacatcagttgggttcgatctggtgagtaatatccataattgtgatatctggcttggtttatgattatcgagagagatagcatcgggttttcagccgatcttacctgatttagctactttatgttttatatgtttaattgatatgctagatctgtcatttatattaagatcttgtcgcattaaggtatattaggcttcttgtttaatatattttgcttattttaatatcttagtctaaagtagtatcggagtattaaccgatacatgctagatctgtctgatcgtctatataacccctgctttaatgtatatttcgatttaagtgatttatactgtctcggcatggcgaccgatctatcgtaatcacttagtttaaatatacatcgaaggaagggttatatcaatggcggacgcaggattaaaaataagatggggcgaaaatgttcgctttataaagaccgtatttatgccgtaatcgcataaaaatatatttgaggcaaaaaaaccattttataacaaagaaataatatttgcatcatatataaattcatcatacaccaaaaaatgcagtaggacaaataaataatatgcaagtaactgcgcatgctttccattttcacagtagaacagtgttaactaggagtacctactatttccattaacctaaacagatgattaactgatctagacagcaagaacagatcatttgcaagaggaacaaacaaatttgcttggtacttgactacaataaaatggtccaaggaagaggatgatttgattaaaatggtccaactgctactgctgcccctaccggcttacccctgaggtcgctgactcgttggcgccaggcgtctaggcgctagcctgcagcctgctagctgctgttgtgcctgtgctgcggactaccggccaggccagggagcgggacggccggaccaaacgtaaggcgacgacggtgacgggctgacagcgacggcgttgcgttggcacagagcaggaggaggctggaggcgaggaggagacgaggagaagcgagttgctgggcgccggctgcaagcggcatcgggccagtcgttggtcgtcgctaggcgccgggcggtggctaggcgtcaccgtcgcgtgcaccggtggccggtgtggcagtgcgggacggcggtaacgagcgagagtgcaagacggcgtgcggagtcgcggtcctcgcggagacgaagcgttggcgcaacgatgcggtagcgagaaggcgaagtagaggtatggggggtggg

SEQ ID NO: 29216 - DNA, 1076 bp, Oryza sativa
agtatatccctatgagtataaatatgtacaccgggggttattgtaaactatctccacgatcaataacaatcaagcgtatcgccaccttttaccttttctactttattttatcgtccggcgggacttggcacctaatgcgggggttttcgatctctaacgaaggggtaagtccaatgttccactggcccaggcaattgtatcgtctacgtcggcgttgttcaaggctgcatcggtacattcgacctcttggattgctctggtttggttgatatatttgtctggctatttatcatatgtcttaatctagtcttagtatcttaatttagctttatcggttgtctctcgctttagggttactgccggtattggctaaattgttttactatattagattagataaggcatctaccaccctaaaaatcagtcaacggcttgattatctagatattgtgtttctttttatacttagtgctgcataagtcaagtttgatctactaagtcatgtttagaaccataatccctagcctgttttttgaccgccaataaaggtttcatctgggtttcagccgataaagtatctggacgttgcatcggcttacaaggattgcatataagttggatttagccgttcaccgctttaatctattctgtggattttatgatatcggacctctagtcgatatatgctttaaccttcagattatattgttgatttcttgcattatcatcagccgattgtctttatattattatttacatcaagcgtcagaatctacatcagaattatagccgatagctcaaaaccctatcgctatcggttggtatcggcatcggttggaattaatctatcggcttatcagcctatcggctcattgatctactatttatatatcttgtcagttgtagggtcaaacttactggtatgtccgtatctcatcaacttttggtcctgcactggagctgagcagatcttccagcccagtgtgtgtttttcgcatcaacatggtatgatcggataagtaatttaggagaaaaatatttagagagagaagaaaggaatgagaagaaacatttag

SEQ ID NO: 29217 - DNA, 211 bp, Oryza sativa
ctattctactggcatttccagcatccatattccacctcaacatcaatgtctcgagcttttctttctcttgaagttttgccattcttgcatcttcagtgtctgaaaccttttcaaggttcactagtgataggctgtgtttagttcagcgcaaagtttgaaaaatgactaaaaatagagatgatgtgactgaaaagttgtgtgtgtatgacac

SEQ ID NO: 29218 - DNA, 1134 bp, Oryza sativa
aagacctggtatcattctctttcctcatttattctcttgccacatcatctttcattctaagtgttatgtataccatcctagtaattgggtcgggaatggtctaactaaatagtccatcaacagaatagttaacttatcgataacatattacactattaatgcataccttacatttctctctcaacataggttatcggatctcgtgctgtaacttgctacaaatatgaaccccgtatttcctctctcatctcttttttccttcacgtacgcacaaatataacgtgacaacctatatagtccgcttccatcattttattatgtccattttcacctcctctctttttctcttgccatgaacaaatacatatatattataaaaatgtgtagagttaactttgcacgagagtgaacactttacagatgtctattattattctagtcatttgcttaatgcagtcatacgtaagtttgtggagaagaaaagcacctcaacattattttgtccagatttattgtactaggaggtcgtattctcttaggttggcttttttttaatggatggagtaggttagatggttggaaccctggaaagctcctcgataccagtgatgtcacatggaacctcatgttggagtagatctgctttatagggagaagatgcttcacatagggagagataatagtccggtgggttaggatgaaatagttttttactaccgtcctactattttctccaacttaaaatataaaaagctaaaattagatcagatattctttttagtattataaatctagaaagattgtctgtcagtccaaattcgtactactgaaaatctgtccagattcgtagtactagaaaaatgtcatatcttataatacgaattcaatgccaaaaatcaaaaggagaatggtgccacgtggcaacaccggttttgcaggctcgacgaaacgtgcgtccgcgcgtgcagggatcgatgaaatgctcttgcctgcgtgcgtgcgtgtgcaccggtcgtccagaaatttctccccaatccggcgcctttacgtgaatgagacgagatactatgcatacagtgcaaacacgttaatttctcacattcccaccgtagggctggcaaagctcagtcaggc

SEQ ID NO: 29219 - DNA, 726 bp, Oryza sativa
gttttctttttaaagtgttttgtttgttagaatttttctccaaaggcggctgcaatttgtactccttttttgagaaactaattgaaaggtgttgacgtatgcgaatttttatgtatttttctacagtatttttctcagtattgacagctatatgcatgattggatgatgagtctcacatgtggttttaaactcttaatcttcatgctcccattgtctgtatctgcagtcactgtcatcctgacccaagcaaaacaaactaacctagaaaaattatagcacaacccattttatttgtgaataaataatcctacatgacagattgcacttgatagtggctgcagagaagggaatacttcaaatacacatgggtttttttaagctacatgtaaattttctttacaaaatttctacaaacacggatatcagtcgtttgatttatttagatggaagttataccaaatctagatgaactcacacatgcctcgtcagagttagtaagaattcagtaaaaaaaaaaacttgtattcatgtaaggctatgtttagttcaaactaaaattggaacgatgtgataaaaaagttagaagtttgtgtgtatacgaaagttttgatgtgatggaaaagataaaagtttaaaaaattattttggaactaacacggcgtaagtaatccaaattcttgatttcaaggtacagcttcaggtttgatgacaaccatgagcctcct

SEQ ID NO: 29220 - DNA, 7587 bp, Oryza sativa
  unsure (1)..(7587): unsure at all n locations
ttctgccatttgccttctatcccttaatcttttgacattaaatggttcgtgaaaccaaaaaggatgcttccactacagtttggagtacaatacactgagtgtcacatttcctccctccctttttatcctgcatgcaacacatagtttggggtacatgttcttttcagtttcaaaaaaagaagaaaaaaattcagtaggagataatctaaagtaatgaaagaaacaacctttcttgaaaggacattgggctacgcaatgtgaaaaacaatgaccataagatgaatgtttcgatgaaagatggacatctgatcattaacatacatgcggtaaaaaaaaaaatgcactagacacttccctcccgatccttcgagtgtctcccctcagacatgtggcaagcaagaaaaagattactccatgaaaaatagataatgggctattggtttgcatggcaattaattggcatactttaatgggctgcactaattaagatcaattttgagatgtcaaataagtaaaataaacatgaacggttgttgtgaagaaaaataggaatacatattacggtagtactgtatgtaacttacgggctacttcagttgtaacaatcaggaaaaaataccactataactacaaggaaaaaaaacaatcttaagatctttcaacaaagatggcatctcatagtcgcgcgaacacgcgactccgagaggctaatctctatgtgaaatctaaaagtaagttataaaacaattatcaactagccaacagaagggcagtctttttatgactgatacaatagacttacaaagaatgacatcagaattctcacttgggaaaaaaatgataaaagtacgctgtttaaaatgtggtagctattagatgatccatctattacattatagggatttgctattcataactcaactgaaatttttttgcaagaaaaatcagattcctaacctttggatccggcagagattcgtgctccggcgagattcttgactctggcggccgtgcaacaacggcaagagcgccggattaggtttcaggtggggttggggttagggaagggggattttggggagagggtggatccccgggtttagcgggaggccagcgaggcggctgaccggaggtgcgtggtggcgccgccggatccgcgggctggaagcaggcggtgggcggagtaggcagcgggggcaacgagaagtcgagtggttagcaggcgacgcccgtatctgnngnnnnctatnntgcgaagacagggaagggtcggcggcgcgaaggcatcttgccggaactgtaggagacgacgaccggcttcgagcgataagaaaaaaattcccaataatgagggggaagggacaccgggaagangaagggttacgcccagtgggcgggcggcccgggcgtctttcgaaggcaagcttgtctgccgggcggcgttgtggcgacttgctactcgcgagcgaacagacgagggtgacgagagtgttgcagttgcctaaatatgtactccgtcgtatttttacattttgcttacatggtttaatcatttatttattttattaaaaatatttagaattattatttatttttttattcacttttttatccaacgtactttaaacacaattttttgttttttgtgttttatatttgagcaaattttttaataagacgagtgtttgttttttaaattttatatttgaacaatttttttctagtaagacgagtggtcaaacggtgtaaataaaatattaaaaaaatctcttatattttggagtagagagagtatgtactacctccctatcagaatataataatatgggatgggatgagactcatctcagaataatttatctggatatgtttagaataggcctcattttatcctacgtggttatattttgggacggagggagtaagctcgtttttcttgctgcttcttttagtgtgctctaactgctctctctttttcgtcgtcgtgacttttttaagtcaattagtttataggaaaatataggccgagtatatttccaatttttttaaaaaaaactttctacttttttatcacatcaaaactttcctacacacgtaaacgtctaacttttccatcacatcgttccaattttaactaaactttcaatttttgcgtaaactaaacacacccatagtagcttttttaacacaaaacaaatatattatcaaaatatattcaatagcatattagatgttagtaaatttatttacaaatttaatcaaacctaacaaagtttaaatagaaaaaaattaaaataacttataatatgaaacataggaagtagcttatagtctatattgtacttgttgtaattatgcctcgttcttttcagcaaattcaacatgcaactttctttttttaagcacgcttctcaaactattaaatatttgagtagaatttttctacatagaagttccttaaaatcaaataaaacaatttttcaaatctttagtaattaatactcacttaatcatgtgttaataacatgtctcatttcgtaagaaaaaaactaacaggatcaaatttataatggaggtgactaatatttatgtagtctatcaataaattaagaggggtctcgtatgtataataggttgtttctaatacataaccgttaactgctctaacactttcatatttttattgaaacttacgtagagattttcctttgtatgaggggtgtttttttctcttctccatcttaccgttcaggccacgttctaaactctaactattcaacttcctcgttttccataagcgcggttctcagaacgttaaacggtgtatttttttgaaaagaatttatataaaagtttctttaaaatatcaaatgaatctaattttcaaatatttaataattaataattaattaatcatgtgttaattgtttgctctggtttccgtgccggttaaaatctcaattcctatgcagaaacgaacgaagcctagtcctaaatgatacttcctccgtcccaaaatataaacatttttaacacagtgacaagtcaaacatttttaactttgactattaatagcaaaaagataaaaaacatcaatcattttatcattaaacaaactatcataatatacaactttttatttaaaacatattactatatatatatatatatatattgtatattgtattgatcaaagtagtatatcggaaactatgtcagggtctaaaactgcttatattttaggatgaaagaagcatcccgtatcttgtgtttacatgtatcactttatccagcatccacctcatgaactgccaggggcggagccaccgcctggctagcccaggcagcctgcctgagctcgctggcaaaaacttcattaaattttaatattgttgaataaattaatgatgtaatttttattaaaaatgatagttatagtgaagtttgctcgggctaaaaaatatttctacttgcgccactgcgacgcggcaaatttactgtcgtcagcgctgtaagtctgtaacacaactaaccatgtgttctagtagttttgaagtttcaactccctcgttttccagaaatttcaaaatttgccatcgaatacgcacgggtttcaggacatgccatctaattcgcactactttcagaatacatcattgggacgcgaatcttcttcattttacgccactccgtccggcgacgtcagtcctcctcgtcgtccgtccgtctgccgccacctgcgccccgtccatccgccggcgccgccgcgttcttgttcgtccgccggcgccacccacgcgccaccgccctcctcatgctcggcgtcctctgccactcgctgtcgctcatgcagtcatgctcaggtacgcgtcacctccggcgagcacgccatcgtctccggtgacgccgccctcgacctgtcgtgtgcctgcagcatcgtcatgctcatcgcctacctcttcttccaactcaagacgcatcgccagctgtttgagccccaacaggttcgtgattgatcgatccgatgcatgtcctgtacgttcgatccatccaaccaaatggtaatcaggttgaggatgatttagtgatcgctcaagatgatgagccagtactgggatgatgacgatgatgcgcgcgggggcatacgaattggatgccggtgtcgttgaggatgctgacaccggcggaggcgaagttggcgcagacaagcaggttctcgcctcggaggtcggggctcaggtaaggcagcgcgggcatgtgagtcaggaagtcgatcccgtacggcggcgccgctcgcatccgtccgccggcgccgcccgcgtccccgtccgcccgccccgccatcgcccactacccctcttcaccgaatctcgcgcgtctcgccgaggagcaccatcgcgcctccacggggaagatggctgtgtcggcctcctcgacctactcgacgacgacctccaccacgagctcctcaactagggcgattttgtccaggcggcgtgtcgggtgttcgctcgcagtggccgcgttgagcaggccgtcgccgcggcggcggatggacggggactgacgcagctgtcgtcagaggtgccgcggacggacggggacgtgggtgccggcgctggcggatggacaggaacgcggcggcaccgccggatggacggggacgcgggcggcggcaaacggacggacgacgacgaggaccgacgtcgacggacggagtggcgtagaatgaagaaaattcgcgtcccaatggcgtattctgaaagtattgcgaattagatggcatatcctaaaaaccgtgcgtattcgatggcaaattctgaaaattctcctcgttttctatcaagcttccaaaactgctaataaaacgttttgttttcaaaaacctttcatataggcctggtttaattccccaaatttttttccccaaaatatcacatcgaatatttggacacatacatatagggcaaaaaaatatagattaaaaaactaattacaacgttaggggagaaatcacgaaacaaatcttttaagtctaattagtccatgattaggctcaaaagattcgtctcgtcgtttccaagcgagttatgaaattggtttttccattcgtgtccgaaatactctttcaacattcggtcaaacatccgatgtgacactcaaaagttttctttttacgaactaaacagggccatagaaatttcttaaaaatcaaataaacatatttttcaaatagcatccctacaaacactcatagatcgtcacatggtgttctaataaatcttagaaattctaagaaaaatttaagacatttagccatcggttatcatttaatttggtggatccattgttttcaactattagacctattaaaaagttgtgaattcaatttatctctaaacaacaagtacggtatgtatgtcgtcgctgatgtgatgcacgcacttggtattggaataattaactatttaccactcttacaagtggtaattaaatatttgccattagactcacatatcataaaactgcgagtagcaaatttttaattaccacattttaaaagtggaaaaaagttaaattaatgaccacttggtatcgtccccgacacgagcgtaagccacccaagtgactcaaaactgcaagcctagtctaatttgcaaatggatggtaaagatacatgttgcaaactgaaaatatatgcttaggttgggaacccttctcttcgacatgcaaaacgaaactcgtattattacatgattaactgttttttaacaatggattaatataattttttaaaacaacttacatatagaaagttttttataaatcacacaatttagtagtttgaaaagcgtgtgcgcggaaaacgaaagaggtgggttgagaaaagggggaagaacacagccttagtcttggggtctgtttggttggggactaatattgccacacattttttactaaggtagctaagcttagtcttgccacacttttgtggcaaataaaatgacaaattaagcttaggcaatgtttggcaagaaaatatagtgtatgatatgtgggccaggtggctaagagttaggcaaaatagacttgtgacaagaaccaaacactatctattaaaactttggcttgcctaaggttaggtgtagtaaatttagttgccaaccaaacaggcccttagtcttagttcaatgtatcactttggtcactttaaatgctcaaaaagtgaatgttactctaaagagtcttaaaaaaaatttgtccccaaaggagggccgtgctggggccaccccgtgtcagagcaggtacaatagcgggctattagccagctataaacatattttaatgagataaaagatgagagagaagagcagcgggctacagatctgtagccaactacagcacagactccaagacgcaatgtgtatatgacaggtgggaccatatgttaatagtatagtaagcaactattgtatgaattggctattagatcggctatagataatttggagctagtagtgggctatactattaaacttgttctcacgggagcatgacctcgccaaaagcaacttgctagacgtgcctccacggcgtaagagcaggtacaatagcaggctattagccagctgtaaacatattttagtgagataaaagatgagagagatgcgcaacggactacaaatctgtagccagctgcagcgcggactccaaaacgcaatatgtgtatgacaggtggggaaccatatattaatagtatagtaagcaactattatatgaattggctattagattaactataaatgaattagagctaatagtgggctatactattaaacttgctctaaggacatggccaacggtggccataccccatcttggaagtgggcccaaccacacgaggccctcaatcccctaagagcaggtacaatagcaggctataagccagctataaatacattttaagaagataaaagataagagagaaggacagcgagctatagatttgtagccagctatagtatggactccaaagtgcatatgtgtatgacagatgttatcagatattaactatgtagtatatgtttataggtaactattgtatgaattggctattaagttgactatagatgatttagagccggtggttggctacactattaaacttcactggtggagaaatgatctttgctgggtcgacccaaaaccacaataatcccagttccaaaaagaaccgggactaaaaatgatctttagtcccggttgaaaaccccagaggcattgtatgatctttagtcccggttagtaacaccaaccgggactaaaaattatctttagtcccggttcatcccctgtcagattgatgtcagggggccgagcatctttagttccggttggtaacaccaaccggaactaaagatcaccactttagttccggtgggaacaccaaccggacaaaagatcaaaccgatctttactcccggttgaaaacaccaaccggaactaaaattcgaagcgtggtatataatccatatcccttatcctctcctcaacagatcgaatctctcccttctttcccttccttct

SEQ ID NO: 29221 - DNA, 2363 bp, Oryza sativa
tagtacaaaatccaaatatgacataacacaatacattataattattctataatcaactcttagtttcaggttaaacagagctaagtgttggaaaaaattcaacccgcggtgtttaattcttctctcacggcatcacacctttaattttctttacatgttattaataaaattaatcaactccatatatgacttgatatgtggcaaagtggtagcgtagcggcggtcgtaatcaccttagatgccttagacacgacgctttgtcacgcgtgcaaaaggcaaaaagtgcagacgtgcattgtgtagcgggccaaaaaagagaacttcgaacgctttatttataagaaaacaatagatccgatgatttaaataatgggtccactggttctagtgtaagtgtaaattagttaatatagattttaaatttttaatttaatgggtatataatataatagtgtagactttattttgaaactatgcattattggagaataatagtccaatgtaataaaaaataaatccagtgatttaaataatgagtccatcagcttaaatgcacgtataaattagttaatatagatcttaaattgtttatttgataggtacacaatataattgtgtaaactttatttttaaatagtgcattattggaaaataatagcacaaagtaatgagtacaccggtttaaatcaaaattatcttacattattattaatttaatgggtaacatataatggtctaaattttattttcaaaaattgtagagctaatttagttacatgcaagttgcatgatggtagattctttgtttgtaaaatataattatttaaaaaatatatatctattatataaatggaaaaagaaaaaaaggaaaaaaagaattgaaagaagaagcgtacgcatgaattatgattatttaaaaaaatatatatatctattatataaatggaaaaaagaagaaaaaatgaaaaaaaaaaagagaaaggaaagaagaagcgtacgttcatggtcgtatatatctagggaggaggagaggtggggcccatagtatttggtttggtttatgttaagatcaatttcatctaacggggtataatattggacccaccaatttaagtgaaaattaaggggtagatgttttgcttttttcttagaatttctaggattttctctaatttattagagcgccacgtggcgacttgagagcgtttgtaggaagtttaatggacttttagtatataatagatagatagatagatagatagttacatactacactattaatatctggtcgcacatgtcatacacacaatgtgtcttgcagttcgtgctacagttggctgcaaatctgtaacccgctgctctcctctctttttatttatcttcttaaaatatatttggagctgacttataacctgctggtatacatgctctaagagaaactatagattatccccgatgatggacagaatcacaggaggttcactagcagcttagcttgggagattgaagcccacaaggtggatagaggatttttttggaggcggagatgaacctgaggcggctatgggaggtgtggggggagtgggagatccgcgtgctcgtcctgtccagcctgtccctggaggtcttactcctcttaaccggcggcctgcgcaagcgcaaagccgcttggtggctgcgcatgccgctctggctcacctacctcctcgccgactacatcgccatctacgcgctgggcaacctttccaagaagcagaagctctgcgacggctcattcgatggcgagatgcacctcctcgtcttctgggcccctttcctcatccttcatctcggggggcaggacaccatcaccgccttcgccgtggaggacaacgagctctggctgcgtcacttcctgagcctgctgtcgcaagtcgcgttagccgggtacgtctactggaagtcgcggcccaacatgcggctcatgtccccggcgataatcatgttcgtcgccggcgtcaccaagtacggcgagcggacgctggcgctcaggcggcgagcatggactgccttcgcagctccatggtcacgcagccggatccgggcccgaactacgccaaattcgtggaggagtgccagtcgaggacggagtccggactggtcgccaagatcgtcatcgtgcaggagcggcctccagatgacgaggaccatgtcgaagtcaagcgagaggagtacggcgacctggtgtacagtgcgcacaggttctttcacaccttccgccgcctcttcgtcgacctcatcctcagcttccaggaccgcatcgacagcctcgccttcttccggaggttggagatggagcaggcgtacaaggtggtggagatcga

SEQ ID NO: 29222 - DNA, 3322 bp, Oryza sativa
ccccaagagctaccggaaggctggcgagcaccgtggccagtgggcgctccagcgcaagggcctctaccagaagctgggctggagcgtcgactgcgagtttgacgagagcatcctcctctggcacatcgccacagacctctgcttctacgccaatcatccggcggacaaagatgatgacggatgctgcagctgctcctcgtcgtccaagtgtctccgttgcctctgcagctccagctcgggctatcctgatgccgaggctcgagggcgtgactcgaataagctggcgacgatgagcagggagatatcaaactacatgctgttcctgcttgtcatgcgcccgttcatgatgacggccagcatcgggcagatccgcttcggcgacacctgctcggaggccaagaacttcttccggcgagacgacgaggagatcggggacgaggagcggtgtgccaagaggctcacgaaggtggacacgtcgattgcagagccgcgggacgtgaagggggacaggagcaagtcggtgctcttccaggcgtgcaaactcgtgagacagctcaacgagctggagggcatcacggaggagaggaggtggaggctcattgctggcgtgtgggtggagatgctatgctacgcggccggcaagtgcagcggcaatgcccacgcgaggcagctcagccagggaggcgagatgctcaccgtggtgtggctgctcatggcgcatttcggaatgggagaccagtatagggtggagtctggccacgccagggccaagcttattgttcatcataatcatagtaccatgtaggcctgtttggtccattttctctgttcagccatccaccatggccagcagccgcaggatatgctttgagattcgaacgtacacgtaactgccccgctcgtatcactttctgctggcgccccagaatacatgccgtgggtcccaccgaactctgtataggttttttttttttttgagaagactgtatagggtcttggttttttgtttcttccccaatccccaacccccggatccaccgcctccggctagcaggttgaggtggggcgcatcgatctgtccgcgtgttggcggacgccagcgagccgaggagaaacaatctactttgtcccgccaggagcaccatttgttggcgtaagcacgacattgcattatattttcgcccgtgttgcctggaacatgtgtaatctcagaaaagaaaagaccaagttcgaggaaatatttaagcacggctaattgcaacttaattcatgtggagcaaccaagacaaaagcgccaagtatatatcagtgtccactaggctgtgttccttggtcaaggtttccaatgatgcgttcaatgagtcgtgtttatatgtataaatctaatgatgcatccaatctagtttatatctgcaatgtcatgatttatttatggaataaattaaatcattatgtacttataattgtcaacagagaaaaatgtaggattctaatagaaatgcaagtgcaaaacagatgattgcaaaacaaatgaaaaacccagaaatgaccatctgattaaaccaccggaaaaccaagaatcagatgagataaactcaaaggaaagtttccaagaagctgaagcgcttactaaattttcttcaaaatctctgtggttttatttagaaaatagggtaggaaaaataatatcccacctttcaaagggtaatattgtatcctaactatccattcttcacacttcatttaatcctagccattcatctatttttctttcctaatccaattgccaaacacaccttataggattgtctattttacaggaattttaaaaggtacgataggattcaatcatttgttttaaggggtttcatagaaatttttttctataggattagaattcttcaaatttcttatgtttttccttcatatcaaatgaccctacttgttgaagggtttcgtctgtgttgtaagttgtaattaaattccatcgggatttcgtaggtccgtgcaaacagagtaaaaggggataaaagcttttcagcagcttcgccgctgcagccgctttcctccggccgcattcgcttctctcttttccgccagccgccaccagaaaagcttcgtcacgagatcatgacgatcactgtcttcgtgggcggacgggaggggcatcggctcggtaaccggcgtgacggacgtggtcaaataacagatcatatgcatatgtggttaattacattgatgcatgcaattgggataattaaattaatgtaaaacacctaaacattcacgcatgcatgttatgggtttaattaccgagaatgctgcaaatctctatatacgatttcagggtccgatcccgagcctcagatagggccacgtggcatcaagcgttgcgctccatttgaattctcgatggagaatgtgccacgtattcccaccaatcccaggaccgttagatggtacatcaacggtgaaaaatcgtctggatgagttatttacaaaacgtaagatctaatcatctggaagattgaaagagtccggagtattggacatgaatccagaaaaaaaaaatcgcaagaaaaatataaattcctatctcctactcaccgtgcctccgccctgcctctatccacatcgccagcacctgcatcggttgatgagcagggggtgatggcggctcgatctacacagcctgctttgcctagacatgcgtcgccttaggggggaggcgaaaagcggcggtcgcggcggtgcaggagctcctgcggcacgtcggcgacggcgacgacgatggcgttctcaatcacgtcgtagattctgcgtggagtcagcggcccctcagaaaagctcgcgccaccgttccagctggttggccagagtcgcttcggccacggccacgcccacccgctcccctctgcccccaactccgatttcttgcgcttgcgccgccgaaggccgctcccgttgggcaccggacccgccacgcgcgcgctcctcttgatggccgccgtattctcctctccgctcgcatggtggtggcctcgtgggaatcgaatggataatggagtaatacagggattagtttgcctcttcttcctacggtagtagtagacgaatagcagcatactccctccgtcaaaaaaaaaaaaaaaaaaaaccctggtttccatgcctaacgtttgaccgtctgtcttatttaaaaaaaattaaaaaaaaaattaaaaagacaagtcacacataaaatattaatcatgttttatcatctaacaataataaaaatatgaattataaaaaaatttcatataagatgaacagttaaagt

SEQ ID NO: 29223 - DNA, 851 bp, Oryza sativa
tatttctcttttttactaattcctccgtttcacaatataagactttttattattgtccacatatatatagatgttaataatctatacacatacatgtgtctagattcattaacatatagatacatatgttttacattgtgagacgaagggagtaatttaactgctcgttgtaaggctcattaaacgagacaaatacataaaataaaagtcaaatatgagatatccctatatgactagatatgcgttcgatagtgtcaaaagcccagaaaaaaaatcccacgttttctatgcacatgctatccgaactgataaacaatatgttatttttataaaattctgttaaaaatttactctaaaaaaatattaatccatttttagttcaaataactactatctccatcccatattagttatcgctttgagtttttattcgtaatgtttaatcattcgtcttatttaaaaaaaatttggaattactatttattttatttgtgacttgttttattataaaaatgctttaaatataacttatccttttttatatttttactaatgtgaagtgggccctcagggtgtctacgtagttaattttctcatcaatggtttctaaggtaaaaaaaaatcagagaaatattaattaagaaaataaaaggactgaaatagaaagctgaaatacaaaatctaccataggtacaataaggctactgttaattactgtggcttgtacaaccttattctatatgttctatatctagaacaaggactaaaatagagagctgaaacatatgttctatatgtagcttattctacatggaatttttttttatttggccactagtaaaagttacttc

SEQ ID NO: 29224 - DNA, 183 bp, Oryza sativa
ggtatccatctctgctagtttaccaccatggcagatagctccaaattcttccttttgagagatagatacagccagctcatgcaccacaataggcatcctgcaacttgctactctaccttgttcgtccacatctacaacctgcagaaatccccagtggattagctctttatatagcgctcacca

SEQ ID NO: 29225 - DNA, 3574 bp, Oryza sativa
aatagttgcttactgtactattaatatctggtcccacatgtcatacacacattacgtcttggagtccgtgctgcagctggctacaaatctgtagcccgctcctcttctctctcttcctttatctctttaaaatatgtttatagctggcttatagcctgctattgtacctgctcttactactcctacgattcttttgaccaaatattttccaccgtccgttggaattgcagtcactgacaccctgaccccacacgcacccttacccctcctgtatatataccccctctcgatttcaccatacgttcccctccccctccctttcactttccccatctcctaacaccacggcgaagatgcaccgtctccgccgccggccgaccggagagcacggcaccttctccgccgcgcttgcccgccggtggctgccgcggaagacctgttcctttctccggcggacggcgggcgggccttccgcgccgtcgacccgtccatagctccgcctccgtgatggcttgtcgtgtcgccggcggcggcggcggcggcgggggtggggtttcctccgccgcttcgtctcggtggcgaggccgacggcccattggggcccaatggggaaggcccatcccccgtggcgggttcccggccacgccaacgccttctttttctgatgaactctccctggcaactggggcccgcaccgactcgcccaacggtctcccccaattttcgcctctcccgcctctcctctcttccaactccgacgagcggggccaacgccgatcgccgcgccggagcagggctagggttccggccaccgccaccgccagaacggtgcgtcgcgtcccgtccccatccttcttctgcttgctttccccccgttgtgttgcgctgtgtttttgattccgttgttcttgttgattttcttgcaggaatggggggttcgttcggatggttggagtttctcttatcgacctcgcacccgtgcgaggatgatgcggcggaggagcttcccgtcgagccgccggtggcggcgatggatgccgcccatgacggccgcgatgaggtgcggggagaagtcccctccgagccgtcggaagtactcgctggagaggaggaggcggcgatggatgccgcccatgacggccgaggcgaggtccggggagaggtcaccttcgagcgggcgatcggtgcctcctcccgtgcgggttacgaaggcatcaagctgggggaggagccctccctcaaaccggcgatggtgggcgcgcccgagattaagatgatcgagatagcagaggcctcctctgttgcccagtgggacttgttggcggggacggaggattgcagccctgagattaacccgaagattgtcgacctccagcagcagcagcaggaggcctctctccttcctgatgaggtcatctctgaggcagacgcgtcaatcttggcgcagtattcatcggtgacaaagaaagacgatgatgctgagttcttgatttgtcggccaaactttggttttgttacacgaccacagcaacacactcccaagaaacggcaccccaagaacaagcgggctatggggattaacttggtaagatgtttaaagccaacactatttgtatctgtctgccttctttttggacatggaatttatactgatttcattattgatgtttcaggctaagtcttcttgttcttactgttttcacttatatcttgtattccagataatttttcttgatggagattgttgtatttagtagatatatgttattctgtcttgatggagattgtcaactttcatagacatgttattctgttttgatggagattgtcaacattaatagacatgttattatgtctagatggttattattaactttaatatacatgttatttagtgtaggcattttttttaaaattaatttttgttttctctgttttcttaggtaactctacaatctacatgtctaacagccattgataatttatattgtcattgtgttttaattaaattgatattttgtggtattgtgttttgtagtggttaatctttaattgttaattcatttctttcttcatctctgatctagtatgaattatcaatggtgtaagcaagatttgtgctgtaagcctaattgattttttccttaacaccagacttaactaagatattagctttatatttttcaatgcgattcgtgtttttgctctatatcttaactaatatagatggtggctctgaaataaaactaacacaagacaatcttgtaacaaatatagttcgtgcatgctttgccatattattgtagggattaaattccatcagagcttttactggttgattaatactgtcaatagtattgtatataaacagtgaagattaaggcaagtaggcaactgattttgttgatttaaattcactgagctttgcttttctgatgtttatatgtgctgccttgtgcccatgtctttttgctagtcctggacactgcttgctttggcacaatgcattcatacggcccaatggtgcagtcatacctttcccttgttgttaggcttagttcttaatccctcaacgtttgttgtacaggtttcgagccaaataaatgtttgcttgttgaatatgccttgaataattttgtactattattaaataatgagtcatcttttggttaatctgcgtttgtttgtattagatgtgtttgtacatattattgatattcagttattgcgtccaaaaacatgatattcagttaatctgaatttatttggttcatctgttttactatgggattgattaccattcatcgtgaaactaatgtttgatcttttgtttttcagttggatcgagagggaaatatctgcagtgatgataagcttccaagtcagggttgcttggttggtaaatacaataatcttttgctgcagttgtatcagctgctgttcgatttaaaagagctaatggagctttgtggccaagctaataagatccagagtaaggtgttccttaaaaaggcaatgaaaaaagcttgcagagattctgatgatgctgttgcaaacatagtgtttcaggccctaaaggtagatggtttcattctgaggctattaaggtatctgaagagccaattcaatttttgccggacccaggcatggaagataaggaatgagatattgagaattggtggtacacccatcaatgatccactttccaaagattctccttgaactttttgcttctgggcccttgaaccacctccaatatgggacgttgttctagaatcattgagacatatgctcctgattaccacatattttgcactttggcttgtggtggtcgtaattgttttgtgctaaatgtaatcctctaacaggctgaatgtgaaacggtcagctgtggtactgtatatagacatgtatccaatctgaaatgctttgtatggttgtatacctggatggacatatgcatcctatggatagctggtgcccagctgtggcaatatgctcgttgtatatgaattagcacagagagtggtgaatatgaaacttcctgttcttgttgatatttcactttatgttt

SEQ ID NO: 29226 - DNA, 653 bp, Oryza sativa
taatttaattccgattctgatgaacccagtctcaagttctttatactactactacttattgctttctggtcgctgccccttgaaagcaagatcgacgcgagcgtacgttacaaacgacttgcgagaagataaactgcaggagcttaactgctagatcgatcaatgggagcatcgttctcctacggacaaacgcaacgggtcaccgagaataataatgccgctgcctccaccgtcgtcgccgtcgtctatgcgccgggtaggggcggatccgatgtgagttccccctcccaatcaattctagatccgccccagacaccatgtctggagcggggcaggggcggatccaacttgagttctccctcccaatcaattttagatccgccccaggcaccagatctggagcggaacaagaggaagaaggtgaagaagatggtggatcgtgttatcgatggcggggatctagacttggtcttatcgtacgagaacgacgaaaaatgtttgttaaatgagagcatgctcgaggatcaggaaacattccggcaccaaatcgagaatttgggctatgcgttcatccatgtcatgagggaagtcatcctaaccgatgatgaggatcaagaggaaggcgaaattgtcacctatgctgaggaggaaga

SEQ ID NO: 29227 - DNA, 303 bp, Oryza sativa
tgtagagttcgtaaggaacaattcacagtttgcaagtacatatataggtacaaagatacagcaatcgataggtaggcatatgaatacagaatacataagattttatttataccttgtgtaatgcttatgcctgtgaactgtgatatcatggcctcatggggcgtccagctggctgctactagctggcatttcgtttctctctggatagccataactgtggaaagtataggtccctgacggatatgattctctcctggtcatggatactgttcagctgacttatttttaccacatggagaactt

SEQ ID NO: 29228 - DNA, 498 bp, Oryza sativa
atgtctacctctttgatgagaaaatttcactcatagtatcttacaatttatactgcaactcttatcttttcagacacgctaatgagtttgtgagataatatctacagttcatacccaattagtctattatatcaagctcttcagtcttcaatacatttgcagtattgctcagaataaaatgggatgaacttgccaaatcacctcagctccacaaatcagaacatgttacagaaaatttctgaagaaatatacactgtacccttaatgaaaagaatgtaaggaacacaccaccaaaaaggatactctttaaaaagcttgtcatagtaacgtttgaccagcctcttctcccaagtagaatccacatcgtcttcctcagaaagtatgaacctttatatggataaataattaaagaaaaggatttaggagtatttcataaagcatggacacacattccaccataaataaataacaaagggtattggacttgtttcttaccta

SEQ ID NO: 29229 - DNA, 519 bp, Oryza sativa
cccatgccgcctaatgggcacgtccgcccctggttatatgtcgttaatatctatagccgatcgagtagatttagtctaatcttatttattcatgactgtcaatcgatcccaatatgacatcggcttgatgataaatgatatgtcatcggcaattagccgatcggctatcgtttatggatttaaccgcggttttcttgtctttctttcttgttgattgtaggatcaaatcaattggcacgctcacaaatctaaaagcaagattttggacctgcacagaagttaagtagatctttcaggccagtgtgtgtttttcgcatcaacagtatgaaacattgagttttaaaggtttgaaacacatgtttttcttttaacataatattgtaaagatttaataaaaaacgaatacaaccgtgtgttaagattgaaatttggtaagccctaagagaattatcacatcgccaatagtcggatttctgctatatttggttaaggaaattaatctattaaaggaagcttatt

SEQ ID NO: 29230 - DNA, 7229 bp, Oryza sativa
ctgtgcacgtttgcgaactagtctttctgaaccatccgcacaaccagagactccttcacccaatcagccttctcacctttgcccagcctaatggcctaatccgatgtgcttgctatagttgggatcatcactggcagcacaccatcatcagtgagctcctctccttttggctccacttctcttctagctttctggggcctgtaaatactgtccacctactgaatagcgaatgtgtaacaaattcaaaatatatcaattcagaactaattaataagcttaaaaaagaaccaaacttgtcccatcaaccaccactgcaaaagtgcaaacaccaccaaattggataggggcaattgtgttcttatccctactttcatatgcaattgtgattttaccctttttttatagggtttgtgattttaccctcaccttttcaaaatgaaactctgatttacccctactctattaaaaccacctaacggtgtcaatgaaactaaaaaaagacaggtataaccctgtacacttgcccctacttttctattagaatctgtgtattttccaaaaaaatatgatcgcacttggacaaattttgaaagaacttcgatatcattgataggatttcacagaactttcaccaggtgcgaaagatccatcgcattcaccagtaaaaaatcaccaaacaaacaagctcctcacaaagtagcacaagatcggaaaaaagaaaaagaaaataagaggcggctgcagcacgaccggagccgccgccttctagtgcgatgccgctgctgcgggctcgcacgtgccgccgaagctgcctcctgcttgcggctgccgtcggaggctcggagccgccgcctattcactcgctccgccgaagccgcggcttgctcactgcgcctacaccccctactcgctttgctgatgtgggcatctgctgctgctcgctgggcatcacagccttgcccagccgccggcctatctcgcctgtgcacagccgccggcggtgccactagggttaggctaatcaagtaatcagaatggggatcgggtgggatgaaaaaggcaatgcagggtgttgttctttgcactggggtataatggtccattgtttttctcttagtaatttcatctatattttttacactcttattttgggtccaccaaacggtcatccaatgtaggggcaaacgacagcttcgttcgaaaaaaataagggcaaaatcacaaaccctagaaaagaggggtaaaatcacaattagatatgaaagtaggggtaagaacacaattgccccaattggataatatcccaatacaggttttaatgacattcaagagacttattacgacaaatccaaagcgtcttataatataaaatgaatggagtaaattgtcaactctcctcaccagactaaaatgtccttaaaaatgttcttaaaaaatgataaaaatcccatttttaaaagaataaatcatgatgtttcccgtccaaagctgagagtctactctagatgagctcggtgtcgaacttgaggcagatgcccatggagaagagctcctggtagaggatcttggcgccataaggcacgctcaccctcaccacctcctccgccgacctgcagaacctgcagtacggccccctcaccttccggccgccgccgccgtcggcggcgacggcgggcgacacgacgacggcggcgcgctggcatcggcggcagacgtggaggcgcgacacgtcgctgaggaggaagaggcgctcgtggaggttggcggcggcgccgtgggcgaggaggcagtcgcgctccatctcgccgaacttgacgccgccgtaccggcggcggtcctccaccggctgccgcgtcagcgggtgcaccgggccggtgttccggaacttgaccttgtcctcggccatgtggtggagccgctggtagaacgtcggtccggtgaacaccggcgacgccgcacgctcgccggtgcggccgttgatcacgctctcccctccccacctggagaacccagccctgttcaaagaaacaagaattccaaagtttttcatcacattttcagttgcatctggttactgttgtagtttcatgaagagaattcggtgaaagttgtttgtttgggaatctggctaagagtaagaggggataaaaattgtaatgtttctagttctatctactttcatgaagagaaaacaatcaagttattgagaatccagccctgtccaagagagagagagagagagagaggaattttgttccccatattttcagttaagtttcgtgcatctgattactattgtagtttcatgaagatatttcggtgaaagttgattgtttgggaatctggctcagatcaagatggaataaaattcataacgtttctagttctatctattttcatgaagagaaatcaatcaagttattgagaatccagccctgtccaacaaaaagatccattgttttccccatatcttcagttatatttgacataattcagtagttcaatctagtactagtttcatgaagttcagttcaatttcacatattttcagttagaaacaataattcaatcaagttcatcatttgagaatccagcagtaatcaagatggaacaaaatttaacatttctagtttatctccaccttggaaatccagccctgacaaaataaaatccaagttttttcaccacattttcagttatatttcttacatttgattacttcactctagctagtttcttaaagggaattcagttaagttcatcaaaatggaacgaaaattggaacatactttcattaagagaactcaaccgagttcataatttgagaacccagagctgatcaaaatgcaacaaaatttggaacatttcaagttctatctactttcatgaagagaaatcagtcaattttattgatcattttgagcagccctgacaaaaaaactacaactcttttccccacgttttcagttgaatctcattcattttgctagttcattctgactaatttcataaagaaaatggggtcaagttcattaaaatagaacaaaaattaaaacacttctagttctctctacttttatgaagagaaatcactcaagttcattatttgagaacccgattttgatcaaaatgcaataaaatttcacatatttccagttccgtctactttcatgaagagaaatcaatcaagttccttgtttgagaacccgatcaaaatgcaacaaaattttgcacatttctagttctgtctactttttaatggagagaaattaatcaaatttattgtttgagaacctggcctggattaaaatgcaacaacatttggaacatttctagttcttctactttcatgaagagaaaccaatcaaatttactgatcattttgggcagaatgaattgcttacttgtgcagctgctctgtgatcacttccacagatggacttgtgaacggtgtcgcataccgggtggcaccgccgagggcgattcctttgcctagtgcagcttcaagaagttggccgggagtctgacgagttggaaagccatggggattgatcacaatgtcaggaactatgccttggtgagtaaaagggaagttctcctgggaatccaagaagccaatgactcctttctggccatgcatgctggcaaacttgtctccaatgcgtggcgagcgagtctgcagaggtaatcagatcaaaaaatttactaactttaacaagtgttcatcagttatcagatttacaagtagatcttttggaacacggggaataacagtactaatgttcatcacttgggtgttatggcagagtagacatgagaagatgaaaatgattgatgtgttatggtatggacacaatgaactctaatagaatgtcgattagtgtagaaaaaatcagttggccattcaactattccaatagtgtgtcatagagaactccactatcttgcaaatttataaatggttagtgcagattaattttgtaaagattgcatattcacctgtcttagagtaacaaacgcagaatttgtcccatcatcagtagctgaaagaacaaccttctccactattcctttttcagtatgtagcagcttgatgctatgatcttcaccagagtctgagacctttccaatgataatgtcattactctgaagacttgctccaatatatggtaagccatcaatatctaaactgtcaaccaggcctttcttgctaggagtttttccaaaattgatattttccttgtgttttaatcgtttggtgatctctttgttttctatcagtgctttatagctcttaaaatgttgtgttcgaaacatgccacgctctaaagaggccctattcaataccaaagaatcctcttggttaaatccctgatggacactgattgagactattgcattttggccattgaaatactctggtctggcaaagtcatgtttgcttccagatgtatagtctctcttaccaagacaatcagcagctacagttttgaacagaggtctctgtggataatagagctgatgggaatgtgtatcaactctaaagagaggattcgtagtggagtagccaatagcctgttgcgatatcttttcagcttgcattagaattctcttagcagtatcatggttggcaaagggaatgatactgcaactcaatcctagcaagaaagaagggtcaagttcacaatgagtatagaatgagaaattcttttcttcgtcccctgcaaagagatgcctaattccataagcacaccggatatcctcctcttcttcaacaccaatcagctcaattatattttgatccataagttcctggaaggagtatgatccattctttcgattcatgatgtttcgtagattttcgacaataagaagaggtcttagaatccttcctggatcggaaaatatacgaacttctttgttttgcttgtcccttttgatctccacctaatcaaagttaaaaccaaaatacattgtcagtactatctagttgtattaacatactgttgcatatttcacagaagaaatggaaacatagtactctaacgtgataaatatgctgtcatgcttacaacaagatatgggccaactatggcattcatcaaatatacttcttggctcagattagttaattttactaagtaacttaaaaaggattacatagtggaaatgaagtatgagaacagtattttattggaatggaaagttcatattaacaagcaagaatacaattcccttttcctttaccaaacattgtaggattattcttttttttttggcaaaagcataaagtcataaactcaaacaagaatgacacaaaagcggtccattaggatttctggaaaaataaatcagtggtgacaatgcgaaaaccataccccaagaaatgattatgagacagattatgccaatcatggactgcttttaaaggcaccttgtttaagtgtgcagatgtcatggtcggaattgtctatcaaaggaggcgaaggccggatggcgccacggatgtgatcgacagcggcaagggcgcaacagccggatcagcgccgtgatcctctcccgtgccggacgggaacagtaatcagatatttagtgagtttgttagggagtctgttaggattagttcctttctatttgcaattgttagttttggtttgtaagcctataagaggcacttaaactcaggaattaagtaagcaagattaatctactcctcatcatctgtttctctgttttctcaccttcttctccgaagtgcccatcctggggcgccgatcaaccaaattacctaagccacggccacccacccatcactcatatcccatacgatccctagccacccataacagcagaacaatatcagaattatggagagcacaaacaatcatgatatgtaaaatctctcacagagatgcttcaaggttgaattgagcataatagcttagcaggaaattttcaatcatcataaatgaaagcaaagcataatcatggattagtacacaatgcttcaaagtaaaaaaaaaaatccgttccagtgtagcagaatctggaaaagaaagaaacctgtgcatcaatttgcttcctgcgtctcatgctccttaagtgcaaaacaaactcgactgagtctgcacaaactccaaccaagtttccattcaagaagattctgtctttcccgctgatctcttgtagaagcagttcatccagtttcttcatcccacaagaaacaagtgcgtcaaccgagggctccctgccaaacaactaacgatagcagtaatggcaagatttttcacaaatccacacttttcaccatcaggagtggacaagaaacatagctttccccaatatgatggattcctaggaaaggatttggtaagtcagtttgcattaggatattgaaaacaaaaaaataaattataacaggaatgaatgattctatgtcgaaaggtacttacggatatctagcatctccagcctttccagcatatgcaacccattgtcgtgtcttcctcatgtcagacatcatttgaagaggatttgttctcctaagggttgcaacaatccctgaacacctctctcttttattaaatggatggcaccaggaaccagtggagaaggcacggttgagaccattggtaacaattgatgcatggacataacactcaagaggttgtaggtcaccatcaccactcaaatgtctctgcatgaccttgaccatacgtttctgggcatgcataatatgtacccatagctctctctggagcaattcacatgccaaatccagcctcttgttgcggaaatcatccctattatcactcttccgattgccagaggaagccaatagaagacatctcaccatgtatcccaagaagagtgctttgctcctattcccactaacatcaggaaacatatgcctaccaatatactcatcaaaggatccttttggtggaaactttgtattcctgatcaacttatcaatatattcactggctctcccttctctctgaaagccttcgcactgctcatgagattcagttatagtagctgatattatgttggccatggaagcatcacattcttgtatgtcaataatatcaaaagcttctttgtctgatgatacacctagtgcaaaaaacattatccagattggtatagttgcacccaaaaagtacaggttaatgacttttctgaaaccatcattagactgaacaggttttatagagatcttttct

SEQ ID NO: 29231 - DNA, 477 bp, Oryza sativa
tctatttgctgattgaaaggagctatcacaattgatgcttggcaaattaaaagaagacatagaaacaccgttgcgaacaaacaatgtatgcaattcttgtagaaccatatttctaagttgagtatcaggaacagagtacgaagagttatttaaggcttgctgcagattaaacagaatatcatcaaccatcgcatgccaatgcttctcaaaaacgcactctcatcagcaataccacaatgaacaatcatcaacacaaaaagcgatctaagctggccgccggatgcccaactatcagcctcatcaaatgcatacgaccattctctatcatcaccaagcaaccctctagcagcacaagcctccttaaacgtatcataaacaacgccgcatatgttctaatatcctcataacttctagcgccttttacgtacatgagcaacatcctcataaaatatccttcgcctgcagaaggatggatgt

SEQ ID NO: 29232 - DNA, 35499 bp, Oryza sativa
  unsure (1)..(35499): unsure at all n locations
ttcctgcagcccttcaacaagtaagtaatcaagctcattttcattaggatcaggaagttcagcgctgatgtatgtatccacaacagatggtgtggcgtctgtgcttggtgcatcacgccaccagtatatgcacgtggggaaggcccctcttctgaaattccacgctataaagtactacaaacatatcataggcaaaacaaccaaataaaaatcaataaaacaatagaccataaagagcacagctaagttaagggcaaaaaaaagagcactaaccagcacgcacacgaccaaatggaacaccagccataatatcagaaaccatctcatcaagtttcattttaaaaactctacaaacaatgtcagaacgatctgtcgaacgctgccctggctcaaagcgcaatgcttcttcaatctcaggccatttcggattacaagtaaaagtggtaaacacatcaggggcgccatacacacgacaaatagcaaccgcatcctgataattttggtacatatatcttctcccgccagtgaagcttgcagggagaattcgtcgcttaccaacactattaccgtctaaacaacctttggcgactgcatctgcaatgccttgaacgtgttcgcatctaaaatcgccctggtgttcatctataaatgtcaatctaccctcgtcaacacacgcaaaaccatcaacttgactttgggaggacaaacgaccgcaacataaatatgggttgaactggtctcgacgatagtggcaacagtaacaataatgttcttgcatggaagccttagtacgtatatcagtgcgatttaaatcaacccccctcaaatttataccaagctgaaaaccacgttcaccatatgggaataacagtgggtattgtaaggccatgtaagcaggatgcaagctagatacatgatggagtggaccaggaatgctctgcacaattatatcacgttttgcattttccaatgaaaaatcacctacaattaacccagctagttcatcggctgttggtaattcatactgaacaggcccttcctcctacaatcttaattgctaattgttcatcaccgtgttcagccagccgatctctcgcgagcctaaactgcttaaccaaaggattacaattgtctagcatgtctagcaattcagcagctatctcaggatctagatcacagctaccattctcttcaccaagaacagcaagcattctgttttggacctcattttgagtatcataaatatacagctgagcaaattttggtggattatcttcattaggcaagagcgaacctatacggtgatagacctggccatttattttaaagacataaggaccaccaccctggtttaaactatcgtcaatatctgcacccatcgaagtgaaagtaaacagcgaattgtactgacgtatatgctgcaaaaaatgtttacttcgagcatctccatcaaatttaagaagtgaattcaaaggttctggtggctgcgcaaatggagggacaaaaattttcccacctttgcaacaaaggttgtaacagacacggcgcttggtaatagcagaatctttcttgcaccgttcctggtaccagaactgagcagcgcacaaacggcagcgatactcaggagggccataatcacacctatcctttgaagtctctgtgcaagcattcaaaaaaagaaatttatgtttaaacccagcatgctggcattgcaaacaagggaatggaaacgaatcagagatgaaagcaacctctcaaaaacttggcataatcactgtcaaacttgttgcaagagacaggagcaatacggcaaggttttttgcctatagggaaggagacataacgtccatgtaagccatgtcagcaagaacatatgcagaaaaccaaagatccaatggaaaaacctgcagccaccaatcgtttcatggccaatttttttgaacgcatttgccgtctttttgaagaataccatgcagggtagatagggaaaaatccatcgtctaccaaagcgagaaaaatatatgagcaacgactacataaatataaacaagccacaacaacagtcgcacacagatcagtaaatcacataccctgacggggtggagcaacagtctcccaaacatattcgctggcagctgaattagaggaagatgctaaacaagcaacagacgatttaatctttccacccaggaaaagatataaaatctaaagcgtctaaaaaaacaaaccgcaacaaaccatacatctaagagaagcgctgctacgctctagcaatcggcgatcccgtcgacgagcaggcctaaccacacaacccccttccatataggaactaaacgcacagaaaaacagaaatgtcgtgcacacatatagaacatataacccacaaggaaaagcgcagctcgaataatgtatagatagctgaagcaacagaggccaattgttataccttagccgacatgtacgggcacagaagatgtggtccgcaacctgcagggaataagaatgtaatttaagctggatatcagataaaagaaagaacatacaccaaaccacaaggcacaaataaactacaaaacaaaaaggatgtcagccccaaagaaatagcaaagaaacaaagctcacctgaacaggagctgatggtaaagggaacagcagcacaacagtaacgaacgtatcgcacggacctgaccgcgacaataagcacctgcgccaaaaaaaaatcgatatgaagggaaaaaaaacatgtaaacgtacagagatgcacttaaggaaagactcaaaaatacaaatgaaccacatggttctgcacgaaaagaaaacaccacgggacacactctgaatggcgaaacatgatccaataatgaatcagaaccaggaaaaaaaagcaatgatatttgtcattaactaacgaccgtgtgcttcatctatgtaatagccaccatctatttactgaaagaagtatatactgaaagaagaacaacaaagataagcaatgatccactgtcaaaagggaaacatgaacacggggaaaatcgcctaaaacctaaaaactctgtgacagtaaatcccgtgcaacaaacaggccagtacatggctacctgagatgcaccaagcctaatcacaggataaaaaggaaacacacggcacagacagaaaggaaggcagctaggccagatacagaaaacccaccagcacacgcgttcaccccccagggtccatgatcaaacgaagaaagcacaacagcggagaatgggctagaacagacgacaagaagaacagcgaacgggcaccaaaaggcaatgcaaaggaaatggtgaaaaagcagaagggaaagagaagattggcaggcaatgagctacttatactggtaaacaaaacaaaaaaatatgtaacataaaaaacaacatactcagaggctgtcaataggaccccacagatgacagggccatcggtcaaccacagcatacgacgtaacacatcagtgctctgacggaggccatcctcgagctctccgtgttcgcctcgaacgccgagcagtaacactgcgccggacaaagggcacatcggcggagcctactacagcggccaactgcaattggcatggaccacgactacgtggggcccgaacagcagcggagcatgattggctatagccgtgggaccgaccactcgccggaacacgcacagacaccaccaaccacctcgcagccccgacgaccggctgccattgaccaggcatgctcgagctctccgtcccgccctcgaacgacgagtggtggtgagtgcacctgacactggccgcactggcgggatcctcccgcagcgacgagactcgactggcatacaccacaatggcccaatcagagcatcttgagtggtgtgagcgggcaccctgaacgatttgtaccatgctctgatatgcagcgacaagtgaggaagaacaacaagcaaacatccaacaccaattaactggccatccattaccagggagaaaatgtataaggaggaagaaatcacaccaggcatgcagattcggcactgagataaaaagagcatcgactcaataccaaatcaggggggcaaaacaatggagccgctgatatcggagcaaaaatcgcacggaatggcgcggccaacgacgaagaggaaatgcgagtgcatccagaaaatgccacgtcgtccccttccttctttaccacggatgaaccgcccaagctgccacggacacactcaaagacacgtgccttcacatgcaccaataaacgcagcccgtacacatgaaacgcgaccaccgtttctgaacagcgcgaacaaactaaatttgccgcagccagcgtggacccccacctctgtggggaggaaatgaccccatcgaccgtcgtcgtcgtcgccaccgccgccgccgccgcatcatgggggaggtaggcggggtaagcagggggaccggaggcaggcggggtgagaaagggatagcaaggagcggcagcggtggcgctcggcgacggcgatggcggtggcggaggtggagacggctgcactcggtgacggcggcagcggcggcggcggcgggagaagaagagggagagggtgagatggcaggcactcggtggcggcgcgggacaaggagagcggcggcggcgctctgcggcggcagcaggagtggaggcggcggcgcgagggggcggaggcggcgctcggcgacgtggacggggcgagggggagggggaggcggaggcggcgcgtgagggggcggcgcggcgctcggcgacgtggacggggcgagggggagggggggcggaggcggcggcgcgagggtaggcgcaggcggcgggagtggaggcggcggcggcgctcggcgacgtggacggngcgagggggagggggaggcggaggcggcggcggcgcgagggtaggcgcaggcggcggcggcgcgggaggggggcgggagagggagaggcggcagctagggctttggggggtatgcgttagtggatgctgttttgcggaaaagcccctcttcttccacatatcacaaaaaagcccctttccgcgattattcctcttcaaacacaggacgctagggacctatacattattacgaaaaatcggagggctttttcacataatttccaccccgcgcgtactgtagctactgtagcaaaatccgacgtggacgcagcgagcgagcgcccatcccgccgtccttaatattctccaattactttgtcataaagaatatatttttcatttaaaaaaactaatctcatactgacatatattagcgtgcatggtccccttaaaagttaggtttaatcaaaaaatgcgttaaggtggctgcaaggtctctgctgccctaaccgaatggctaggagtaaaatttggatctacgattcacctcagctaagttaggccctctttgtttaggcttagacttttaagtcagcttattggcttatatgatttataagccggtagatttaatgtcctaagtttagtggtggagtcatacatcaacctcacataagccaaaaaagcttctccaatctagcttttggcttaatagtgttagagtggcttatggctttaaaaaaagccaaacaaataagttgcttgtttgtttaggcttagacttttcggcttataagttggcttataagcctgaacaaatagggccttactatattttacaagactacaattacagtttctggtgcatttgccaagcactattcaggaggatattagtttttttgtggtcctggtatatgtacatatgggataaatgcatggtggatgcaccgaacagaaacacaccaacatgcccacgtcaataacccaaccattgatattttggtgcttatttaggatgtttgcatgaattagtagtactagattgcaaccaggtcaacgctcttactgaaaacagccatttgaatggacagaagtctaacagtagtggtagtcaaatcgatcatcaaccttttgaggttatatatttttcatctgcttctgcataaaatacatcaaatgctagacttccgagtgaacttgatcgaaatgcttgcagaacatatgtgtgtgcagaaattggattaaaacaattatttttttctccacgagcttcacattcatgtgtcctacagaaacatactactaactgaagcatctgttcagtttgtcacgttaatgacaaaaaatcgaaatcacctactgagaattaatttgtttatgcaggcatttattacagtccatgatgcccacacgcaggacttgtcttcagcactgtccaggcattaattttgaacatgaccaggtaacgtcccctctggctttcgtacatgaaccaaaggtaacaacagttagttatatacttttcaggaaataattttgaacatgagcagatagacgtaaaattatataccctaagagcatatgatgacaatgtagctaactactaaatttggaccatgctgaatattataagatggaacatcttggtagttagtaatattatgctgaatagttcgtatatatccggttggatgtagaggccgggtaaaaaaatacccttctctaaaaaaataaaaaaaatatgctgaatagttagtggctttgattaatctctctgtcttcttgcatggagtagcacaattatataaccagctgggtacttggtaccttgttgccaccctaaaaaaatgatggcaccatacataaatttgcttgtgttaaaatgtattgccatcatagcgttgtaacttataccttgccttcatggaagatagtagtttattttaaatggaagacagtaatatgctttgttcaaattgatcttccagatgcataggtttatgaaatgctatgatctagatgaataggtttcctgactattgttattcatttaaaatagaaccaaatatgctgaaactattcatcactgaaaaaagtcaaatagaattatactgtcacaccgcactttcataagtttctattgatactggattttattctctttatgttccttcagtattttatcttatatatcagaattaaatagtttacaagaatatgagtgagaattatattattattgatccgtttctgttgtttgccactgtaccacctatgcatgcttgcctattctcttgaaccacatcgtatcgttcttaattttcctgaaatgttgcatgcattctttgtttttttcggactgctttctgtggtgcctagttgttggtagtgtgcaatattgatgatttacgcgtcctgtgtattcgtagggtataatgaaatttgatctgaacatatgaaatttgacacatgcatttccatgatccgaaaagtttatctgcagatttaacaaaatattcatgttcattttacctttttcaactcatttacatgaacaaaattggagccatgtaaaagcctatatatttactttgatacatatttttgctttaatagaatccgggatattttgccaaatattttgggagttaaattactactgctaagtgatgaatatgtctttataagcgtgtgcctcgtggtaggcaaacacactgtcttcaatatggtgcttctactgatatgcgttcgatagagaagttcatgtggcttcttgaggtgctctataaggaggaaggtgaccagtgaggagtagaagctgcagaatgtttccaggcgatgcatgtattgaaaaaatagcacctgtagaacttgcaggtgatatttgtatctatattttacttctaaacattgtgttttgaaatgttaaaatattgtagaactctattcatggtcaactttgggaagttattaacagtataataatattcatgagaacaatacaaatatctctatcgttattttattcctgaatcttaaatattaccttttggtttttgcattatcaattatcaccattgcgttagcacgggcatattactagtgttcgttaattctcccgtgatcgggagactttggaagcgctccatggcgtttggaaaggaacctccagcgctctcaccgccgtgcagaatcgccgaattttgttcatttttaatttttttaatatttacagaaatactataccggtgaaaatatttacagaaatagaccctgcaacccttcctgagggtggcaggatgatgcgtgtgagcaggcgctagaggccgctgagcgggcatgcgaattttgcatgcggcaaaaaatgcatttcacccccttgccgcccttacagaaggcggcaagggacctcagcgcaaaacgtgcacacaacgccgtgtgccacgtcaccttgcgactctccacttgggcgacaggtttattttttaaatatttttgccggtataatattttttaaatattttaaaaaataaaatctactactacttaaaaaataagaggtgcttccatcgtccgtcaaaaaaaccgggtgaaaaaaaaccgggcagaaaaaaccaagtttgtccgatcaaaaaaaccggacgaaaaaaaaagtccgatccaaaaaaaaagtgaaaaaaaaaccgggcgaaaaaaacacccgtccctggcaaaaaaacacccgatcccttaaaaagggaaaaaaaagtccgagagacaaaccgtttaatgaataaaaaaagcgaaaaaaaaagagtccgattccctggagaaaaaaaatctgatttccctggaagagatccgatctgtattggattggagaaaagaaaaaaaacacttctctaggtgcttctgtcgtccgtcaaaaaacgggagaaaaaaaccgagcgaaaaaaaaagaaaagtccgataaaaaaacctggcgaaaaaaaaccgggcggaaaaaaaacaaatatgtccgacaaaaaaaaggaaaaaaaaggaaaaaataccgaaacgaatccgactacatcgacgcggtaaaaagagtttaaaaaaataaaaagaaaactgtcctattccaaagaaaaatgaattatatgtatcgtggagcaaaaaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaatgggcaaaaaaaaaatttgtccgataaaagaaaaggaaaaagctgaaaagaatctgactccatcgacgcggtaaaaaaaggcgaaaaaaaactttccgataaaaaaaaggaattatatgtgacgcggtaaaaaaaataaaaaaaccaggcgaaaaaaaagataaaagtccgataaaaaaacggggcgaaaaaaaaacaaatatgtcctatccaaaaaaagccaaaaaggggaaaaatcaaaacgaatccgactccgtcgacgtggtgaaaacagggcgaaaaaattccaaagtaaagggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccggacaaaaaaatatctgtccgatccaaaaaaaaggggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatgtaatctaatctaactataaaaagagaagtttctacagaatattaaaaaaggaaaaaatgcgcgagaaaataaaaacggtttaaaaaaacacgtgagggaaaaatgtcagaaaaaagcacaaaagaaaacgcgctagaaaataaaatttcgtagttctaattttctgattgttatcgacatggttatgcatgaaaaacgtatattatcattacgttttttcacccgttgcaacgcacgggcatatttgctagtgaaaaaaaaatccagaatcgcctctcgtgcaatgctcgagtgggccggccttctgccgtgacggcccgttttgttcggacgcccacacggcccaccgccgttcgggcccaaaactcccagcttcccaagtcgacggctacgcgcagtagcgctgtcgcagtttccgaacggctgtacgcgtcggaattctctgtagccctacagcaccgtggaagtctggggtcctcaatttcggcacacgttagtgtttagatcttttggatctaaacttctaaccttttttatcacatcaatctgtcatacacacataatttcagtcatatcgtatcaatttcaacctaaatttttaactttaaaagaaactaaacacagccctttgtttgttgggacttgggagagtcggcaccggcctgatccggtccggggctttctttcggggaaaggaggaaaagctgatcatggaagaatgtgttgatgactggagcgtgattagtcaggtcaaaataggtcgtagatgttgccagatgccaaccgcatcaccgttgctacttgttgcattttgttcggcgatgatcccctgacacatagtattttgtagcataacatgattaccgttccatgatactccctctgttttagattataatttgttttaagtttggttaaagttaaactactttaataagtttatagataaatatagtaatacttacaataccaacttagcttcattaaaccaatattgaatatgttttcataataaaattattttaggttgaatatgttataactttttttctacaaacttgattaaactgaaagcaaattgactttaatcaaaattgaaacgacttataatataaaatggagggagcatcgaccctattgtttcgctgaatatttgcaaacgaaaactaatttgtgaagaaaacttttatatacatgttcttaacgatctaaaaagcaaaggctgaaaaatgaactttgataaaaaaaattgaaaattcaaaatttggctggtaagtataaacatgagcaaaaagatagggctgcatatgtcagttatcttaaacttttatgaaaggatgttgttagttcttttggctgggtggtggccattagggcaaggatgtgtcatggtttcggagtggaggatttttttaagtaacttttaggagtttaataagttcgtgtgaaaattttgtaaattctttcgatccaaagtagcctatgagagataagtgttccaacactaattctcagcttgcattttatgtttattaccggcttcccttttgcctttaacttgtcccccatcgtcctgatttctcctcgtctgaaacaactgggatgtatctatacggtggttctcttttatgctatatcatgataaaatccacatattgaagtgtgcgacaaagtttaaaggtgcacttgcgtagttgctaaacaatacgtttcatgttgctaaataatacatttcacgcaaaaaatttctatatataagttactttaaaatattaaataaatatatttttaaaatttaaaataattaaaaccaattaatcatgtgctaataattttttcgtttcatgtgcccacacataattagggctgtcaacgagccgagctcgagcaagctcatatgcttaggctcgagcttgacacagactcgagccggctcgagtcaagcctgttctaacattcgagtttcatggtaggcttgagttcggctcgaccgagcctcgagcttgcctgttgttagcttcgcaagtcacggggaagaaaaatgaaggacataagctttcgttgggagggatgagtgatggagaaagatgaaggcatttagtgtgccatgcagcattttgctgtttgatgtgagaggagcggccgctagctattctcctgtgggaaagcttggaggaaaatttggatgagacaactaagggcctgtttagttctttagtcagtgaaataaaaatttttgggtgtcacatcagatgtttgatcaaatatcggaaagggtttttggacacgaatgaaaaaactaatttcataacttgcctggaaactgcgagacaaaacttttgagtctaattaagccgtcattagcacatgtgggttactgtagtacttatggctaatcattgactaatcaggctcaaaagattcgtctcgcaatttacatacaaactgtgcaattagtttttctttttatctatatttaatgctccatatatgtgtccgaaaatttgatgtgatgttttcacgaaaagtttttgggaactaaacaagccctaacagattagcataagggatggcaaattgtacgtaagcccagcagcaaaagctcgtcgagctatttgagctcggctcgagaagcttgcgagcttcgtgataggctcgagctcagtttaataataaaacgagccgagcttgaatcaagcctaaagcgagccgaactcgagtagcttgcgagtctcgagcttttttgacagctctacacacaatttttatctaccgctatctcaaacccagcttgccaattgttttgactggttacttcataaaatcatatattcatgaaaagcttaagccagcatggaacctccacatagaaagcatggtaaacagctaataggcatgatatatttagctttccttcaaaattaaataacctttacctaaaaagatgctagcatggaacaatcataaatatttttttctgagagggaacaatactatttctgaagtcaacaaaagcaacaataggagtatcagaatttcagcatcatgggttttatttagttaacaaaacaagagtttcttgtgaggacaaaatgggaaagataacaacactacatagcccaacagtgacaaaatgggatggacaacagtggcacagttggaagttcaaaccgtttcccaccaactgcggttaggaaaaagggtgtgtttagttgattggctaatttttttttaagtatatgaacacatattaaacgtagattaataataaaataaattatagattccgcctgtaaactgcgggacgaatttattaaatctaattaatttgtcattagcaaatgtttattgtagcatcacattgttaaatcatggtgtaattaggttcaaaaggttcgtctcgcaatttacatataaactgtgcaattaatttttcgttcacatttaatgttccatacatgtgtccaaatattcgatgtgatgtttttggaaaaaaaaaatctaaacacggcaagggtccgacggaaatttgcacgagtatttttcaaaacaacccaacacagccgaaatattcacacataattcgaagacgtgtttaactagcaaagggaactggactgtaaacaattactcattaattcgagggacttgtacgcaaaaaagctaaaaaattgaactaaccatagttagctaacctcgccttccacagaacaaaccagggttgcgcggacgcgaacaccaccagaccagaccacctcctcctcgagcttcccctcctccccctctttccaaatttccccaatctcgcgtcgcttcttccccgaattccccaacctcgcatcccgattcctcccgcggatcgtgcggcgacctcgcccaaaatcccccgccggattggcctcgccgatggcttaattggcgatttcgactctgcaatggaggcgcagtggctcgccgagtacccgcaccagggcgccgacaagcggccgcggaagcggccccgcctcgcctgggatgtcgcgcccccgctgttccagccccccaaggtataatccatgcgctatgtgctgcgtcgatccggtctctctcgggcgtgtgggttgcggtggtagtttttggctagatctagtcgtggtttcgctagatttagagcggggcggttcgatctgggtgtgcatatttgggaattggggatatgctgcgctgttgcagaggatcatcgatgtgatattgtgaatttgtgggataggatcggagccagttgctgatcgaaagaacaatatggagaaaaggggcaatctcacgacctccatgtgcctaagtgctgccaaatttatggaacttgctaataaagtttgatattctgtcattatttttgctaatcgatattgttctcttttggtgggacacaaccgttacttgaggtatttgtccattcagtgctgtcaaacatatgggttacccggtgtacttctctatttaggactatcaaacaaaacagatagataactttaatggtgctaagtggggtgtaaatatcattgaactttgaaaacacaggagatcagtatgcagttgtttctattcatttagaatttatatgcttgttaccaattttgatgtatatggttaatagtaatttacgtggctaattatttttgtaggcaattcctatgctatattgcgggcaggaactaatcaatggaaattttgcgaccgcttttctgccaccgccaccaatctattatacaggaccaccacgcaatctttcgcctccctggaggccagatgacaaggatggacactatgttttcgcagttggggagaaccttacaccaagatgtatttttccacaactcagtattatttattgcatagggttattgtttttgtttgcatttctgatcgcttgcttggttagactgttaaactgtttttcttctggagtaagtttatcttgccacaattgttgaaatactggacacagaactttcattttgtttgatatttgggacttatgtagctgtttaatgattgtcagttactggttaaatgcaacaccgtgtttcaaccacctaattatgggttgaatggcatttcaagcctcattaaataaccattcattatttacagtcaattaaatcagggtaaaatgtttgcatacctttgttcgttgcccaaataacttctgacattgtgtaatggtcgtgcattcttgatatctattgccgttgtgttgtcaactgccctgcatctctaccagctgtactgaacttatgttttgttggcgatgcttcttttggttgagataattctgaggtttaacctttgttcttgtctatggctttgcagatagaatacttagcaagatgggtgaaggtcagtgtgctcctccttttctaaatttcaacatttcattttataaggaatagttcaggataaatgcttatgctgcaaaagttttgccctttgtacatgttaccaacaactacctttcttaatttgtgttgcagggacttttggacaagtcttagagtgctgggacttggaacaccaagagacagtggctatcaaaattgtgcgctcccttcagaaatatcgagaggctgctatgattgaaattgatgtgcttcagaggcttgggaagcatgattttactggtagccggtaagcaaactactttcgtcattgctaagtcttgactctttattgagttgatggatttgcatgaatggttctatgcctgcagctgtgtgcaaatacggaattggtttgactatcgtaatcatatatgtatagtaagtacatgtgcatcaagaaggcttcctttcatgttttggatggtcagaatttaatattgaattactaactttgtcaggtatttgagaggctcggaccaagcttatatgacttcctccgaaagaatagttatcgtgcatttccgatcgaccttgttcgggaatttgccagacaaatattagagtctgttgcatgtgggtattcagttaatttctgctgtttgttggttatgcaaattaacgttttgttttatcttgcccctaacagtattattctaatgtttattttattgtaatatttgcagttatgcatgacctgcgacttattcacacagatctgaaacctgagaacattctccttgtttcatcagaatctatccgggtgcctgattataaggtggcttcaatactaaattttgtcattcgaactataatcttttgcaattttatccgttaacacttgtggttgccattacattatgtcaattagtacgagcatacatttattttttactgatttttatattgttttccataaaggttacaatacggcccccaaaggatggttccttttttaagaatcttccaaaatctagtgctatcaagctgattgattttggaagtacaacattcgaacaccaagaccacaattatgtggtatcaacaaggcattatcgtgcccctgaagttatccttggtattaacatcatatccttttccatttcccccctataaagtggaacacataattatattactgtgttttgtttatggtacctttgtttagttatttcctttctctgttttcatttgcaggtcttgggtggaattattcatgtgatttgtggagtgtgggatgcattttagttgaactctgctcggttagttcacactatctatacctgagtagttccttgattttctctatagcccagtgccggctccgcgaatttgcagtgcttcctattgatatgttgcctctttgattttctctactagggtgaagctctctttcaaacacatgaaaatttggagcatttggctatgatggagagagttctaggtccccttccaaaacatatgattgtcagagctgagtatgtatacaaggtcttcgttatagtttcatgatttattataatctaagataagatggtttacatctaggcttaggttgctgctgagtttcatctgaagttctttcaaattatcaatcacttgcatgtacttgttacttcttttttacagtcgccgtgctgaaaagtatttcagacgtggattaaggttggactggccagagggggctgcctcacgggaaagcctgaaggcagtctggaaattgcctcgtctgcaggtactttgttatctgatgtagtcagtatgttcctcttagcattttcccctctttgccaagtgtcgctcataggtggtatcctcttgacactcgaattgtgctaactcatgcagaatctggtaatgcaacatgttgatcattctgctggagatcttatagatcttcttcaaggccttcttcggtatgatcctgatgcgcgcctaaaggcacgtgaagctcttcaacacccgttctttacaagatgccacagaagatgtggttactgagactatactgagattaaaatgctcaatgctgtatttcttcattttgatgtgtaagaaccacccaaaaaaaagtgaagatgttccacaaaaatgaaatgtgctaactcgcattctgttcgatgatgtgcaaggtaactgttgtatatagacagagttctacgactgccgatttattttaactgggagatatttttcaattcttacaagttcctgtctttaaacctcacattttacttcatactaatttttgcaagactgcccagtactagcaggtagcatgcagaaatctcaacttggtggagtcaattgaggatagagggaatgccagtggctctcatgaaagattggtacactgtatttgatggtgagctggtgatataaggtgagcattgcattctgaccatgtcctgtttggtgtggagataggcttatcaatataattttatgtgcatttaggatctcagtatttctcgtgaaaattggtgatggcctgttcacttgaccttcatgtccattctattttaccttgaaatgcatgattagccctggaaactaaccggacgttaaagttacaccctggtgagttttgcttgtgactggtcatatttcttaaaacaagtctcgggtgttggataaaagtttggtaattaactgagcttttgagtctgacacttggcttggaaaggtttgcgacaactttgaaattgtggacagtagtctaaatctcaagatgtgctcaactttgaaatattgtcaactgtgactaaagtccagaatccttgatagcagctgatatatatctaatttacctgaatataccgtaaagtactggctttaaaatcttactggttcccatattactagcagccaccaagctcttggattggagatgtttgttagataaatccttgtgggttttgagcttaaaactatactcaacctgtgtctatcgtttgcgccaggtgagcttgttcttaatatcttacaaaagtcatttcctttatcaaactttagtgatgtgatgattgtattcatctattgcttgtttcttctttctataaaggctcattactcaaaagttatcttctggcaaaaaaaaagactgttatttggtctgataacatcttattggctgctacaatatcttctttgacaaactgagtatttgaaatctgctggaaaatgttttacaactatatttaagcaaggacgagtattttttttaatttatcgttttcatttttgcaattgagtgaaactaccgttgaaggtaatttatcaacatcgagtgtcaacactagtgaaacaaaattagtccggcttgttttgttgattaaagatgaaatcattctataggcaagatagactaaccccagaatgctggtagtttaggctcgttttggacatgcgaaagattttactcatcgaaggtggatttggagagctgctgcttcctactgtgaatggatgagcagctggtaaatgttttactcattgggctacgtgacgtcagcccaaagatcgcctccaaagctgtagcagcgggtcaattgtacaagagcctgtaactctgtaaggtatgatatactaacccttcggaacgggcgccaacgcttccatcgtcatgttacatgagatcgcgttcgaagacggcgagcagcaggtttgatcacaggtttcgaacctggcattctcgtatagtcgtatttgcttcgatcatcatatgttacagagatcgcgtttgtttgaagacggcgagcagcggttttgatcacaggtttcgaaccaacaaccctgtactaatatatactactgcatgtgttctttcagcgaggtaggttcttttttctcttgttgaccgatttattgacgtgactcccattctcccaccaaacccgagaccctcaattttttgtttcttatgatcttcaattatttggttgcctccgtgtccctgatgagtccctttctccctgagctcccccgtcaatatgtggaatatactaaatcgtgatgaacgttattcgccaggttcctgcctttccattcggagggttcacgtctcccgcgacgaatgagccaggatcattacaccggcaaacgtgcacattccgacgaagagacgtttatccatcggtagcaaggcgctgctccggctgcctggttgctgctgcttgtagacggtcgtgggccaagcagggacaacgactcctcctgtggattacaggattgtggtagctcatgcaccccggtggcgataagaccgtgctcgcgcggtgaaaaaaacggcctgatcggcacggccaggacgactccggctgctcccgcccacttatcccagcggcgaggcgaggcagcgtcatgcgatgatgcgatctgctttcccgtcccaaccgtgtggctctctgttgcatcattcgctctgccactgcctccccatgcgtacgtggctctctggtgccaggtgcgtgcgtcgtttgtgtggaagaaacacgaggacgatatggtccacttcgcttccagtttcgacatctttttgttggaagtacacgcacctagccgctatccccgggagacgaaagctacggcgatctcgacgcgggaggtgactccgaccacaccgcgcgcttgtttcacgtttgcaagtgggcgcacgcgccgccccgatcagtcataactagcgactctcttcttgaccccaaatgcacttgagctctatagttgtttttctcgaaagttcatcttaaccgagtaatcatgttctcctacataggctcgcaccagccgtgtcatcagctatcaagccaggagccccgtccacgtttacaactgttcgtcgcttcatcagtgcaacttggcaagacagcaaaatcagtgagaggggttgctgtgactgtgagagggattaaatggatctggtaaaggatggcaaataagtagttaaaatcccccgcaatcagcatcggccattttcctgatatgtgtacgggggacagagagaggcaatcaggcgaatgcgtttttaaaccggagaagggggccacatttcctactgcgctgaaccggatcctctcggtatcacctcgcgccacgcaaccgcggggatccgtatcctctcaaattgtgcaccctccacctgtccgtcctcctccgtaggccaagtgcaccgccgtccttgtcaaaccaaagaccgcggcgatcgactatgtacgtggaaaacaattttaatcacttatatgtatattgtatgtcataaatagttataaaagaatttatttaaaaaatcaaaataaattgacatataatatgtcactccaccgatatacaagtttaaactcgactctataagttatgaaagcataaaaaattaagctctaattaattaatcttttgtagaagttaaattttacaagtttaaactcgactctataagttatgaaaagttatgaaagcataaagaattaagctttaattaataaatttttatagatgttaaatttaaactcgtatgtatatcgaatgatatatttcatatcaattgatttttattttaaaaaaatgtatataataatttaattgacatgtgtaataaacgggctcgacagccaccgagacatggagtgattataatcaatctcccgcggtgtatgggctcggcgcacgcggcctaaccctccccttcctttcattccctccccccgccgccctcttgaccctcctctttaatcacgagacccgcactctttttttgcgtcgctcgagcgcccgcgttccccgcttcgccgaaactaccaaccgcctcgccgttctcctctccccgtggcgccgccgcgccgcacggcgggagggcaactgaccgagggagactgcccaccagcgtgccgcgcgccgtcgcctccggctccctggttcgtggaataatggcggcggcggtcgcgggcggtggggaggagggggaggagctgctcctgctctccgccgtcgaggccggttccttcggcggcggtggcgacggtggcggcgcgggcgcagcggcggagaagtcgtggcgcctcaacttcgacggcttccgaccgccggaggtgcagcaggagaggcggccgccccgcgggctccaccaccactgcctcggcgtcctatgtacgatctctctccaactcgccgtcgcgcgcttgctacccttgtaccgtgtgatgtttatggtcttatggatatattgttgtgttcgtatgcttggttgcttgatctaggctttcattcgtttgccttttctcgtgtgttggcaacatggttcatttgtttcggtagttgccttttgcaatagatatctactaaagtaacttatttttatctgctttctataaaagcagttccgtttaggcctttataatataaaaaggcagtaactccttttatttttcgtttcagcaactagcaagagctcagctgtgctagtatagatggggattggattaggatgttgacggtagtggtaggctagattcttcgtgtgcaacctttggcagataagaataggaatggggaatgttatattggtggaatgaggaatttgttgtttctagctttctgatattgcctagttgcctatactatcgtgctcatctggggcagggcaggacggtcctcacgtgagctgctctgttcttggagtgcacgtgaacagagttctaagaaaacttttttttttatcagcgggggtggttagcactgagccgagttgtaaagactggggcactgggtgtgggtgactgacagcgtgagaagggcaccaggtgtcttagcgttcatgtattgtcacaattattttacccttttatgcaattttagaggttttgttctggttaacaaagttgcattgggcacaaaaagttgaattaataacccaatcatgtcatttggccgcactcaacatttggggtttggatatctagtagtcgtttctctcccgtattgtcaatcactgctttcccatggctatagaagtagggagtccttgtgggcttaaagtcgtggtctattggtggttgaattcaaggccccacaatcctagtactagtagtactatttaaatcagaattgacatttttatcctgtacatttcaatagctgtagcattttattcagtggttctacatgtgatataatcaatagatgaaatataattaattagatatcagagttatcaggttcactgagaagtggtataattcagtagaacatgtgaagcatacatgcctgcttgctccactaatgtcactatctttcttcatgctggacataattttctgtgattgatgtacgattctatcttcagctcaaggtcctgaggacgtagttgctgaatactaccaacagcaagtggaaatgctagagggctttaatgaaatggatacacttactgatcgtggttttcttccaggaatgtccaaggtatgtttgataagcttttctgttgtaacagtagggaagacaaattgtttaacaactgcattgcaacactgaacataaatttatttgcctgtaggaagagcgtgagaaggttgctaggagtgagactttagccatccggctatcgaacatagcaaacatggttctttttgctgcgaaagtgtatgcttctgtgagaagtggttcacttgctattattgcttcgactttggattctcttcttgacttgttgtcaggatttatcttgtggtttactgccttctctatgcaaacaccaaatccctacagataccctattggtaaaaagcgtatgcagccactggtgagtcctatcacaagattaccttcatgtttgccatgcttattcttcttactgtaatttatgcaattgattccaagggactcaactctcggctattcatgatgcatagccagttactccctgtgatgttcttttttccgcaaaatgaaaagaaaaagtggaaatgctccaggaatgaaaagaaactaaactattgcaaacattcctggcagatggaccatagtaacatgcggaattttgtgttttgaggattttcatagttactagaaatcacgttcccaatttcccccagatatctcttgctcttaggtcaatgctactgtatcaatatctttgctactccggcagcagacaatttatgcatggaaatatttatgataagtccttcagtctaatttcactaaatgatcgagtttatcgcttctcttttcacttagtattatcagtcatacacttttaagttccaaatttcaatatgttgactgttccatcacaatatcttcttcagggaatacttgtctttgcctctgttatggcgacacttggccttcagatcatcctagaatcagtacgctcgttgttgtctgatgtaagtctgctgatgttttgttggccttgaactcctactctcattttgcttttgaccagaaactttgcctgaggatttcttttctagaacgataagtgtctttgatgtttgttggctttgaaattctgttgtagcttgccatatacctttctgattgctgaacttattgtcttgttctccagggggatgagttcagcttgacaaaagagcaagaaaagtgggttgtggacatcatgcttgcagtgacattagtgaaacttgcccttgttttatattgccggacattcacaaatgaaatagtgaaggcttatgcacaggatcatttttttgatgtcatcacaaatatgattggtcttgttgctgcactactagcgacttatatcgaaggttggatcgacccagttggtgcaatcatcgtaagtaccaaaaagttttctcctgttccattgcagtagtgtaaaactagagttcaagtaaatgctatatttgatctaatcgttaatttggagctaggcacatcatcctgattgggaattgactgggaaaagtaactagtttctgccaattttccatgtatcatgatatattctttcaaaaaaggaaaacataccatgatgaaaagatcagctatgactttattgtaaccagagatgcaaatcctggcagtaccagttactgccatttatccacgagctggtttgttcgtactggccagaacaacttaaattttaatttggaatacacattttgtacaaccatgcatagtcatattcatatgttttatgaacaactacacattagctatatcaaaagtttgaatccaaagttttgaactaaaaaaccggctcgatttgttatggatgttacaggtttttgaattagtgtttgattttgctcttttgtccggtaaaaaccagtaactggcagttaccggtttcttaaagggaccaatatttttttttccttcaaaactggtgtccataaccttgacagtgacttggtttaaaagagagaatatttctagtctgcctgactaaattcctctactgaaagtctgatgaaatagcttccagtggtttccatcgtcctgggtgtgtagtcctttgcaacgtccaaacgtttcaaacatgagaattactcaagaatcttgtattccaaacgtttccttaggtttttgttaagaaaaacacgctgtatttcagagactactttctgttttctcgtttgcagctagcaatctacacgatcagaacatggtcgatgacggtgctcgagaacgtccactccctggtcgggcagtcagcctcgccggaataccttcagaagctgacctacctatgctggaaccaccacaaggccgtgaggcacatagacacggtgcgggcgtacacgtttggctcccattacttcgtcgaggtggacatcgtgctgccgtcaagcatgccgctgcaagaggcgcacgacatcggcgaggccctgcaggagaaactggaacgcctgcctgagatcgagcgagcgttcgtgcacctcgactacgagttcacccatcggcccgagcacgctctgtcccatgaaaaatagccagacgcaggttgcaagttcgcaaccactggtattaagtttagcagcagcaattagtttcagaatttctggtgctcgtcaggaaacctgcgggtgtatgagattttaattctgtatactggattggcgggtgtgacagtgccaaagccgtagattgtgatttgtaactacttgttgtagactataggattcttgactgttaaatccgtcatctcgatcatctcgtgtagtacaatttatactcaaagtctagagagacatatgcctggtaattacaggctcacagccactttacattaatatacggtcttctgctccttcggctacgaatcatgagatctgtttactcggtctatatatatgctactctactgtagaatccattaatctgcacgcatgtgtgcttgtgcgagtgtggtgtttgtttgtttgtttgttctactgcttagcaatcggttgattatttcagtttccatgcatggatgcaagttaggcgggagtaacatgcatatgcataaatacatttatcacacgtatcatacttgctagtactctagaagaatgagcagttcattactccactcccgaactatgcaagcagatcataacaccagcattaatgatgctactctgttctgcttataaatggaacgagaggggaattacttgatctcatattgttgattttgttggattcgatcgagatggcagggtgccgtggccacggattcggacgaggccttgcagtggccgtggcggcaacagtgctgctgctgctgccgctgccaagcatctcctccctgcagctgcaggccgtagcttcgtcttctgctgctccggcaacgacggccacggccacggcgacggacaagagtaagctgccgttcatgcccgtcccgacggaaccattcccaccttcgccgcctcacggccaccgcctcccggttgtgccgccgcctaagcccaagtcggcgaacagggaggcagcagcagcagccgccgccttgacatctactccttgatctactccgatatcgcccttatatatgttcatatatatcatcgattgtctctttctccttgtaccaataaatcaataatatcgcgtttactgtaataaatctctctaatccgtagtggacttattcttgatcattaacgcacttatcttgcagcaaatatcgttgaagacacgcatttccgcaagaacagtaggaaaaacgtaagcacgtacgctgggccggaatgaatagatggccagtttcttacatcagatggcctggccttaggcccttagcccagtactcctacctaagtgttgcattaaaaagcctgtatagtcctactactttttttaattgaaaagaggggggggggggggggggcaatctatcattaatcggattgttcactttcagggtcgaatgcatctgtgcatggttccgccacagatctttaaaccgtgcatggttgaagagcgccgtaaagataaacggatttgttataaaactatcgccagaattttttttacagaaactttcggggtgggtcatcagatgagtgttaagatttgtgctagggcatggataaaagaatttcacaccacatgcgtgaagtgggaatagacctagggatctcatggagatggaagcctactagtcacctaccttttcatgtttgtttcataacgagttacatataattacattgcagttacacctcccttcaactgacgcattatgtcgaggggaggcatagttaaacctgagataatacagtgtggtaagaaataataacggtgtgataaatggcatgagtgcatgacaatagctacagagcatacgatgatgcatgtctagccccaaaacgattaattatgcttttttttaggacacggttaattatgcttgggcggtatataagttgcctagggcacactgggcaaaaggttgatcacgattgctatacacaagaacacatagaagcttaagtagctccagacttatttgcacaagcacttgaccacttgtaaactatgatatggattggaatcctaacaaccaggttaaaacactcacatcattagtccgtacgctgatgggctgatagatcagtcctagtggaaataaggtctatttggaagcctaacattatgacaggaagcagctgatgagaattttgaaaaactatgatttccgatttgtatttgggttcactttcatgattctacaactacaaatttttagaatctagattaaaatctggatattttttcttggagagctgtagattttaggagaagcctgctaagctcccaaacagggtcttaatcaagcagaaaatgttgcaaatgtacggagtactcctaccttaggtcctttttagtactacatcgatccatctcaaaatatagctatttctagcacaatatcttgtcccaaaataaagctattttttcgtctacctcctcctctcaaccaatcacaatcattatctttcatttactttatttctccaaccatacccatccactttctttatactcgtgtcaacctaaaaaatacttactcccttcgtcccctaatataagggattttgatattttgcttgcactgtttgaccattcgtcttatttaaaaatttttggaattattatttttttggcttactttattatccaatgtattttaagcataacttttcgttttctatatttgtagagcataacttttcgttttctatatttatacaatttttttaataaaacgagtggtcaaatagtacaaacaaaatatcaaaatctcttatattatgggacagagggagtacattttaaaacagaggaaatacgtataagcatgtgaagcacgcacgtcaaaacgtcgcgcgcggccgacagatcgaccaatcgacctaccttcctaccgatacgcggtagggcctgacaaaacaaacaccacagcgcgtacgtacgcatacgcgtacgtgtggtgcaccgcagccgacggcactagcacgcaacagtacgtacgtagacttgcacgtctacaccaaaccggcggccaccaatcgatcaccgcgcgcgcgcacgtacgtccacacacgcgcgctatacacgacctagctactgctagcttgcgctgcttcgccactctctcgacgcacgtgtgtcctcgaccccatggcgactccacgcgcggtccagtagctatagtagtactactagctactccttctatctcctaaaataaagaattttaatattttacttgtactgttttatcattcattttattttaaaatttttagaattattatttattttatttgtgacttactttattatccaaagtactttaagacgagtaatcaaacagtgctagcaaaatgacaaaatctcttatattatgagacggagggagtagtattaagagcaaatttaatagtatacccatctactgactttaaatcatctatagtcaattcatacaatagttacttataaaaatatgctacataattaatacatgatcctacctgtcatacacacatatattttgaagtccgtactatagtaattctgtagcccgctgtttttctctatactattttatctttgtcgaaatatgtttatagttgttttatagtctgctactaatgtacctgcgtatacctgtgttgtgtggccaacgcggcacgcgtctcgctctcgctctcgctccccctcggtacaactcccaagtggctgacgacgatcgctcgcccgtgcgtgtcgcgctcgcggtcgatcgagtacgtacgccaataataatgcgcgcggtgtgtacgatccggaggagagaaaaaaaacccagccagatcgcctgtactctgacgacgcgcacaatttcaccttacgtttgcatcaaggcctttgggagaagcacaactcctcgtccaggaaattatacatacatggactgcatcttttacctacaatatatataaaccatgccaaaatttattataaaaatatatttaattattaatttaataaaactaatttggtattatatttgtctataaacttagtcaaacttgaagcagtttaactttaaccaaaatcaaaaacatattataacctgaaacggagggagtagtaccaaattgatctttgtgtaccttgataactcccttaatttttgaacacacgtttaactatttcttttatttagaaaattttgataattattacttactttattgtaatttattttatcatttaaaaatacttaagcatgatatatcctacgtatatgtataaatattttgaataagatgaatgtgaaataaataacggcgtcatttacttaaaaaatcgaccgagagagatccatcgatctttttactgacagcaacaaggtagctaggcactcgaatgtgaatatatgtgtacacacgtacgtcatcttccggatgcatgcaacaccaccggctgaactagacgatggctagctgcgaatccgaatcttaattattttcggggcaaaacgtacataataacggctacattactactatacgctatgtactatgaacagctagatgtaagacagtacgaggtactacgacttgatggatatcctactgtacaagtagccccctctctcgtgggtgccatgcatgcacctagtcgtcgtctccgcctgatctcttggaaccagcagcttcctgtgaagaactactgctcttgctctccgctggttcctctccttggcccttcttgtacgtggcgaagaactcgctgttctccttctcaagctccttccacactgctcacagacagcataatcaagaaaaaatattgaaaaattctcgacgaatgagcagatatcgtcatatagaatacggagtattcatcttatattcgtatttcaaggggaaaaaaagagacatgggagtttttctccgatggccaaacaaattaactaaacgcatgcagcgtgcacaatgtaatgcattaattgatgaaagccacagcttctgcatgtgcatatgcaccgcacagttgcaatgcaagtaataaactcctaggtaaatagtacttaaaaagaaaggtactaaacatgtttagccatttatgcaaatgtggcgtgaagctataaatagcgaattaccggtggaggtgatgacgggcttgatgttggcgtgcttctccagcgtctccatgcattcctccttgttcatgttgtagcagatgcacttctcgatcagatgctgcacctgcgtgcaaattaatcagcatacatctatacattcatcagaatgaggcatacatgcatctcgcaggccacaatccagatcaagctagcagaccacgtacgccgtactaatagagacgccacaatagacgtaccaatctgatgtacgaagccggcgacgagtcgccgccgccgccgccgccgccgtcgtccatggccgcacaccacgcaccactcaccggtcgatcgatcagctcgatcaacgaccaaactctcggatcgattgaggcttgcctactcggaagatttataagcgagagagccttgcagctcgctaatggcggatcgaccggtcgacgacggcgagtagctagcgatcgatcgatggatcgatggagtgatcgaccaacgagagcgtgacaagcagcggggtggaggaggtagaaatagggggggatcgacgatcgagtggggacatgtcagcatgtggggcttgctcacgtgggtgccgcctccccattcgcggagaggcggtggcgggggattttgccgggcccacccgccgcactcaccttacccagtcccctgcttttctatgtggcctgattttgatctcgctccctgacggtcagttcgcgaggtaattaattatgcacgctcgttaatttcaggccgtccgatgcatgtggatggtgacttgctagccagaagtacattggaattggaattcaccgtgatcaataggcatacgtacatagacatgcatgactatcaccgatgtatcttccggttcaaacagtggatgtagctaacgtgtacactgcaggatgagatagtaccaaaatagtagtgacctagtagcatcaaattaacaagctgcatatactaataatcaagaagcgactccggttcggacgcccgatgggactgggagggggttaaaattgggccatgacgtcagcgtcacgcatgcgtacaaaactattttaaatttatttttctcttaaattatttatccaaatcatgacccgattgcaccattaaatttgttgcaattaaatcttcaaaacaagaccatgtgtattctgatgaaaaaaatttagcttattattgaattatttttaaatgttgcacgatgttccaccaggtatatcggaattgtttcactaagtagatcgaaaatatttcacttgtttaaatcggatgttgtttcaccttatataaaaacaatatttcagcaaatagtaaaagtatgtttcagttcactgcaacattagatctatacatagtgaaacattatgagtgcactaggtaaaacattttttgtggaacaaattataaaacaaattctcttaatagagggttcccaaaatatgtgggtgatttgttgcaatggagtattttagttcactgcaacattagatctatacatagtgaaacattgtgagtgcactatatgaaacatttttggtggaacaaaaaataaaccaaattcccttaatagagggtttccaaaatatgtggatgatttgttgcaatggaatatatggtggagatacatggtggggccaggaggagacattgcgcgtgaggagggggaagcgcccgatccggctccccccgcgccggtcgcccggcgttgagcatttacgcaataaccatataatatctttgtttttaatatatgacaccgtgacttttttgacaaacgtttgaccatttgtcttattcaaacttttttgtgcaaatataaaataatttaagttaggctttagaatatttaacgataaatcaaatcataaaaaataaatgataattttatattttttaataaaataaatggtcaaacgtatcttaaaaagttaacgacatcatgtattaaaaaattgaggaaacatatagcttcttcattgctactaatccgtacgtgaccaagcccggtacaactcctgctgatagtctccatttcaagagagaaaacgtagatgaacagctttggggacagctatgtcgtaccaacttacaggtaggagtatactgtctacgtactaaaattcttcatcgtttacccactaaagaggaatagaataagcacaatttggttgcgcttcgctgaatttcctaacaaaaccggaattacggtaagtattgcaatcattcacctgtcgaagatggcaataccgtaacattcagtaaatctatataaaaatcacaaatactcatcacatcatacactgtactactgtagcgtatgccactatgcatcgatatctataatagtaatatgtagtatatatgaggtgcaaatcgagcacacacatataaacactgtagcacgcactgttgataattaattgtccacgatttgattatacaactctccggaaaatttgggccaaatgtggccgagatttaaggttaagctgctcccggaatatgggagtgcgccaggtcagccgtgcgtgctagtcttcatctagcttgtcagtgagatcgtgagccacgtgtcctccatccattggctgcccaaattgcatcgtagtacgaattgatcggccggccatccggcggcccacgcccataccgatacagtgtaccggcacggtgcgatcaaattggtacccgttttgtctgtcttgattcagccataattttccgagcccaattttgatcgtccgtcttattcgaaactttttttaaaaaattaaaaatataagtcacgagaaaagtactatttatgttttatcatctcataataataaaaatattaattataaaaaattaaacaaaatgaacaataaaagttgggtgcaaaaactgatggttgcacttaaaatgagacggagggagtatcaaacggaccaatagcgaaatatttcctctgttccatagtaaaattaactcctttcgtttatttcaaaataaatttatttttaaagtaatcattgcatcggagtttgtgaaagtagaaaataattgtattgtgaataaataaagtgaagaataattgtattgagatttgataaagtagaggtattgtaatattttggttttatattggttatatgaaacaggtaaaaaatgaatttggatagtacctctctcttcgattccccatcgatcagaaaaactaaagacaaaagagaccaacctccctagcttcctcgatcaccgggcgcagatgcaataatcatcgaatccgtgacacgaaaagctacaaatggccaaatcatgcaaagcatggcccatctactatgctcgacggaacgccacataaaatgtgtcgccgcggcgagaaaaatatatatcgacggcgactaaagagcaaagaggacttgtcacctactgtgtgagatatttcgagctccccctatccacaacggaagatggcgagcatcacagctcgcaaaaaccgatcaaatgtggatcacaggttctcgatggattcaccagctaagacgcgcgcctcgcggtctcgagtgcaatgctgcgactgccagcgaggtgcagtgcacctggaacgtcgcaggtacgtttctgccggaattttggcgttgatgagcaaccacttgacctgatgaccacaaaagttaattttggcagggccgtgcgcgagcaacaaggcgtacgtgtgcagcctgtgtgatgccgatcgggcagggtgtcgcgttgcagggtgaattggtgtcatggcgtgcgtcatttccctcttggggcttcgacgacgttgttttcgccgtgatctgactgaaccacggcaatacgtgaggctaagcctccagtagccgagtgctgcctagtaatctctagcggtatagtgatggtcagaaattagcaaaatatatctatatcgtctattgacaaatttcagggcatttcgctctacgattcaatgaatgtaggaatgatcaagaatcgacatggaaatgtcattattatacggaagaaaaagcaggggccagcaaacagcgacgctggaacggacgcaccgatgtgcccctctgcataaaacacgtcctcaaaacctcaacgcagatgaggcgcaaagatgccttcgcatcgccgcggaaaaattttggataaacccaatcaaatagggagtataataccaaccacatttcaaagaataagatgataagcagctggttaatgaaaaaaatcgacagatgacaaacggaatctggaactaattagcatgggaaaccaaaatacacgataattcatatgcaatctactcagcaaggagtaatgtgaacaagcaatatgccgaaatcaagttttcctctagaggttggcgggagtacagagttcggattctacatttccgcataaatcaatccagtgccctaaagaagtcttcgcactttagtaccaagttatcagagatccagcggaatgactaaggacaaatacatcgtcgtacagcaagagatcttaggtgatgtatctttcctgctgctcctgaaggagacgcgccgacgatttagcatccaagtacagaccactgacttcctcaagatcggcctggtaaaggtcatgagttcaccgtgtgtaagatagtaagaataatatcacaatataagtgcaggtagcagctctaggagcgaagaggcgaagaggatgttacaatatatcctgatgaaatgtcaatacataccttgctgatcttttctctcccattagcctttgcaactacgctggcaggtgatagcagctgaatagcatgcctgcaagagattcaagatatacagtcgttcatcagtagcaatctcaattaaaaatgcttatagtagaacactgaaactggaaggtaagaccggtccactcaacatattccctttactcaacgtttcagcttaactatcttttgcaaattgggctgcaggaat

SEQ ID NO: 29233 - DNA, 25279 bp, Oryza sativa
cccactgagagcagtaaactttcaatcatacggataaaataagaagatacctcatcaatgaacagaacaccaggtacaagctctgcaattccttcatcaatatatctgttgaccacctactaaaatgcaatataaacgattaaagatcatacatcgatcctggaatgttcattaaatttaatccagtttcaaagaatgggtgccgctcaatcagaaactgaaaaaccttattgatttcttgccgaagcttgtcagtgatttcagtctttcgtggcttcatcatttgccccataagggacaaaatatcttggcctccttgtggttgagcatttgcagcgtcaaggtcatgaagtgtaacatcctgtacataaatgacaggagaagttttcctatattcattaacttccatataacttaagagccataagcagaaagattgaatgcactaacactgcatatgagaacaaattttcttatacagcagtaaaagaatataatgtttgagagataatagataaaaaggcaaatcatacagcttgacctttgtcagatgtaacaataattaatcaaacctaatgactccaaggattataatacgtcttagtaagacatcaagtcatggatttgataaaatcttagtgtttgtttgttaacctaatgactccaaggattataatacgtcttagtaagacatcaagtcatggatttgataaaatcttagtgtttgtttgttaaccttatgaaattatttaccaatggaggtacaattacaaatgtagacagttaggtgaataagacaaaatcttatttatttttgtttagcagggatgtaagttcaattctccataaaggtgtcagacttggtcgtaatcccctctattcagacaggtgtgatggccacaaaatgcaccatagctctactttcaatcttctaaacgtcgacatttgacactgtacttcaaatttattaaacacgaatacacgatacatttatttcttcgattatcaacaacattaattaatggatagcacaatgcaaagaagagttgactgtgcaaaatgtatgggcaaaaatccttaagacaaagattcatcaaattacctgcactatttcctttttcttatggacctctcctttgggaatcggaacatactcctcagcttcaagatcgtattctgtagcaaaagaatcacatctaccaactcttttcactgcaccactattagcttcaatgtatataacatcacccactgccacctgcatcccacagatagctgatgataaatatgaaacatcttgtgcagaaaatggaagtaacagaaatgaatctcagtaccgagggatctaatcagctccagtccaaagtgataagttatgagttcttacacagtagagtatctgaagtcaatcatgcaaatttctacaagtaacattctccaaagtttgtacgatatattaaatattcaacagaaggcattcttttgaataagaaacaaacaaactcaaatttcaaaacatgaaagaaatgtatttttaaagtctagcacacgacataaggatgaggatcaggaagtaaaccttttcctttattaaagcatcgtaaattgtaggatctaacttcagctgcttagtcccttttacagtcttcagacctatgattacatggctaatgctttttccatatccacttgttgtactctcagcttcttctggcgaaagttcagtaacctaaaaggcaatgaagcacagttttatattattttagaaacagacaatgggaataccgtatcagttatgaatgagtgtgaaaacgtaattcaagaacactatccttgcacaaacttaaaaaactagctaaaactatgtgcttacctctccttcataaacctctttattttcttttatacgcaagcctatagctcgacggaaattttccatcagcacctcagttttcttgacctctgaggaatacacttctgatcccaccataggacagaaggggacctgtgttatgaaataacaagacaacatatcaaccattagatacattggaacttttaccaaaactgaagtagatgtagggcatcaaacaaaaaactcataactattacagacaaaatttatcatatagttcttaggaataaaacaaacaaaatgtacaggtatccaataagttgacatcttatgccagtgatccacaataatttagcctcagaaatcttagcacaaatattttcaaggaataaggaacttttcaccaacaggcgaaaaggcactataacatattgaaccagctagcaacaaacatccaaatctcaaaaaatgctgaaaggcaaaaacatagaccataacacaagtttaattaggtgaatctaaaatctaattgaatcatcctatcaaagttcaatttagaaaatgacaaggcatggatctcaaatacctgaagctcaatataaacacctttgtggagctagatgagcccttgtgaatgcagaattacttatttacactagctaattgaagaatgaaaaaaatcaaacatttcaagaaggcttattatcaagtgtccaccagtaatcctcattgaacttgataaatgggattcatctgagcagctagatgatttaactcattcttcagtgaagagaactaggaaactgaataagacctcttaaactaagcatgtcgtatcagaggtaggaaatttatcccccgtcacacatcataattgtaagtgaaattcggacccagtttggttggtttgcaacctttcgaacctaccattttaccccaggaggatcctcaatctcttcactagcagacaagcgaaattgcaaacttctgccttggaataagcttgcagtaagcatccgttgtaaataacagtgtgtgttcactatggagcctaaatctaacatcctagtttgtagcgtcgagtacaaatctagcgcagtcctcaacggtacgaaatacagcggagaaagtgtagcattgtgcatttcagaagcaaacatttatctccatcaatccaaataccccaacaataatacagtttgtccgaggagaataagttgaagcaccaaccttactacctagctcctgagagatgccgagagcgagggccgtcttgccggtggcgggcgggccggcgaggagcagcgcgcggccggccatcttcttctggcggatcatgtcgaccaccaggccggccgcctcccgcgccgccgcctgccccacgaaccccgaagccagccctatcgccgccccattggcctgctcgatgaaaccaaaccaacaagccaaaccgtcagaaaaaagaacaaaaaaaacacggagatctacgcgaatcaccccgaggctaaaaccctaggagaaaacccccccgcgttgcacggagaagcgcggaagatgagcacgcacgtcgaggccgaggcccttgatgtgggtgtgggtggcgatgcgctgcttcttcgccgccgactgcacctcctcgatcctcatcgccgccgccgagcacgcgccgccgccgccgctgcttgtctctccgaccctctcccgccgcaacaaatttgggaacggcggggagcgctgcggggcagagcgcagctgaagaggttttatcccgatttttttatttgtgataattagttatgcctaaattaaatatttagtaattatgggatgggatttactatataggaaggacgctcttgactctagcgtccaggattggacgctgtagctatgtgcgtccaggtcgggatgttgcttgtaaaaacgtccataacctggttcgcatgcgtcatgtgtccagccaaaatggatcgcgtatttggggtctctgggtgccgaagtctacgctgttggctactagaagtcagtgagtttcctctccattcacctatcactgaaaaaaagatcggcgattgacgttttgtgtccttaattattttctgcgcccctgtatttagctattgaagtgcaaatagctttgccttcatccctttctctaacagactgtatacgttatcaattttgtcaatgtgatgcaatcatttgctctagcttgttactcctattagcgtctagaaggctgcacagaagaatacatatatgctacgggttcagcaattgtgttggctcagacgattcaaaaaaatattcaaatgatatcaccacatatcagaatacaataagttctgaccacataaaaaatgaagcgatatcctttcaatccaatcaaatgttacagcagtattttttagcagattgtgacaattaactagatagtggtatgaatggaattcactaatatttgaaagtagagcactgtaagtacagaccttgagcacacaaataattttacaaaataaatagcaatgtctagttttcggatagttttgatatattgaatgaccaaggcatccataacacatcattagcggccggtttttccaacctgcaaacaaatttatcaagatcgatcaccaatccaaacattgggcccgaggagagggaagccggtgatggcgtttcttcgcgtgccgtggcaaatggttgtggagagcaccgaagagcatccgaaccgagcaggatgaggtgcaccaggttggacgccgcccagaacagcgtccacctttggacgctcttcgaaagtgtgtccaagtctagacgctatagggaaccgcgtccatcctattttcacaaatttaatctgagatttatttatttaatttaaggatcattaattactatgaataaaaaattcggggttttatcactagtcgctgcacagtggggccagaataaaatttagtctgaattgtacgcaaaccatcactgaatgcgtattatttagtttacgtaaattgtctacagaagcggagattatgtgataaagaactaatgatcgacattgccccggacaggagagcaaacacccgcacgcttttgcacagcagatcatttcatgcttctactacgtgctactactacagactggtcgtgttattgtgttgactgttgagtgggagtcgttgagatccaaagtggagcagtttagcataagaccaactccatgtcgcctcttgattacctaaaccttaattttgacagcttaaacaagcacacctcacaaaaaaaccacacctccaaactcccaagcctcgtctacgagtcaaaactgcgcgccgagatgcaagcacaaactcgtcgtcgcatcctcgcccaatcctgcgttgcactcgcgctcctgctgaccacggtacacacggcagccggccgccggccggcgagcaacaaacccacgctcccctcccatggctccgaccagaccatgacgctctacaccaccgtagccacgccggcagaagctgccggcgttccttcgtcgcaacaccccgtcttcgccggccacggcccaatcggccaccactccggcggctggctgcgcgtcttgacgcggccgggagcgctccagcccggcgcggcggccgtcgtcgacgagaggttccacggcaagaaagagttcgggatgccactggctgggaagcttcagggagttctcgtcaccggcctggaggatgacgacgatagccgtattgtggcagtgacggccttgttttccggcgacggcgaggaggatagcatcaggttcttcggggtccatcgcgacgaccaggaagagtctcacatcgcggtggtcggagggacaggacggtacgacggcgccaccggtttcgccgttgtcagagcagctgacgcacataaagctggcagaaatgtcagctcgaactcagttcttagtttcagagtgcatttgaagtagagtagaagaggagagcttgcagagatgcataccatatgatgtaaattaagatgagaatgctcacaggtgtcaagactaaagtactgtactatgttaagcttgctgtactacaatagattggcagttgaacattagtgaactaaggaacatgattgaactgaagagcaaaaaagcgaactcgtctgaatatatttcacttgaatcaaatattcgtattacaattaggagctagatgaaaatttgaaaccaataacagctcctgatatacaaacctatacttctcacaagacttactaagattcacaatgtggacaaataattaactaattctgttctgtctcaccaagatacaaaaaaatcaagtaattctacaacatttatcgtgtatgcagtaaataacgttgtactgcgtgatccagcaggtgaagtgctactgactatatttgcagcatcatatagaatccagatgagtaaacacacattgttttgattactcatccaaaattctttgacggaagtccttcaccattaagggaagaccttccctgagagagacctttggctcccaacgtagcaggtgcttggccttggtaatatctggctttctcatgtgaggatcatcagctgtgttgggtttgaattcaattgttgccattgggtcaattgtttccttcacaacctggagaaggcaaaatgtttgtttatgcaccaattcaagaaaaaaaatctgtaaaacaaattgtgtacaaacctgtgcaagttccaacatggtgaattctcctgggtttcccaggttgaaagggccaatgtgatcaccctccatcagagccatcagtccagcaacctaaaaaataccacaaaagattttggaactttaagactttgcaataggaacataatatcctgcagtcatcgttcaccatttatctgctggagataggaggagctgaacatatgattgaaagcacaacagaattgtcgcacagagggaaaaagagtgcaaatactataagctggtgatttcctgaggctcaagaatatgtcctaatttttcaagtttttccaatgaagtccggactgaatgccttttggttaaaataagctataacagaattctgtgcataaaacacttcatttcatttaggatcacagtatgcaagtaatctgcaaaagaatgctgcctggagaacatacttgaaaagagtggacaacatctgtaactaatgagtaaacacacacacagaaagcacaataagaatactgtttattgcttaccagatcagaaacatactgaaaacttctagtttgttttccatcaccataaactgtcataggctgtctacgcaatgcctacaatgataatcatgtataaactcagaatttcatattgacagcgcaaatgtgtaaccaaaagttaataaaatagcggtacgtgttaaacgaacctgggcaacaaaattgctaaccacacggccatcatctagacacattcgagggccatatgtattgaaaatgcgagcaatgcgcacctgcataataagtcagttagcaaaagatcgtagaatagctatagttactaagatgttgaagtcacataatgctacaatacgaactacagtattgcagcaattctactctatttcatcctaagagttagtgaacaagattatatgttggacacgttaatgtaattgttactttaaccattttttcagtttcatgaataatatagactgaataaaaagtaatgaactaactaaaaaatgacaactaataaagatcatcatcgccccctcccccccaacacacacacccaccctgcaatagactgtccaaaacaaaagaaaaaaaatatctttcaggactaaatggtaaaatgaaacagatctgtcataatacctaaatccatgtaaatgaaaatattagaaccccaaaagtccgcatacaatcgtcatctcaatatgttgtaaacccagcatggaatataagtgggacatatttagattattacctcaacaccaccacctctgtgatagtccatggttaaagtctctgctgttcttttcccctcgtcataacagctcctaacacctgaacaagggagagaagtcagggcttagttaattggaggtccaaatgcaaaggactgaccagaaccaaaagattatataatgtggtaccaataggattaacatgcccccagtaagtctccttctgtggatgttcaagtggatctccataaacttcacttgtgctagttagcaagaaccttgcaccaattcgctttgccagacccaacatattcaaggttcccatgacattggtcttgtaataattgttaagaaacccagatttgataatatacagatgcaacacatgattatattgtaaatagtgaaaataacataataagttgcaaaaaaacatgattggtcaaatatccaggtaaaagacataacggttttatatttaactataaaacttcaactatatattgagttacgatagagcacataaaaagcctttttaagaaaaaaaataaatgtaccttataaaaattcaggtgatctcttttcctaattctcgtacaacagaagctggtttgtgctatatctatatggcatttcaatgaacaaactaatcgaatcctgccaaggattgttcatggaagtatgtttagaaaatgggttagaacccggcctctacatccaaaacggatgtacacagccattgttcatggacgtatggaacaactactactctctgttaaaatcctgtagataaatggcactacagtagaaccggctaccccacatttaccacctgtgcatcacaactaacaaatctatcgcgtcttcctaagatctcaacagaacaaccacttgatattgaaaaaaggaggcaaatttaggatccagggttcacttgaatccaaaccaaccaccaaaagtttcagcatacgagcttgatctggaccacttatgtgctagtttgcttcaagcatatctcccacccaccaacccaataaaaaaaaataaaggagaagatcaaatcaagtcgacatgaatgtaagcaaatcaaaggtatgtgcagatccgggacgagaaggatatgatcgtcttgatggggttgtacttgtagtgcacaggggacgcggggcacgcgaggtgatagatccggtccacctcgagcaggatgggctcgacgacatcgtggcggagcagctcgaacctggggttccggaggtggtgcgcgacgttgtccttcctcccggtgaagaagttgtccaccacgatcacgctgtccccttgctccagcagcctgtcgacgaggtggctgccaacgaacccggcccctccggtgacgacgacgcggcgcggcggcgggcggaacccggggggcacgcccgacgccgacgaggtgtgcgaggcgaaggagaagagcgggcggcggtcggggacgtgggaggacggggagagggagaagaggtaggggcggaggaggaagaaggaggaggcgatcagggcgccgaggaggacgaagaggaggcgctgctcgcggaggaggtagccgacccaggatcggggcccggggcgggacgccttggacgccttggacgccggggcgtgcgccgccgccggcgcgtgggtgggggacgacttgtggagctgcttcatggcgggagagcggcgcggcggaggaggttggtggtggtggcgtgggttgggggaaggggggtggggggtaggagaagaaacagccgaggtgtgcgagggtaatttggggttttcgttttgctccgcgattgttgcgaattgaccctccaacagttcgccctttgttagaaaagcaccgcatttcatgcaggaagtgaggaagaagaccctcttgtttgatggttttcatcccccccccccttttaccggttatattgtcaaataatactctcttgactatgttcgtcagggtgagattgagtgagaaaacgcatcgttttccacgcgcacgtttcctaaactattaaatggtatgttttttttaaaatttttttatgtgaaagttgctttaaaaaatcatattaatccatttttgaaatttaaaattgttaatacttaattaatcatgcgctaatagctcatctcgttttacgtatcttccctatcttctcaatccccttctccttaaactcgtcgcttgttctcgatgcaattggctgcttaaccaaccatatccttagtacattggtgatgaggcatcgtgtcaaaaaaatccaacgacaaaagcgatatagcttcaacagagttgtggttgtagcagcttaggttatttgtaaatgagagaaagatctgaactttcaaccaataccgttgaagctggatatagctaccaaagatgatagcaaaagaggatgcgccctagtggcttgctggcgttgtactttggtaaatttcggatcgtagaagtagctccataggctgtatacatattacaagagataacccgtttaaaactgtcttttctttttgttacatgtaaactacctcttaaaagcttaatgcgatgatatacttcgtgtttattatcgaaaaagggattgtgattggctgcaaatatctaaacttgtttttttttgtcaattaaccatgtgtattaatattttttttatggtcaccttgactcaaaccctgttggatggatcgccacatcactaatgcttccagacaagaattttcatataaaccatgtttgacccaatataaatagttgtatcatatatatagtagtactacatataacgaactcttctccatataactaagtactattttatcgtcatgttataatcaaagagggcaataaccatatccgtgcactaatgttgctatattattgtgctcacccaaatagccatgcttccatgaacattgatgacgagtgttacgtgcgttgatcatgtttttgctttttcttttaaaaaagtgcacgctgctttcgaaataacctctctgaaagataatacagtacagggtgccaaacgcaaatagacccgcgcaacatggaggattcgttggacgcttgacttggaagggttcagaatctctctccccatccagatctggcccacggacggcccgggcagtaggtgcactgttagattcgtgcttgcgtgcctttgagattcggatccgcgagtctgttaaaccgaggctgtcgcgcgtcatcgaacgacgacgatctgttctgaatttctgatcggagacggcgcgtccctctccctcgtggccgcctcgtcttttcgtcaaatcgaagcaatcacgcaaactgccgctccttttcctgtctccttttcaagacaaacaacaaccctttggtggttagcaaatgcacgtcaaaccttcggtttaatttagcgacaccaactccaatcaaccaatcatcatccagtctaaagtttaaccgattaccagtacaaaaatcttctgtcagcaatgtgatctgttccaagctctctgcattctgcatttctctagtgcgcaattcctgatcggaacgagttatttattcagaacaagtttcagtatatcgttttcggtaggacaaatttacagcggacaagcacagggaaactgcaatggcacatgattgacatctctcagaaagtttcaggaacactgcctgcacaatccgacctttcgtccagccaggagatgatgtcagaatagacacgctcgacatcgtcaggaagctcagccgtcagagcatgccacatcccagggtaaagcttgaaagttttgtccctgcctgatgcttcttcgaacagcagcttgctcaccgaaggatcggtcacgatgtcgtctccgccgtgtaggaccaagaacggcagtgtcacctgccaactgaaaatgttaagcagaatagcagtgtccagggagttactgcacatttgcatcagttgcatgtcgtgtgcagctcgaatcgagaaaataaacatggcatatattgaaatacgctgttctaatgatgatacatgctttttttgcttccaattaggaatagagagaaaataaaaccattttcacctcatgcaggttcttctcaatgtctaggctgaccatcaggagttcatgacaggtcttcagtgggagctttcccctgtatatgtacggatttgagcgaacctaaacgcagttaccaacaaagacaagttcagtaaactctgcctttttcttccggccatgcaactaacacatgttagctatacctgctttctcatctctggatctttacaaactttgtcaattatgtccggtgtgggtatgattctccaactaggagccacagcgcacaccattttcagagcgctgaccgcgatcgggtgaggccgcatgtcatcaggaatctgacatcataaggtagcaaacaatcatacgaaaatcgtttagaaaaagggaaatttaggaagaaaatcatgaggtggtataagtaaaaataaagaactctacaggtttcagaggaaagagagctcgttgtcgagccatttcgccatgaacggaccttgcacataggagcaagcaagacggcgccatcccagtaggttggctccttcctgtggaggagaagcgccacgcctccacccatggagatgccgtacaggaacctcttcttctccctgttctccggcttctctgaaaccagcaaccataatttcagagttttgccatccccaaactgcgtgttcgatgcgtttgatttataccgcaaatactcgtgaaaaagtttgcgcagtctgagacgatgtcaccgaagtttggtatgtagcatctctgaccagatgatctaccgtggccttcatgatcaatcccgtaaacggcatatccggctcgcaccaatcgagcggcggtgtctgaatatttgtgcagctgtcagtatttcagtcaggcaagaataaatgaataatcgaaggatggtgttgatacctctcatcgatacgccgcactctgctgcgattcctggagaagaataatcaaggtgaaaatgatcagtttgtctaatcgcttctttgaatcgatttaacacaaaagggaaatcttgttagtagcagtaccatgacagataaagatcagagcttttggttcttgtttatgcggtgtccatctgcaggtgaacagcttgttgtcacgggagttcacaaaaaactcctgtgaaaatcgagttagaaaaagggctggcgatcagaaactatgaaggctaccacggtgggatcgcttatcaggattaactaacctcgtcatacttgatattctcactgtactgatcctgccaagagaaaaaaaaaacaggttgaggaactcagcctgaatcatgatccgtgatacgcaaatgaatatctgaactggtgtagggtgttactgaacgtaccatggccatatgcgtctatgtcttcagatgctttcggaactagcaaacttaacacgattggtgcctacatcgactatgcatatgtatatatactgcttcccaaaaaaaaaaaaaaacgagcaccgcaaaatcgtgagacctgggaagttacaaccaagcaaccatgggaaatctctgcatttttctttccttaacatagccaatgacacgcaacagttttatacatgtgtgtgtaaaagagtggattccttaacatcagaagattaaaaatgcaactcgtctaaatggaactccagagaccataaaaacaacgcgcatgcagatgaatgtctgcggacgcaggtcagaatcatgtggcattatcagttgattcctcatgttgatcttatactactagtacagtatattccatctggattgcaggacagtggcatcggatccacaagtttgatgaatataatatacggtagcttcagaattaagagtttcagacatctgaagtcccatttcgcaatatccatcgtactttgagagtttttacagtccttgaagaaaggaggtaccaaatccaagtcgtccattacgcaccatccaacggttgcaaaggcttggtacctcgcggtaccgcgtctctaggaaagcaggtaccgagtaattttcaacggtggaagggcagagtagtactttcgcatatgaattggaggggaacatcgcactgcttgctatcgtcgccacaaatcgagcaacccgatgcggcagtcggcctcccggcggcggtgaccacgggggaggtggtcctatatggggatgcgggcagagtactaccctatctcctccctcgtcctcagcgctagtacagcggaggcggcggccatgggagtggacgacggtggcggagacctctcggatggtggccgttgttcctcattgtgctaagaggccgatgcagaccgaggcaccgagctgagcttcgccgccgcagcaactgttgcagttgtgcatggaagaggaggtggacgctgcccctgcatcatggtatgaagccaaggccaccagcaggcagcagctacgcgtccagggcaagacgatggagccatagttttttttttaagactggtgatggagccatgggtgaaaacaacgttctgaataattgaaatttctagttgatagataaattggcttattgaacaggaaacatgcatacatactatatctatatcaatatcaagaacttcagatgttgggtttctctcatccagatttttcaacaaggatgaacacttaggcagatttgcccaggttaaattcattggtgaagttattgtggaaacagaacatcacggagctgcaaagaaggagctccaagcaccagccagctcgagtgcaccgacggacagaggttgaagaatcggagcgagctcgacgggccggcggacaagcttgatgatttagagcgatctcgagggcggtgaattggaacgagaacagagcgggcgagagctggcggcgagggcacaggcatgaaggtcacgaaccctgcggacattcccgggggtggcctcgatgcgacggcggcggcgcggcagcctagatgtgcgacggcggcgcggcgcagatggccagcacaaacgacgtgatgcggcagatggaagaggggagaagagggcggctcagaggatgtcgctattttgttagcccaatcatacccctgctaaaccaacggttagattagattggtacctcataataactcgtacctcatagtacctcgtggtaactcttcaaggatgggaaatatgctctcgtacttatcagaaatactgttaccgtaattactatagtaataaattagtaattgactaattgtggatactttatttgatttatttacttcaagtggactgtgtggtatttttactactattttcattacagttgttcatgtgtcaagcagtagtgtcagcaggagcagaatcagtttcctcttcgaggcaagtgtcttccggcagcggaactggctgccagccggtgaagcactccagtagctccttgagcgccattgacgccggctgaacggaacaagactggtagaaatccaattcctgaatcttgaagtcccacagctcatctgccgcagcttctgaatcctgagcagtgcactcctctgcaccgttcaggaacaggtcgccttcagaccggatgaacccagttgaactctggtctctgtctgccgcctgttgcaatcaccatttcaccaatgcaaagcatttttagaagtatctaagttaaaacgttttatccaccattacgtggcgtaacataatttaggataagatactgaactagtacagggttctgaaacgaggaaaatgacctgttctatcatgtacttgaagactttcttcttctcccctgcctcgtaaatgttgcactgggatacaatctgcagcagtaatcaacttcaggttaaattcgtacaattccccgaaaaaaaaaatctcgtacaatgaagttccagcttgatctgatttttttttcaggtgtgctctctccggccaaaaaaaccaatctagtattagatgtgatactttctaaaacaacaaatcagacatacttatgtataaaaaacgtcttatttaatactaggttgggattttgggatggagggagtagttacctgtgactcgacactggcgcagacagcgtaaatgccccagcccctggtgtagttgttgtagaggtgcaccctgccgaagcggacgcgcgggtgcctctgccgcgtgccgtcgaagaggcagtggtggatggtcacccggatggcacggtcctcgacgtggccggcgctgccgccgatcagcacggccttgtcgtgcgccgagaagcggcacctggacacggtcacgtccgtgctgccccgggtgacgtcgaggaggccgtcgccgcagccgcggaggccgcaccggtcgatccacacgtgccgcgacccgggcttcaccgccacggcgtcggcgtcgtggccgcggcacccttccacctccaggttgcagacgatcacatgctcgcactcccgcagctggagccccttgccggacagtgtcacacgctgcccgcggccgtcgatggtcttgtacgacgacacgcgcagtcccgtcgagaggtggatggtgcccgacacgtcgaagacgatccatagcggctcgcgcctccggcaaccctcccggagcgacccgtccccgtcgtctggagatcgagacccatttgctacgttgttagatgcagggagatggaatatgaataggcttgtgtgtgttagtgtacgtgccctcgagggtcgtgacgtggtagacgtcgccgtggaggccgccgatggcgtggcggccgaagccctcggcctgaccggccatgacgcgcagcgaggagtccgcggtggcgtacggcatgaacacgactccctccacggatgccggtggctcgcccccgcactggccgtcgagttgaggaggctccatggctaccgactacgaggaggttttcgcgtcgctatttgttgagtcgcgcgcggggaaacgcctgctgtagtgctgtttactgctggaatttgttgcgaccgggccgtttggcccgtttccgcttttgcagcggcgcgcgcgtttcgggccggcccagacaagccgccaaccggaagtccggaagggattaacacaggtcaaacagagcgttttaggagtttgcagggtcgttgcattgcatccagcacgagctcgttactatctgcatgacgttacgagcattcgatttcaaactatcattcaatctcgatcgtgatgtttttacctcccattgcccggaaacgtcagtgcatttaagcttgtccctaacataagttttcgctgttagatcgtttaatgttcataacatcacatgagactaatcttgaatgaaaaatcagttgggaaactctccccctttgatcaatcttagctaaaaacatcacatcggaatatcctctttgcctgaaaaccctctctaatcttctaggccaaaaaggcaaaaaatcggtcatggcccttcccatttttgtactgtttgatgaaagttttaagtaatatcatcgtgcgagacatccgacagtgcgaagtttggtgtgtcgttgtcacgtaaccttccctcgtttcctcatattcctaccgccggttgcgggtcgtctttttctcgcccgtttcatgggctccctttcatgtcagcatcggattgcgtccgaacaaagtccactcaaactctcaaaggaagatcctgaatggtctccgatcgaagctgtattggctatctgcgaagtgtcattgccggctcagtggatacacacacaggacacgaatgtacaatcactaaccacgcagcaggtacgcaataaccagcgttagtttaagcaaaaaaagggtcgtcgattacgtataatttccgctcgatagagccaaaaccgaacgtgcccataatccccccgtgcgtggatttacgtgacgcgcgacagcgcaattctctcccacttccgatctcttcttccgcttggactcatcgccgtgacgtcgacgttccacgaggaaaaggacggcgtcgaagccaccgggcaacttctcactcccgctcgcgtctctgacaagtgggccccacgcctcgctttcttccccccacctcccgcccggctgatggcccaaaccccaacaaaacctcctccgcgaaagctacaatccaaagggagtcgttaccgtctcgccattgtcctcctcctcctccgcccccacctctctttcctcgtgccttcctctttcgccgccggccgtgcgcctcttaaagccgctccccgcccgaaaccctacctcgggaaccctaccgcgcggctttgacccagggataatcccactactggctactgcattcgcttatctcgctcgcgatgtcgctcgaaatccatgaaggtgagtgatgggaatgtttggacaggtttggtggagtgtgcgtgctcgaggcgctgatttggtttgtttttggttgtttgggcgcagaggagggaggaggtacggcggcggcggcggcggtgaaggtgatgacggtgtcggggagcgggaagcgggggcggtacgtgcggcaggtgacggggcggcacaacgacaccgacctgcacgtggcggcccgcggaggggacgccggggcgctgcgccgcgcgctggacgaggcggcggcggccgtggccaccggggaggggagggaggcgctggaggaggtgcggcgggccgtggcggcggagcccaacgaggccggggagacgccgctcgtcgccgcggcggagagggggcacctggaggtggtaagggagctgctcaggcacctcgacgccgagggggtcgccgcgaagaacaggtcggggtacgacgcgctgcacgtcgcggcgagagaaggccgtcatggtgagatgacacatttagagcaactgttgccatatgtttatctgctgggcaagattttgagcattgacgtatgcacggaactgggactcgatgcaaaagtctgattgatctgtaaattccaaaacttcgagatttcttatgataaaaatttatggtataacttccactgcaattagcaagtccatagagagagggagggataaattccaattaaaaacagtaacagtgtgtgtttcgtaacactaattattgctaggacctgagtttgctagatacaatattgtttctataatctttagacacaaactcatgtctaactgactaccacatattaatcggtgcttcttcttgctgatttttcccccatctgtccatgaatattagttgttcactttcctctgaggtcagtgtacttatgtaaattgttgtgattcaaaaaatatgttagcctgttatttcattgttagcatggcaacttgtaaccttgaatttctggatattgggtttgtagcagaaaactgtgcataattccataatcaaattaaaagttttggtcttttatgtgttctacacattctgaattttgaacaaacctatcactttctcatttatacatgttaacagcgaagccaatatatgcagtcgttcattttctcttcatacataggaacaactaggataatgtaactaatgtctttctccagttcagtgtatcttgatgttatcccttatgtatatagtatgcaaacctctgagcaaacatttttttcttgcagctgttgtgcaggaaatgttacttcacaataggttgcttgccaagacctttgggcctgcgaatactagtccacttatttcagcagctacgaggggtcacaccgaagttgtcaaattgttactagaactagatgattttggattggtggaaatggctaaagataatgggaaaaattccttgcattttgctgctcgacaagggcacgttgaaattgttaaagcattactcgagaaagatcctcagctagcaagaagaaatgacaagaaaggtcaaacagccttgcatatggctgtaaaaggaacaaactgtgatgtgcttagagcacttgtcgacgctgatccagcaattgtaatgctgccagacaaaaatggaaacaccgccttgcatgtagcaacaaggaaaaagcgagcagaggtaattaatcatatttctcaatgttttcattttgaataattttatgtcttcccttgtgcactggcattctttttcagttctgaaggaacatcatacagaaaacaattactaacactatggaatgtttatctttcatatgattacttcatatctagaaaactacaatgtaaaaagaacatggaactctacctgatggttatatcttgttaattgaatgatcaaatatccattaagatttactcttcttctggaaacattaatgtacagtttaaatgaaatcaaataggtgatgccatgtgttttcaccttctaagaaataccttgattagctatgttgttaccccttttagtatgggcatcatccaatcaaatttattaaaaccaagttattctcctagctaatcaaattatcttgtatgaacaaatgctttcttaggatgcgctaagtgatatttgtgcattttttggttcaccagaatagatagtcattagttccttttgtattaataaatataatctaaaataatcaaataagtcattaatttcttttttcttatcttctacagatagttgctgttctcttgcgattaccagatacccatgtcaatgcactaaccagagaccacaagactgcgtatgatatagctgaagccttgccactctgtgaggagtcttctgaaataaaggatattttatctcagcatggcgcactcagatctagggagctgaatcagcctcgagatgagctccgaaaaacagtgacagagatcaagaaagatgtccacacacagctggaacagacaagaaaaacgaacaaaaatgtgcatgggattgctaaggaactcagaaagttgcacagagaaggcatcaataatgcaacgaactctgtaactgttgttgcagtactttttgccacggtagcctttgcagccatattcactgtgcctggtggaaatgccaacatggagttgcggttgttgttcaggcagcctcctttagaattttcttcatcttcaatgctatagctctgtttacatcattggcggtggtcgtagttcagataccggttgtcagggaagaaactaagtctgagaggaaggttgttgaggtgatcaacaagcttatgtggctggcatcagtttgcactaccatttctttcattgcctcttgctatattgtgctaggccgccatttccaatgggcagcactactagttagtttgataggtggcatcacaatggctggtgttctgggtacaatgacatactatgtggtgaaatcaaagcgcatgaggaagataagaaaaaaagagaagatgtcaagaagaagtggatctagctcctggtatgataatactgagctctcagagactgagcttaaccaagtgtatgccttgtaagagaaaaggtctcctagattcagtctctgtctctgggattgatatgtacatgaaaattccagatatacacattaacagataacatagctcacagtatttcttgatttttacaattccttcctgtatcaaccaaaccactcagaactaaatggaataccaattgtccaattgtgcaaggctccttcagctgcagaattttatggcaccaaacgagctcaacctattgtacagtgagttgcatgtttttttgtttttgattttcatctattgccaactttcatgagaaaggatttttttttcttattctttctgtgcctacttatagtttgtgatgcgctcttcagttttcataatgtaacaacagaacctgacacgttttagttccctttatgctattggtcatcttattcttacaatgttgccctttgatgtaatttttacaatactgattttatgttgtttcataaataaaattttactgtggatctaaattatgtggctgtaagtctgtaactttgcctttctattttcccggaccttttcaatcttctattgaatctataacgtttctagcaaaactagtaagggtattcctggatcttatcagtaggtttctagcaaaattacctagtgtaatgaatgaagcaatactcacctcgctacatcgtatatttacttgtggcaatgattcttctgtactttggggggggggggggggtgcttttttttttttttggaaaaaatgacccagatacataagcctaaaggtatgattggtgcagacagaaatggtctctgatatgcctgtgccctggttacactccattacaggtgtcactcactggggaaaagactgatttgcttcaccactcaccagaataacttacgattgttttgctcactaattaggaaatggacagtacaagtcagggaagcaatcctagaacactttaaattctgaaaagcacaattgtgcagcttatgtcatgcaaactacacagaccaatgtgctcataaacaatggaaaacatttggctaactatgggttagggttatatagaagcagggaggcataaagtaggccctgttacatgcgtactatcctaacacagcccaacatcatcaatgtggtcggtaactctgcttaactttggcttcaatgctgccctgccttttatcgacacacacttttagtttaaggcttatttgtcttcacttggtcatttatttaccagatgttctgttttgaagccaagaaacacaatattcccttgagtggattttttttctttcaatttatgatagactttagtaaggagtgttatatattattacccaaccttctgtatttcttaaaaaaggaaagatgatcttctgtagtttcatcactttatgcttaaatgaagaaaccaaccagttggaaatttagtacttcagaaatgaagctgatcttttccgtcatgctgcagttctcctgatgccaaatgggaatggccaaattggacgattgcctttgttttgtgctttaattggtggcgtggtatattggtatatgtccttggcatgctttgttgattgaacctcctgttcttattgcaattgcttggtcaatgacatctcttgaaaacttttttgagcactaaagatgatgctaataacatcaatggaactatagcacaatcaatccctgatatttattatgcaaattctgagaaattttgtcacatccaatggcctatatcttaatctgtcttcgaatacagatcaggatacccaggcagtcatcaagtgtgaacataaagctcttgcctccattgttttcacattttcccttctttttcatttaattttgttgccttatcatattcttccttcccttgtgattcaagctttagagttgggcattatgtgactataagcagatgtttctaataagcactacaatggattttttttatgtatatacaactagaaagggattttgtccttttggatttcatgttttaagtgtgtcggccaccagtgctgtgtatttcccaatcaaggtacttgccatagtacaggtgtgttccttggttaacttagagccatgatagttgcattcagaacccctgaaataataaatattataatacagaagtgcaaagctcagatgcagattaaattattaataccaaggtgccagaaaagctttttgtgcataagctggactcccttgagttaatgtagtggcgcactttgcccattgttacatacataagtaaggcccctccgcccatgccgattgttaatattcaagctgcacaataagaacttcattgtcttgctttatctgggcatgcatttgaaaaaacagccttctgagagtaaatatgtgtcttgtatagtgaatatgaaagggcatgtagcctagtggttatagtgacctgagtagtaccccaaggtcctgagttcaaatctcctatggagcgaatttcagattgggttgtttgcggggctaagttccctattttcaatggccgtatatatccggttggatgtagaggccgggtaaaaaatacccttctctaaaaataaaatgtgtcttgtattgtgtttaagaaacaagcaactaagatctaatcaggaattggttgcatgtggagacagttacacacacagaaacagaataaagcgacaggtccacccaaaaagtaattggccctctttggttaattatgctccattttctcttaattgtgatgtttgtcatattacttctttttttttcttagtagcctactgcacatgcacctgcaatagggatggttatgagagaaacttttacttcagtttagtttgttgatgggaaatctgcactctggtattagacagtcattccaagtgcttacactatttggtgttaaagattagaattagaaatttgaaactatttgttcttacacaaattacacaagctacttgaatttttctgaaggacattataagatcatgtctgcaggtatctgaagatcaaaagtgtacagaattagcaaaagtgtttaaatttgtacataaacacttcatcgtccgcaaatctcaattatatcatctggatcttcagactctgcagctatccttgacgctgatgatgacatgaaacggaaacctgcatcgcttgcactctttctcaccgaggccagttgctgtgaccttttgcagtatgctattgctccctggattggattgtccatctctgagcttgcactgctgctcctcctgagcactggccccacaccagagtcagtggagcttagtatggaggaggatgaatttgatgaagagcatgacgatgatgacgctgaggatgtcttgtttgatgatgagtatcgaataatgacgctggagaaggacctcctgtggccgcactcatcttctttaagctccctccaagtgtgacactgttgctgataggcgaggctatgtacctgttgcttctgatctggccaaatgggttcttcctccaagacttgaactgcgcattggagagctcatttgcactaggtgtaccagtcttgccatctggattgcctgctttagtggcaaatattgtcttgatataagcttttgatgccttgagcttgaggccaaggttgagatgcctgatgaacttgagcttcttggaccatggcttcttttcgcaggcggcggcctcctcagcagcaccaataccagctgatgtgcactcgtggaagtaatgctcagcattgagctctccactgacataacatgaatttgccggtgatgcattgcacgactggtatggcgttgctggggcagtgctcgcggagaggaggcccttctcagctgcactctcgaggagcttctcgaccatctggatgcgtggtggaaggtggagcggcagtagcttgcccttgtagaagagctcatcggctggtgatgccgcgggctcccacttgtcaaccggaccgacatgtgg

SEQ ID NO: 29234 - DNA, 491 bp, Oryza sativa
gtcacttcccgtgcaggcttgaaagtacttatcgaagatgacaacgggaattgctcctctcgtactcgaaacatcgttattcgcgaaatattcgctgctcttagatagttggtggttgctgtcgttttgtttattttattcctgcggtgtacatatatacttgttttgtttatatctaaaagtttgctatgctgttctatggatcctgtatattacctggttatgctgcgcttttgtttgctgtcctactatactctttgccataggtgatgcaccacatatttatctgcttattttatgctttttttgcccttttgcatgaccttgttttttgctttcctatagatggctttcgatttgctgtgtgacatatccccagcaagcagaggctggaagatccgtgcaaagatagcaagaatgtgggactacactggtacagctgacgatctgccctctatacatgttgatctggtgcttattgatgagaaggt

SEQ ID NO: 29235 - DNA, 39472 bp, Oryza sativa
  unsure (1)..(39472): unsure at all n locations
ctatgcagggtgctggcttctcatgtactgtgaccgtagcgaagttgagcccatctcagtcatggtggttttcatcctgttcccgttgtcatagagccgcaactgcatatggatctagctataaatgctccagcggttgctcatcagttactgccattccaaagtaatgttctacagcatacatgttcagctccttttttatatgtctgcttggcctctatgacagaaatttcatttttatatgttaggtaccgtctttgcctgataggaaccgatggaactaattcagcagagtttgtgctatttggacgtgttgcgcagcaagttgttggccgtcctgttatgaatcttatcaaatttcagggcagatcagacaatattcctaaagaaattgctgctgttgtttcacagaaatttacctttgctgtctctgtcactgagcggagccttatgcacaggaatatatcttttcaagttaatggaatcgagactttctttggaagacagggttctattccgcagcctagggaatagggtccatctgcaggcccttctactcctttggctcttgctgcttctggtatggataaggatgacgcctctcaatctcatgagtcaaccccggtcgattcatctacttcgactgctgatccagtcgatgaacttcctggtgacagcaagaagcggaaatccattgtccgtcatgtacgcccttccattcatatcccatacattaccttttgctttttttatggcccttctttttatatgtctgattgctattccagcctctagcagcacagaaaaaattgacctttgaaacagctccatccagcaaagaaaacaccagcccggttgaccctcctactaggtacaagtgtttttccacacttcttgttcttcttatatgttgaaactttctctatgttacatctgctttctaatttttatggccaacagtaaatgtggtttgcctctgctacatagcagagcacggtcagtccctccacttcaatcagatataagcatccaacccattctatttagtgagaaaccatgcattatgaacatattaatgtaggttccttgttaatctatattcctaatcatcctacctaggcctaatagacctaaataagtctttgctatttctcttgcttccatatgccattccgtacctctggtctactctgtactttgttccgccgtataaattgcctgtatgctaaatagaaccactttacattactatgacatggcctgctagctaatcaaaagaaacatgctcatagacaactacagaacattatttactacaggcagattagttgcttatttattatcttttatatgggatgtaatgcgctccaaaatgatctgcatatggcctaccatgttttgctaccactgaccattgcacgcagcctaccagttatatcttttgctttgcataggcatatcatgtaatattactaaccatgatggctatctgctatattgctcagttcttctcgcactgatgaccaagctgctgataagcaacatgttgtgcctcatgaggttgatgtttcttagattgcagctgcctctgctaaaccaaatactcaggttaagcataaatacaccactttccagctaatttagtggtcgaatttttttagtgacactggcaacctaattattcccgttctataggtcaaagatatcctaccaactgaagccaaaaagaaaaggtataaaactacatattcaagctgagaacgaataagaaaatccctatttttgtactagcggtggaagcatgtcacattcattgttaaatagactgcaccatttcgctttcgctgctctcccgtttttggttcttctagattaaccaggtgttcctctttgctttagtgttgatccaggctctacaggcacacgcaagactaagcctcctgtaccgaaagggaactaaatgctcaccttagcttttgtgctgatgtgagtatcctgttctgttatatatctatgggcatggcattagtttcacctagattgctgatcactttaaattatttttcaggggaacaataccctacatcagcgatcccaccctatgtctacatatttccttaatcttactgttggcgatgcagcttgacatggcacatcgtatcagacaatcttttgtttacatgattgctggcaccactgtgtccatgcatgtgcatgtttggtcctctacctgctgctctttcgccctttagtgtcagtgtgctttccataccgtagcagagacttcctatgaaacgctgccatacgactgcacatcaccccatcttttgcttgtatgttatttattgtaaccatgactgtcaatgtccatatggtgctctgtcagtcctatgaactcgttcagcaaacccccttctgttatggatcatattaatgcactagcgttctatctgctgttgttctgttcatattacatgccttgcagctgctttggatatatctagcacttgtgatacactatcgtcattaaaagcttatgtttcatgtgctatgtgcctgtgcaggaatttgaaatttgtagcatttccatcctacccagctaatgtgataagtaggattttgtgccatcctttctgtcctaaagaaagggtgggcaaaatttgcagccaaaaatagcatacgcgttggatcgatctgcattttccacttctacagggcaagccagatgcaaatgacatgcaaatgaccatcgatgttctgtagaccacacgtgaatagtcaatgtattcaggaccacttaccagctctactgccactgctatgttaattagtgttgcaccttaagattattatcataggtactgcagcaccttacaaatatcagacatatgtatgttgttagcgctgcaatctacttatctattgccgtctgctttcattacttttcccccaccaacactttttaaccgttcttccctggctatcagcttattgggcggcacacgtgcgtacaggcggcacgccaagggtgcgccccaacctctagtagtgttaataggtgatttaccacacaactggtcaaactgtgcatttagagctagcaaatacttcttgtactcatttcctatttattgcttctccaaaattattttctagatcactacagaactgaatctcaacaagaaaaaacacaagttaccaaaacctaaatttgatgtatacatccaccatgatctgaatccatacttacatccaccatgcatgaccctacaaatgaacacaaattgaccatgcatgaccctgtgggatgaaaatataccctgcaaatttcccagtgaaagaaatgcgtctgtctaggaaaggtcaggaaaaaaacagaataaatattgctactggcatttgaattttaaatccatgcacacaataaaggaattttttttgaccgaacgaggcattcaacaggcacccaaatgaaccggtacgtcctatcgctaaacataaaccaaattaaccttatcctatcctatccaacagccacccaaagttctgtataatcccaacagcattcacatagtctcctctatcatcaatatcagtttgaagaaaacaggaaacatgtgtagactaatggcattttttttttcgctgggccggagactaatggcattttcatttggctgggcaacgaaaatcctaaatgatagagcagaactggacagtgaagcacgacttggtcatcaaacatcagtttcttatggccgcaaggtctcaactaatttgcaagctcaacaaacaaaagaatcaatatcctctcagtttatttttttgacatgtacttccacaattccatattacgctatctagcttgacaaaagattaggcctgcaatctaaatcagagaaacatattaagataataactttctttgccacactgcccacacattcgcataataatttattttctcacaggtttatgcacgtacacacataatagccatgacactgtaataatgaaggaacgggatcgagcgacgattaccttgttcgcgtcacggtggagagggctaaggtggcggcgcaacggagagcagatggcacgagggagtcgacggcggcgtcgcagtatagaagggggtgcgtgggtgagcagtcccggtggcggcgcgaggggccggggatcgacggcccgtgacaacgatctacattgtgtgggggcattggtggcgtaaatctggaggcgggaatcgacgacgatcctcgtgagggacgctggcggtgtcatctggaggcgggaatcgacgcgctggttggggcgtcggcgacatcgatctggaggcgggattcgacgatgatcggagtgagggtcgaggtggagagacgggaatcgacagcgacgcgagggggcgccggtggcgtcgatgtgaaggcgtgatggggcatcgatggcgtcaatctgaaggcgggagtcgacggcggctcgatggcagagcgtgggcggcgtcgcacgcgatggcggggcgtcggaatcaacggcagcatgggagagaggaggaggtggtggcgacgattagggttcgccagggggagtgcggcggcgcttgtggtggcagaggggaggcgacggagcgctgtaggttgggagacggttgggggaaggagagcgcgttggggattttcggttgaggtgggaggaggagcgatagcggcgtgattttcgtgcgcgcggaggttgagggggtacgtggaacaatatgtggcattggattggatgattctggaccatcagatttgatgaatgagtaatgtaggtgtaagagtgagttggtgaattatagggtagatcgtgaaacggaattgctataaagatggcgacagatttttcactaatctcagtcggttttcatgtccattggattcgttcgcatgcaaacgctgcggcaaccgtatccacccgatcttccggttggttttatatacggaattgctatatcttaatcgacagttttcttgcaacgaatatgtcacttttcatattttatacaaatttacacggtagttacacaccacttagatatgtaattagtatgtaattttgggatttacatacgtaattttagaacttacatatgtaattttgagacttacattgtaaatacactaaaattacatatgtaatttaaggacttacaatgtaaaaacataccgactattttttagtgaaaaatatggcgctataaatatagctactcccacggtgaaatggccggtcaagggtaactaacaaacctgttggaactttggaacctcggccgcatctaaaaaccaaaggatcgccactttgcttggggaagtgaaagaaaaaaaagatgccttttgtagcctgaacatggttgcaacctgaagattttttttttgttttcttctctttacttgtgatcgagatagaaattacgcatcacgaggaggaggaggaaatacatcacgagaaaaacaatcaaacggcatgctaaacaggacacgagatcagtctcgatcgaagaaccaccaccccaaccctttttctgcacctagcccaggagtacaccgccgccgctgttggaacacgtaccaacacatgcgtgagccgtgaggtcgtagcctaagcaccgtacttgtagctggcgatgtcctccgtgatcatctccaggtccctggccgccacggccatcgacattgcccgccggtgccgccccgcctgcatcctcgccggctgctgctccgacgacgcgtccgccgccgccgcgggcttccgctgctcggcgccgccgccgccgatgacgtccgccgccacgtcctcgaggctggcgaagttctccggcagcacgaacacgctctgcgacgccctcctctggtgcctcccggctctctgcgacatcttgaagcttagcaacacacggcagcagcaacaacgaagaagctcttaagctgcgcgacttggttcgctcggcgccttagcaaattggaagaagaagaagccgttatatataggctaacgcatgcacggacactacatttattttattattccattgattatgctcattactactgctgatctactggtacaattgtaacttgtaaatgaattttgtgtcagttcctggctcccccaagtgcattgacttgtacgcattgcatccatgtgaagacgtactctctcccttggattgattaggataatttggcgattaaacaaggcgacctgattgctgaaatgtcacggcgctcttgctgatttggtgctcgatcgtctggcaccttgctaagctaggatctatactcctacttggctagcgcgtatgccgtgtgatgtgatcgattctgcctgatcaggcctctaaactgaagccaacttggcacgtactgttaactgtggtagttgacctggttggtgagtgcagtgtttttatccatttctgtgcgtgtacgatgtcgctatgaagcttcctcgagagtaaaaatatggtattcgtgaggcgtatgtacaggaatctcaggaccgagctcgccatttttattggggtagtgctccgctcatgaatcattctgacattatcagcagagaaccacgtgcaaaccgaagagagaatccaccagcagaatcaatcacataatactactaaccagatcaatcgcaaaaaaactgaaacatgcaagtacggatgccctgactaatcatgaagtttttctaataacacttgcaagaaatttcctcgtaatcctttgtccctgcacaatactatggctctagttgtgtacagatagtgctgttactacccacaaacaattgctaagaaattagtatcagttagctgtttcaataatttttccgatggttcgtgcttatcgcaatggaatcttttcgttttccttttaaggagcacaccactctgtttatgtaggtgctacaacctgatcaagctggatgtgttcatgcgtgcggaaagaaaaaaagaaaaggaaagggaagttgttaactgtcaaagaaagcaccatgcatgttagaagattccaaattcctagctcaaatccagcctcacatgggcggtacacgtgggttgatcccccacgcatgtaatgcaaatattattggggcccggggcgttcgctcgtgtgcatctccaacaaatttgctgcaagtcgccaaacttatgagacagggaaatgtgcaaggcagcagcacagggcgtgtatatgctcttctcattccaccaattaaaaggattgatttgtaatgcgggtctgggaagtgggaactgaattgttcataggatacgttgtttggtttgagtacgtcgatgatcaaaactgtggtttggcaggctgatctagtgctgtaaactggtgttcagtttggtattgataaggagttcctcttctgccaagactggaggaagcgttcgatgcttgagctgaaaagggaatatattgtcagttcagttccttgtgcagattgggaactgcagccatgccggctagttgcctccttcctcattctgcgacgtgctcaacgccgtgggcagagtaggtatcgtggttcgtggacgccgttgggctcaacgccgccgccgtagaatgtcgcgttgtggcggtcgcggaagtaggcgtacggccgtgcatcgtgtacggtcctggtctttgctgtctccgacaccttgatctagtacatactgaactctcattccggctcccggccggcggccggtggtggaactgtcaaccgcgtcgcccactcccgcacgccggcggcgtcgacgtgggatttctttctcctcgagcggtcgtgactcttcaatgagcatctccctcgtccgatctgaacggagagcgcccacgacacgccatcctctgggttgaggccacatgtgcgatcgatctgcgagtccgttactccacccgtttcatccttttaatgagttgttatgattttttttctaattaaacttcttttatgtttaatcaaatttatagaagaaattaacaatattttttgacacaaagcaagcatattatcaaaacatgtcagatgtaagttttagcaaaattaatttcatgctgtagatattattttttttataaatttagttaaattttaaaatgtttaactaagaaaaaaaatcaaaacgagtcaaaatatgaaacagaaggagtactacaaagtggtcggcaacggaaagaccgcgtttgcattagtgcaatttatttatcctcggtggaaccaaacgtaaaatcgaaccgatatgaaaatggtaccggtctcaaaaacactaacggagccatcattttgcttattcgcaaaataagcgaaacggtatatttgcaaacgaaaagtaacttgtaaatacaaattatatatatatatatatatatatatatatatatatatatatatatatatatatatatatatatatatatatatatatatatatatatatatatatacttagcgatctacaaataagtgcggaaaaataaattcgataaaaaaaacctcacaatcaacttcaaatataaagggaaaaatataaattgtgactgataagcatacgcataagtgaaaagattacgccctgaaaaaaagaccggaatgaagatgttagaattttttttattttaaaatttttattttttaatatttacagaaatattatatcatccaaaatatttacaggaatggccactgccgtccaagtggagggcggcaaggtgtgcgcattttgtactaaggtcccttgccaccctctgcaagggctgcaagggggcaaatgcaaatttcgccttgccaaaaatgtatttttctaattttttttatcaggcctacttctgtaaatattttcgccggtacaatatttctgtaaatatttaaaaaataaaaatttaaaaatgaaaaaaaatcgaaaatgttatatacccgtaccataatagcgaaccaaaatagcactcctaaacagggaccggattgcaggagcccattgaatgggccgtacaacatatagtgatttatcagtgggccgttgcccaagcccaactaggcaccgcagatccgacggccactaacgcgcatcatctcaccatccccagcatccacaggggccgtcggggggtcggccgccccggacggcgccgccgcccaccgccgatcgccgttggtagtggtatggtgtggcagcagcggcggagattggcctcgtcctcgcacgccggagtcgccgagttcatcctgccgcggcccgcgggccctcgctcgggtgctcgggtcgggggaatcctctaaaccgtacggcgtcgtgtccgcgagggccgccgtaccagatgctgctcaagtagcccggcgtgcatctcgttagagatctatacgaaggggaggacatgaacagcttccagcagaggctcgcggggaggttcagagatccgaccacaccacattggtcatccctaagaaagcgtggaggcgtcgagctactagattttctgataatggcaattttattaggttcttaatttctccgtgtttcgagttcatacatggaaatgcaaaccatttttttgatgcattgatagggaacaagaagtcgatataatgtcgtcatgctaactcctggaatcaaaaccaaatggtgaaatggagaatcatagtcgtttccatgttcatagtagcatattgtcataactcataaattctgacaagtatttgtgtaggtctatatgttttatgcttcagagctgtggcatgctcattgacttatggatctatggataactattttaggtcagcacctagctgatgcttccagactgtgccgaagaaggtaattcctgtaattgattggcaaattatcaagacatcactgataatgcatccagacaaaatgaaaatcatgaagcatgtcattgaaagaaacattgtggatcatgatcgtagccattttccaattgctgttcaaattaaaggtttcaattaaacttttttttttgaaagatccagcaagagcgctggcattatattataagcaggagaaaaataaatacaaagtttatgtacatagacaaatggccacctcgacgggtgccaataggaaggtctaaattaaactcggatgatagttaagtaggatactaggattgaacctctcctaacatgtcaatgaaagaaacatgaacccaaaaccaattcatgcattctaatttcgaaataacacgtaagcaaatgaggatcaagcttaaaatatatggatacaactttggcagacaatatccatttgctaaggggctgtttggtttccagggacttattccaaatccctgtcacatcggatgtttggacactaatttagagtattaaacatacactaattacaaaacccatttcataacattggactaatttgcgagacgaatcttttgagtctaattacgccataattttgacaatgtgatgctacagtaaacttttgataattatgaattaattaggcttaaaaaattagtctcgcggattagctctcatttatgaaattagtttttttattagtctatgtttaatactctaaattagcgtccaaacatccgatgtgacatggactaaaaaattttagccccatctaaacaccccctaagttgttctggaatctgcacctttgaattaggagcgttgctaaactatatgtgctgttccatggcagcactgctggagttattgataccattttgtttcagtgacccaataacacacttttgtgtttcatatcaccaaactgcagtttctgcagaccctaggacattatttgggggacaaagtagcactgtaactaggatcatgaagtcaattttgtgtttatcatcaatctattgaattcgttcaaaaaaaatataatcaatctattgaaactttgtaactgtatgtaagataacctttctactaatatgatgcattaaatatcttagtataaaacctagctaatttaacatattgtgcaagtatagtattattatatcctctgcaagtatatcctctactgcctggggctttgctttgcatttcccagataacagtaatcaaacactcacttgagctttccaactaaagaaatcaagaaaagatgccatgacaaatactagttcaccacaaaagatacagtagtctccacaacaagagcactagttctgattattactattgtaatagaacaactgatacatgatgatgaattctatcaagagagctccggggatatagacactccattaccatcttcttgtcgagatggagaaggaagacctgccaaagttgtttagttgccctacatggcctagcacctgcctagtggataccttcgctgcatcggccgttgaggcatcatcttcaacaccaccggcgaagctgagaagtagtgagaacactgcatgggttgcatgcagggcagcggtgtcaggccattgttgggggtagagaggaatccagaagaagggtcctccatggaagatgctgtgcttggtttcatttatagagagtacacgaggtttctttcacaaagtggaagcttaggtggtggagtgccttttcgcagaccgaaatgaggtatcttccttagcatattccttagcatgtggaaacttctttttctgttctatgcttttgatttgctttggagtttttcaaagtatattccatgcttttgtgtgctttttggggcctataggtttatgaacaataatttagatgatgaatacactctagatgtattggagtaccttgacgaagcatgggctggaaagttggttttggtggtgatcacccggagcagatcttgcgtcatggacctacttagcaggtgcagtttggctggtcttgcattgtgcctgtcagattagtgctgtacttgatgcattgttgtcgtttatacatgaaaccaaatgaaatacaagaaccatatgtagattgcagaacaaattattttccttctaaagagggtgagatcttagtagaactttattgcttgtggtgccctgctgtttgacaatgtaattggtgcgagacactggcatatgatctggcctgagccttgtgtatgatgttatcagactggactaggccaggtgggccttatgcctgctttggtcttcatgccaataaacagagggagggcccaaaataagtcctttaacaggacactgatgttcatgttccaatgtatacttacggagttgtggacttgtggttataacttataagttgcaagggacagatattgcccaatacatttcatgagaaaaatctcgctatgcttttgcatctttgcacgctcatttggtgcatacggaggattggcctaaggctgtaaaataacaacaataataataaagctcaaggcttgcgagttgctcgagctcttaacgaaccgagctcgagcccaaccccaagctcgcaaaatttgttgagctgagctgaaagcatctaatgagtctggttatatgggctggtacattctaaattgtttttttactacgaaattatcatcaaatatatgttatcacgtacttaagccaagcccgcctgaaagcataaaggggaataagcttggctcaacctctagcataaggcagccttacgctctggcttgcttgagctcggctcgttgacagccctaaattaaggcgtgtgaacctctgtcaactaatggcaggcacatggtggtggttcttaaaaaaaaatcttcgtttcaaaaattcacattgaagttactaggttggtcacaatcaatttgatgcaaagcggatcaattactaaattaattgataataaggctaatttccccatctaactcagatactatattacgttgcaggcaccgctaattaacccaaaattaaaaagagtaaatttcacaaaactaaatatactttgactaaacgatcacaaaactatggatttaagacattactagtaatcgtgcacgtgcaatgcacatattaacaaatattatatgaatatgaaccattttgataagcatatcacattcaaacgattggcaatagaccaaggctacataaacccaagaaacatgtttttttttctttaagacattgtagttctgcttttatttttatatagcaaggacatattactatataaaaaagagaagaataaacgttgttccgcttgtcatagcatgttgactgtagcatccaggtgaatcctttggcgtggcagcataaagatttattttagttgtttattttggcaacttaaaatttacataaaacttaatctgagacgcatcccatctaaagaaaaccaagagataaatctttgagactatagaattgattcattcactatatgtaaatcaatctctcttgcagtgtttgtggcaaaagatgagcgatgcaatcttgatcgtttgacatagtttattctctttccatcgtttgtacacgcttgttttttggtctcctacacatcaaaagaagaaaacacaaaagaggtagcaaatgacaatacatgctttactgaagattactggccacagaatggtatattaatggtacttattgcagttttaagccaggcctatccaatggaggaatgggcatccagtaaaaataaactcaatggagcagaccatgaacatgattacatgaatggagtcagaggtggagacaccatcttttgcatccccttcactgtgtagaacttgttatcagtaatcagttttagctaaaaggaagtcagctagatcaaaatccaagcaattgaaatatatccaatctgatgcagagaagtggagaaccaacctcgtgcaatcgctgagcactgctacacacctatgaattcctacttcaataggaaagaccataaacatagtagagctacctgttttccttcaattcaagaatttttggtttcattaatcgaaacaaaaagaagaaccgaaaaaattgcaaggagaggaactaaagattttctttagtacaagagccttcatcctcgggatgttgctttcaaaataaaagatatagagcagtgcaaagaaatatttttcacaggttaaatcgcaaaccaaatttcagtacagccgaaaaaaaatagatactccaatcatgcacagacatgaaaaaaaacatatttcaacaattagagcccatttcaaaagaagcggtttcagttctcacaaatatgacatgcaatttgttaatcttaatactggtgggctgaccatatcaaggctaacatggaaataaagcacatcagttgaacttcagattcggtagtggtagaaaattggcatatttagccattttattatagtagtagttttttgagcaggaagaaactttcacttcatatagcaatatattagtaactccacttcatgtagccagaaagtaacagaggagcttgatgaaatacatgtgcaacgctgattagaaatagcaggatgatgcttgatgataactcatccagataatgcaatgctatatgcagtggctgtttaatattccactccatgattcacatgacttttttgtcaataaaagaagacaggtaaatataataaggtaatactgggaagggtatatcatcttactttacatttgatagaacggacttagagagttcttaatggcccatctgtcacatctcgttatctgtggacttccaaatcagttgcagttgaacaatatgaagaaatgaagtatttgcctgcaccatatgaagtattcgagaccaaagaacaattcagctttagtttacacaagcagagctttaaatcacaacatatagtgcaaaatagagtaaatatgagataataataaggattcaaagagtaacatgagtgcacctcgaccatgcatttcatcaaacagttggtgtgctgcccatgggcacaacaaggaaccaccatgatagctgatctggaagacatcctcatcgtaatggaaggataccatccgcaacatgcagtcgctacagccgctgaaggcctaggtgcaaacatgaggctttcctgcgtggcttcagcgatggtgacatggaattctacatatctatcgaacccaacttttaaaacaatctatgcacttgtgtaatcacttgaacaccatgtggattagtttaatgataacaaaatgaaacacgatatataatcttatgattatacctagctgttaagtttgtattcttattggtccctgaaagataaattttcagctcctgcacttgaatcttgcatcatttatataggtaaaacaaattgacagctgcatttataatttcatttaggatttatcatgtaaattcagggtgaaagtgaaacaatacctcagaggtactgtcattgtgtgcaaggatcaaaaacaaaaatggccaactgataaaattatgaaatttgggatctggggcaatgacttttgttgttgattaagtacccaggatatcaatgatttacatatagattgatcttttcattttgtataatttccaaagcataatcaaacattttatcaaatttttaatttttgatatctattggaattgcattctaacatgtatcaatcaagcaaatttgccacaagtcaaaatcaatggtgcaataaacataccatttgagcgcacagctatttctcttatgcgccgaaccagtctagttatagagaaaacactttcgtctcaagatttccttccagataaagaatagaactgaaatgttgcaatggtacaatttacttgtgtttggggagtcaatcaaccaaagaattttaaaaaggaactgcacaaagctaaaaccttaaaacattattgccatgtcacttatatacaaattgacaactgcgaaagatagaccaatatatttagcttctaactacaagggtaatacagtagaacagtgatataatcacaaatgagaggtagagtaaattcaagtcgatagattgacacaagagaaaaaggcatctgccaatccccactcatgtagagctaaaggaatataccaaactctaccccaaggaaaccagtaacaagcatatcaagtataattataacagacgctttactcaccaacaaatcaattgcaacagagctatgaagttgaaccattgtaactaagaatctaatccaacatacaaagtctgaggttgtcacgctcaaacatcaggaaatgaccctttactacgtttacgcgatagctcgtctgcagaggcaacagagggctcaccaagtcttgacgtgcttgagcgcgaggctgccggcctgccgagccggtccgggtagatgcagacgcggtgccactgcacggagcagcgttcagcgtactggtgcggctcctcgcagtccagcgggcggcggttgttgcggatgccgccggtgccgactgccgagcgagaacagtacgaccgttctccctctccgcagccgcttctgtatcggctcctgccccaccttccccaccattatcgcctttgcgattcccacccacccaccctcccacacacacaaaaaaaaaaaaaaaatccccaatcaggctatcagctcctacctccgcggttggagtcatccctcctcgggcgtgtagatgtagataacgaagaaggcaaggacacgatggagaggaggatgatagggatggaagttgtccggtggcgtggaggtgggcagcgggcgttcgactccggggcgtcgagggtgaagacaactaaacatggcgcacgacagggatgcgcacgatgaagacgggggatgagtgcggcggcgacggcggatggggaagatctcggctccgtggggggttggggaagacctcgcctccggttcagtgcgcggtggcggcggcagcagaaggggacgacctcgtgggcagcggtggactgcggcgacgacggcggatggggaagaccttgtctccggcggcggcggatggggacgacgtcggctccggccgcagcggatggggaagctccggcggtggctggggaagacctcgcctccggttcagtgcgcggaagcggcggcggtagagtgcgcagtggcggcggaaggggacgacgatgcgaggagcgagccgcgcattgagagggtgatgaggcgtaatcttcgcccggccttcgcgcctggagagtgggaatcgtgcggtggagaaggctggacggtacagattacatctgatttacgaatggacggtagggatgtaaacatttgatttggcatgtaggattagagggggcaactcatttttatattagtatagatatcacaaaattacatattaaggttaaggatcacaaaactacaaatttaatattgaagttatcgcaaaatacatattctaggatttaaatacctattactaacgttatattggatctataaatgttgtagatctgggatatgtactaaacctgtcatttttgtaatttttttcctaattaatttttatttttatgatacttcatcctaaatatgtagttttatgagaaattttgcgctaaatatataattttgtgatacaagaccttaatatatgtagtttttgtgatagtttggtaaaagtatgtgtagttttgtgaaatttacttaattaaaaatggcgactaagaacgaacaattcactcacactttaccattctaatttctaactataaaattaatttattttagtttacttggaattgagttattgtacaaattgattgctcatttctactttcagtttcgaatttcgttatttttttaaatagagatgagtttttatacaaatataatttttgatatgctttcaattttatttggaatatcagttatcacatattttaaacttacttggacaattctttttattgtggattaattaaccgtgaaagtttgatcccacaaaagttgatgaatgatgaatgagcatatataccctttttctgtctagaaaaatatcggattagtgtgttgaatttcaaaggagtgaaagggtttgatagctcgatattagcagtacgtagaaatatcaatgattaaaaaaataatttaggggtagatctttatatatgtagccaacgctgaaaaatatatgagtatgacaagaaccccaaaatcaacttctaaattaaattttaaaatttaaattttggttgtatagctaataagtcaagaaacaaatggtataaattgacagatactctctctacccctaaaaaatcaatagtaccatatgcgacacattgtcacaatatgtctagttaaacatgcatgttatgatctcacaaaggtaatcgcctctaaaagtaataaaacaatgttcgatctacaactcacgggcaactcaattacacattgtcagagttgaatcgaggttgtcgtgttacaactgacgtcagaaatatgcaacggaggaatgacaagaaaaaaccataccactaactttcatgaatttattgttatttacaacaaaaatacaagagttcatctctgagttcattctcaactaccctggcatattataaaaccccccaaaattacatcaattctacgaaatgttaaaaagtaaataaagaaaggtaaagatcaaaaggaaaaatcagcggtgtatattttatcaagaaacaaaggaataatcggcaacagctatcatgcaataatatgtgcagtttgaacggctcaaaggaaacaatccaacatggcgagcgccttgtgtacgccctgcccgccggcgccgagacccaccacgttccggcactttgcgcggttctccgacggcgtcaggttcaagtccaggcagacaccgccgccgtcgcaggccttcacggccgccgccttgcctacgtcgccgttcttcgtcgtcgtcgtcgtcgttgtcgccgccgcctcggcctccgcgcggtgccgacgcatgtgcccgccgagcgcctgcccgatggggaactcgagcccgcagacggggcactcgtgcaccctcggcttcgccggctgcggccgcggcggcgtcggctgcctcccgaggcatagccccgcgtcgtcggcgccggcgccgccgccgagcgcgtgctgctgctgctgcctcggccgcttgtggctggcgcggtggcccccgagcgcctggaacgtcgggaactgccggttgcacgtcttgcactcgaacacgcggtcgtgcgcgccgccgcgcaccaccaccggctgcgcgccggcggcgaagccgccgccgcccagcaggccgtgctggctctgctgcgcgaggagcatcagcacgcgggccgtgtccacgctgccgacgaactcctgcatgtcccacatgctcctgctcctcttgctcatggctatagctagcttaattagccacgtaattaattaacccagctgatcactaacgtcgccgatcgaaatctgtatatccgctgcactgtgcaacaatacttgcacatatgctgcgcgtatgactatatatatagagagagttagaaagaccaaatggcagcaaagctgaaacttgtggtttggtgcacacgtaggaaatggatcgagctagcacgacgaacaacggcccggcttgcttctagatgtggatgtgtgtgtacttttctaaccatttgaccacgagagagcatgatcagattaattagttcctcccgtagtagtagtacatgggacgaacaccttgttttagtacaagtagctagctagctttagtcaacatgtgtgtgcactgcatatctgtggtggtgacgggctatgtcttgttgtcttctagagtggctgcagcagcagcgccaagttgcctccaaccactcggatggatagcgagagagcgagctcgcggcgccggaggcggttgcgagtgacgtgcgcggcgcgcggccggggtggcgttctggctcgggcaattcgccatgttttcttgcctcagcgcgcgacgtcgcgtgcgggcgtggcctgctcgccggccggtcgttcaatcccaagcctgcacactgaagctgcagagcacgggtttcacacacgtacctcaagctgctgacgacgacgcatatactacatgctacggccgttccattcattggaccggctggcagaatctattatattattaaatgaataggaaaaggagtctacacattcgttctcatggtctagaaattcttacattaatcgaagaaaaagaaaatgcagagtctatatagaaatacaatttagatatagctgaaattcgaaattaaaaaataagaaatattagaatagaagactagagtccatatagaaatacaatttagaaatagttaaaattcagaattaaaaaataagaaatattagaagaggagactagagtccatatagaaatacaatttagaaatagttaaaattcggaattaaaaaataaggaatattagaagaggatattagagtccatatagaaatacaattaggaaataactgaaattcggaattaaaaataaggaatattagaagtagagtatagagtccatatagaaatacaattagaaaataatagaaattcagaattaaaaataaggaatattagaagtagagtatagagtccatatagaaatacaattaagaaaaaaatagaaattcggaattaaaaaaataaggaatattagaagtagagtatagagtccatataggaatttaaaactaactaaaattcggaataaacataataaaattaaaggtagagttttgagtctgtataaaaatataatttacaaataactaaaattcgaaattaagaaaaacacgggaagaagagtttaaagtcaacataggaatacaatttagaagtaactgaaattcgaaattaaaaattaaagaatattgaaagatgagtttagagtccacataaaaatacaatttgaaataataaaaattcagaaataaaaataaataatattggaagaagagcctagagtctatatagaaatacaatttacagaaaattcggaatataatttacaaataactaaaatttgatattaaaaataattaataactaacacgtatataaaatacaatatgaatattacacatttgtagtttcgtaaagttattgcaaaatttaaaattatgatgttattttaatatatttgaataatataatgagaaagcatatatgctattatatgagagaaaatataatgatgctagccgcgcaatctgcgcgggccaccatgctaattgtattaaaacgtttaaccaagatgttctgtacggacaaaatgtgatcgaacacgagctgaattcagagagagctttaaaaaactagtgcagtactgtactagtgtgttccgttgggactgcataaggtactcgtggttagctagttatagctgtttgacacggcaatgttcatgccttcattcacccacaaatttcttgactggaatagtggaatgcatggtctttatttttactttctgatgagcacttcatctggattaaccttgtatgaataatcagcttgacagctttgcagtagctgagtcaaatgccaatccgtgttaattagctcacgttctgagctttaccgaggaattcaaacttacatgtttaaacttttggaacttgcgaagattattattgtggtgggcacacctaacttcagatgcaactccgcaattacgcttgtaacagaattcagaattgagaaagaagagagaaagatgagtttggtgatgcagtccaggtcttggcggcaaattaaacgatttgaccggttatcagtggggcgaaatggctaggtgtgtgcattttgtttggctgactgggcccatccaatattccaatgattcagttaatgcctttctctgcacactacttaacgcattctacgcttttaattgttgcaccgcctgttcataggtgagaacagcagatgccactacgagaacatgtcttcaatgcaactactcccccgtcacaaactactaattgccaatagtcaaattaagttttgatagtttgactaaaagatttccaaaattataagaaatcatagtgcctaaacttgataaatagtagtagaagggatcagctgaactagatgaactcccaagatcggtcaaatggtcaacacacacgcatgtcttaggctggtagcctggggcgttctctctctcaaaaaaaaaaaagagagaaggtattgagctgaacctcaaaagctaatttttgcagcacatatagatatagaacgaccactatcatgcatgactcatgcgtgcaaagagttctagttacacctaccatttgttcctgaatcctgcatattttgtcaacacaaacatcacgagtagtgagtaccatgttctaaccaagaaccaaatcttggactccgactgactgactcaccagtcaccacagcaacacacacatcaatgtgcggcacgatttcacgaaacgtgttctttgaattttcttgcagcagttgtacatagagcactaataaattagcttcttttaaacaactctaattaggcaagtgccgaagagataagtgttaacgtacttgctaggtcatgcttgcataagttgtattccgtttttataatataaaaaatataacgtcttccatgtttcatcattcgtcttttaaaaaaaaaggtaaatatgtcaaaatataagtcacacttatttaaagtacatttaatactacgcccatcccaatttatgtataactgtgggtttttgtgtccaacgtttgatcgtctttcttattttaaaaatttatgaaaaaaatttaaaaaatagtctcacatgaagtactattcatgttttatcatctaataacaataaaaatactaataatatttttttcaaataatatggacagttaaacgttggacataaacagtacaaaattacagtctttctgggatagaggtagtaataaaatactacctccgtgcaaataagtgcagttgtgggtattcgtgtccaacgtttgaccgttcatcttatttaaaaattttatgatttttttaaaaatagtgacacataaagtactattcatattttatcatctactaacaataaaataactaattataaaaagttttcaaataagttgaacggtcaatattggacataaacaatacaaaagtgcacttattatgggatggagggagtaaatcataacaaaataaacaacaatctctgtgtcacactattattcatatttaataatattattactatatttatatagctgcacgatcatctgagtgccaaaggtcaactcggcatatttaatatcggacgacttctgtgatagtggctcaggtgtctggaatggttgtctttccaaggtctggttgcttctagctgatggaatttgcaaaaatgtctaagaaaattaggtcacaatgttgtacagattttgctctagaagtatacgactggactgactgcatggtaattctctatgagcaactcagcatgatggttacgctcgcggctaatcatcattgtggaaaaagaaacgccgaacttaattaatatgcattttctcatctagtatacccgattggaacgtacgatgcgaaaaatagagaaatcgattttgcacgattcaaatcatatagggtagttccgacgtcatttggaattaattagtgggtgaccccaacattaatgtttttctttttaagttcctagccatggcttgtcctttagggcggtcccaacccatgatatccataagcagtgtctatgataccatttcaataagacatcacaacataaactacactttacaacccatgatttcttaaagtgggccattaataaatacatcatctctcttctctaccaataatatttattcttcatctattatgaagacactattctctcccaatgcaaaacttgatagcgttgaagctatgtcatgcatgagacccagtttcttcctctcttcactctttctcttaattaatatagtgtcatataagttaaaagtcctacatagcaatataattaatgtcatacacaccatcctaggtggagggttaggactgcccttaatagtaatgacaaaatatgaaaagctaagactattttttgtgggttattacttattactagcgtaccgtttaactataccgtacagcgttttctagtctgtacatatgttttttcactgtgctgatgaagagcgcggactgcatttgtaatagttagaggttaacttctccaatttttgagagcaaaaaaatttccgttttaatttaggtgatgaccaacttaaactattgcatgattaaaatttgagaacaaaataaaaccttttcatttccaacattagactagaaatgtcatcaagcttttgagcatacacgtgcataatgcatgcctaggctcgagtaccttgtgcatttggattttggtctcgcttttcataataggtctcatgagcataaactaaaagggttaaaattactaaacaaacctatagttaatcttgggtgataacatgtggacttaatattaaactcaaatatcatcttctcagcccaaaagaagtttaatgtaatccctgtaacaatattaggtgcaattatgaagtgggaacacatatacaaagtaaagtaatcctaattctctaaaatattatgtgcaagttaaaaaccatggaaaaaaattagatagacaatgtttagcacaagcaattcactataatattggtacaagttaataactaagtttaataccacaaattaatcagtcaaagcataaaactaaaaggaatcaaattaaattttaatcggctaaagccatacttcatccaaaagtacatttaactgctcataagtgaacatggaaaataatttattcaaatactagattatttatcatgcctaaatataacttttctagaattttcctcctctatttaagcctcctaaaaattcaatctagctttctaatagcccgtctttgtttaatttctatgagcagtctacccattatttttaagtgcaatcaaagaaaatggaatctagatataaacatctaccaccagtaaaatctacactaattcttctggtccacatattaagatattgagttgcaaacttagggggaagaaataattccgaaaattatccaaaaactaagtctacccaaactcctacccatacctctcttcctagcctagcttccatcgacttggccccacctggcagcctctccagctcgcccttcttctgtccgtcatccttagccgaccaagaaacacagagagcaagagatcgagagccgaccgagtcctggacgcgtcgacgcgtggtgacgacgtgtcgacgccttcaagtcactgagtcatgcctccatctcctccagaccgagtcgcccaactccacacatcactctggagctgaagaagtcgagggagaggtcctcagcctctccgtcatcctcaacctcgccgccggtcatagtgacgacgaccttcgccatctccgtttgagtcaaggtcacctccatctctttcgcgttcccatctctccacacaatgccgagcatttcctcttttgacctaaacccctctcgtgcagtgcatcgctgggaacgcaagccacgctgacaacgccctggagcacgcaccggagcgccgccacttcaaccatcgtcgtcgtccggccattctcgaccacctcagagcaagccactgcgccatcgtcatcgcctcatcctcctcttcaatacgcctcaagaaccccagccggagatgtgaaggacttggagaacacatcttttcttcaccggcgccgatctagaattgcctccgccgtcatcatcgattaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagaccacatgcatgcatccttttcgttcggaatcgacttccatgcacacatgcactttcaccccaagaaccaccgccgctcacactcgccatcggcgctactccgatgtcctctaaccaagaaaactagaggaatggaatcgcgagagcttgctcttcattttatctcttgacctcaacctcaaacgagccaccgtttgccgccggcgagctcgagatcgagctcagccatggctagctctgctctgtctagagcagagggatgacttccgtgaattagattaagtgcagggatccgtttacaattgtagaaacacactgacatatgggcctaggactgcgggttgattcctagaaacctcaagggcctttgtgcatattggtccctcacagccatgtggaccccatcctttaaaatctgaagaataattaagaaaatgcccaaacaaatatatgtttagcagaaaaatgcacaaagttgtaaaatctatataaaatcaaatatagctcattttaaagtgattacagttgctgtagattcttgaagttatgaactttattccaggaatataaaacttgacactcactgtacaaataatgtctctaaaatttatctaagataggtcatacataaaacatgtacaaacttataaaatacatagaaaattcatctcaactcattttgaaacaaactcaaaaactgcagattcatcatcatgcatgcactctctgattaggtgaaataaaagtaattacttactttgcatcaaattcctctaaaactattatatctaaaatgattagttttagataagctaaactttagaaattcatgtagaacccaatttagcttcaatttgaataaacttaagttctgtaggatcaccaaaacatgtatttccatgttatgaaataagattatatacttactgtgtagtaaaagtctctaaatattcatataaggatttactaacatagagcagcctttaatttgtaaaacttgtagaaaattcatttttagtccaaatgaaatgaacaaagtttccatagaaccagcaaatagttatcttcaacatagtaaaataaaatttggcaccttttgtagagaacatagatcaaaaccttaacttagtgaaataagaatttaaacacatagtgttgtttaagtaatacataaacatgtataagtatatatacactttaggtctaattaaacctaaataaaaacttgattgaccagtgaagccatagttccatcctcatccactaaaacttagaagaacttagctcatatgacaatttctaggttaatataatatattgctagtttagattagagcatctctagtttataaaatatgaaccatagtagtaaagaccataaacatgtgaaataaaaatgttttagttaaccaaattattccttttattcaacttaaacaggaagtagcatgttctgaacctataactcaaaagtcatgaacatataaaacactatatgcctaaaacacgttgtaacttgtaaaatctataagaaaatcattataactccaaaaattgtgaaaccaaatgtgttagtcttagaaaacacatctccacacccctgtgaagtctaatataataaaaatcactttacaaaagtattttataacactacctaagactatactactataaaccgataaaacttctaaaattcataactcccaaatggaataaaataaaataggaattatttcacctaaagtcattttagatcagtaccaacccactgtgcataaatcatgcattttagagcattttggattttcagctctttcggtatttaattgcatatcgtgtcctttatctagataattgcataatcggtgaagaagtggattaggtgctaacatttatctgatcaaggcaagttttctcctcccatcctttgaacgcattgaatcccatgatttgaggaatgaaaatatttgtttgcaaagttgcatgtgaacttaaactatattggtatttaaaattgggttaaggtagttatgacctatttgctgcattccctaccttgaataattgagcctcttgcagcttgaacccctagaaatggttacagtacactctttgtgctcaaattggtttatatatgctctatgtgcaactacttgcttagccatgcttagaaatatgcaaatgctcattccatctataattaaaatgtgattttcatatgtgaacctttgctggaataaaatgaatatgatgggtatttgcgaactaaaatatgtaaaatgtgattttatacttgggcggcaagtggtgtgcatatggtgttagttgcataccgatagggggagtgtttgcccaagtccataaggacagaacttgtgttacccatttaaagttattcgtacatccacatgtgctagtatgggatggcctaagctgattaatctatttaggaatagccttgcattctggtaggccggtgtgtatgagttcgtataattcagaggagcttcctatttaccccgacgtggtagtttaggtgactaagcgtgtccaatataacggtattgtgccacgtggtgggttcccgtcgtgtccgccaccacggcgttaagtttaaggtgtgggcccgccacttaacggttctaggtatattccaagtatgcctaggatggaggaacacgtatcgtgctggtgcaaggctaggctctaagtagtgtaaaggcttcgttatggcctctagatcacattcaacatgaagagtgtggtggagtcttgcaaactcaaaacaaactagagagttcatatcatgtgggtaaagctgtacaaactctgcagagttctttaaactaattgattagccatgctcacggtcatgagcgctttggtgatgtgtcatgagtatagactatgttttaaaaatgtgatcatgtgacattggtttgaaattgataaatgtgttgagttgtgtgtgtggtgatacattatgacttattgttaagtatggcaataagagattgattatgatggaattatgaagaagttaataatgaaacttaaaacttgtctttgttaattgaagcatcaactcctttacaaaagaattgcgaaacaaaacttgctttatgctgaaattgaactacatatttccttcctttgaatatatgccttacatgtagtatggtaggattgacttgtgcttgctagtacattaacttgtttaatgtactgactcttgctgttgatataaccttttgtttgcaggtttagacttagtctttgagtgatgcgggtttcgattgcttcttctaggatgagaacttaatggggtaaacccttagtcggtgtgcttgtgattgggtagtcaagcttccgctgttctctaataagtctatttggccggtcggcctatctaattattaagttgttgtatgtcttaagtttctttcatcttagttgtgtttgctatgtataatcatgcttaagatgaaagtgttaatctagtgcacatcatcctgggaactagatttacatgagtatgagttaggaatatttgagaggttgtagatctttagtcatttttgtcaagtcttctgaatgtgtaacacatctggtcgccgccttcgagtggtttgacgggcacatatcaggctgaagttgactggcaggctaagggctcagcaatgtctccaatatttctctctcgaggcgtcggatgtttcattatgcttgtttgatgacttgaattattcacttcatctctcaaatatctctcaaatataatgaaggtccggagagcctacgacagcatttattataagcacaagaaaaacattggtgttcaaaaaaatgtcgatcagattttttcaggtttagctcatctatattaatgccagtaaagacttatagtgtaaaatatataagttgaaacatttattagcgctaaaaaattatgaataaaaatttatcagaaatattacaaaatggtataccgttccaacgaaatagatgacgtcatgatgccgtcaatatgatacctagatatcggatctggtacatacgagatatcatatatatctaataccggaggtactagatccgatatctatgatatcatactgatactatcatgatacctagttatcagatctagtacatacgagatatcatatttgataccggaggtaatatattcggtacctacaatatcatgttgatgttagcacacattagcattctgttagaacatgtatatcgttctgtagtttccctcaacttttatacatgtgtttttagtgactcaagcaaaggttgaaaaataaattatgataaaagaacattaaaattaactttaaattcacattttagttgtggctgataagctgacgaataaacgatggtagtttatactttatagtagcatgtgcttgcaacttttcgttaggaattctaccaatatattatatcctctatttcttaaaacaactgaaatggctaaaaatgtgtttcccattttagaattttcatcgaaattctaacatttgaaatattgtatctatatattccaggcacttaatttcgcggtccaaaacacaccgcataatataattatttttttcaccggatgcataatataattattgcacttttgacttttatgtcatatgattgttttcttttagcccgtagcaacgcacatacattccggtagtcttctcaacaacagtaaaatacctgttttttcgtgtataactagaattctttgtaatcttggtggcgtgcaggcatttataaatccgtatctgctgtactcgaatgaattaattaggcgggactttcgctctcttcgcaaaaaggttctctgcgacataccctctgctttctagacacgcgtggccctgaacatcgatgtacacagtacactgcgttccaatgcgtacgaacacctgttgcaaatggcaataatactggctccacacggtgatccactctaacgtgaaacaatacttcaatctcagaacatgggaagtcaacaaatgcagatggaatgtacgcgccatatgatgtggactttggaattggtatggaattcatccgatgcaacttggatccaacaagcactcaactcggttaattaccaacgggatatcagaatatgcatgcagatgatggctaatcaccagcaatggacgcatggttcattgtatcaggatgacgactcctaaatccggcaagtcaaaaaaatataatagtaactacttgaactacatatgcataattgcaggtatgcatgtctctcttccatgttttgatgtttaatctgcatttgctttgctgtttcactgagtcaatgaaagaatgtgtctctgtcaggatctgtaattaattggtatcaactgaaggttcatccagaagaaatcaaatgaggatttgtgcgaatgcgattgcatcatagatgacatagcagtaccaaggtcagagtttatttttatgccttgtcatatctaggcgcacaccatgccaattcatgatttcttacttagtacattgcaccttgcatcatcacgttgatgatatgttaatggttagcgacgaacatatctattctaggcatggttgtatctagtaaacgattattgttttctatcttgctatataaatgcaggaaaccaaatttgcagaaactgaaggttcaccaggttttggcaatgcgtcgtggatgacatgaaaccagttacagctgcagtttcagttatgtcaaagatgcttcatttatattagtgtttcttgaattgtgagccatatactttttctccttgctaatcttgtgtggatatgaaacaccggaacttctctgcgcctacttgtttatatctttcgtgagaaaaaccatttgcctgaattttcagagagaagcttgtttgctgcaactactcgattccaacccaaagtacaggctgtggaagcagaacaccatcgtccttgtcttacttttccttgaactcatcctcaagccagccaacttcccagtattttcaggttttcaaagagcaattcgagacgaaataaatttcacacttaattttcgttatactactattcttaaccgattaacatgtgcacaagtcgaacctgaactagcccgtttccttctactacttttcagtagaaaatacccttgaaccccttttgtttcagaccaggatgtgcccaggtcaagagaaaaaacttaactacccagctgttgctgtgtctgcaactctgaatgcaatcaagacatcaagatcagaagataccgtgctgcttttgaaggtgatttactgagttctgacttgattagcagtcgactacgtactgacttagctatccagtgggaaggaagtcaacacacgggaaggactagtagtagtgacctcgccactgatccaatttgcagcttctttttttcagagttattcggtttacttgccggagtagacgactttaggaagctagcttgtgcagtacttctcaagttgtcgctgaaaagccttacctgatgaaagagagaagatgagataacaagttgcttctgagattgaagtcttgtttcaggttagctaagagtgctgattaagtgtgtaaggttgacagctctcttcaaccaagctgagtttccagaaaaagaacccaatgaggcaaggatctatggaccatttgaaacttggcaggacattttgcaagtatagcacatgccctaatatttttgtatctgatctatttattaattttagatagagaaaggaccaaggatatgctaagagaaaatgttggggctgtttggttatttgccaaattcaaccctaccaaaaaggttggctctgccagaacatttgccacttgtttggtttgctaccacaaatttggcgatacctttttttttccgttactagtctaactaatcttgccagcaatccaagcaatcatctttgccaaaaaaataatttgcaatagccaaatcttgccaatggttgccattgtaaaaatgttagcaatactaaaaatggaagagaatcaagtaggcccattaaggctgcgttcttttgtagggttccctactcccctctcgtttttcatgcacacgttttttaaactgcttaacggtatgtttttttaaaaaaaaattataggaaagttgctttaaaaaattatattaatctattttttaagttagttttagttaatacttaattaatcatgtgctattgtactccgttttccgtgctggaagagaatagaaggttttcaactagcacaacgaacacagcctaagccctgctacttcatcaaattattgctgtgaattatttgctctatgctacttctcaagaaaaaaaaccagcacttattctaagtcatttgttaagtttatcttaaaatattgtattattcctataatcaagtagataatcaagtaaaaatttaggtctcatcttttcgcttatacttatacttatacttatcggccaaaatttaaatttaagctgattttaaggtctttttaatcaaagtttattttttagcctaaaaacacgtatataaaaattttatttacaaattaatttacgtttacaaatatgccgtttcgcttattcaaaacaatgccttttttgaatgggctctaacgcccctggccgaaggatttatttattgatattcttatctttttcttaaccgtaagtctgtaaccagcccaataattatgggccgttgtttgggctttgggccggatcatgatattgcagttatcggatttgtacccgaaaaggaaaaatccgcttcactcgcctcctttctcctcctccgtcctcgtcctggtctcgcggactcgctccctcctcccctccgccatcgcctcgctcgcgcagcaatccgcgacaaatccaccagccaatcgcggcatcgcgcccatcccttcccctatactgcaaatccgcttccccgagatggtaatttccttccgccagtctctcctctcacgatgtttaattgcgcgcatctctgtttcttcggtctagttatgtcgtttagggtttatgaccaagagcagatggtgaaaaatccggagttcttggtcactcggcgtgccattccatatcttttatgcgtaataagaccttttttttatgtttttgtttcccaaattttgctgtctggaaataatttcttgaaagggttggctttgatcgtttgctcgtgcaggaatcctgtccttcggtgaagaacattcttgtgctggattccgaagggaagcgcgtggcggtgaagtactacagcgatgactggccctctttgtcctcgaagcaagctttcgagaagtcggtctttgctaaaacccagaaaacgagcgctagaacagaaggtgattaaaatatacttttattctagttctgttctggaagaatcaaaacaatgtttgtttcttttttttcaaaaaaaaaaggtgctctgtgctacttgtgtagagaacaactgccttatccctgagaacatcaattagcaatttagcatctcacaatatggcattgttgattattgtaagactcctgtggaatattctagaggcatacacatatcttccagttcgagcatcattccattgtttggctcatcttctgtaaacctgtggtttgcttgttatgagatgttaattggtcgatttctgaattttggcagagttatcaccagattttgctgtggaatactaaccttatattatagaataacaggttatctgttttttactgctcatgaattccgttgcatttcttaaaattgactgaaagattcaagtttcggaaaaatgaatttttgttccaacaaatgaaatgatctcgatgcctgtgtcatctgaaatgccttatttttggttgatcattcattttgggggattttagaataattgcattgcacatgagtgtaaaatttgcatggtaggttgtttagttcaagtcatccaactatattcatccagtgatttctttcttttctttcccaatttgcagctgagatagtaatgtttgacagttacttcgttgtatacaagttcatccaagatctacacttttttgtaactggaggtgatgaagagaatgagctcattttagcatctgttcttcagggcttctctgaagctattgattaccttctcaggtgtggacatttcctgtgccgtacactcctatcttttttaacatccattataaatgcttgtcagtactgtatactattttaacaactctctttcttgttttcagaaacaaagtgcacagaagggctgcgcttgaaaacttggatcttatcttcttatgccttgacgaagttgttgatggagggtaattactatgtttgcattgcaatatgctaacctttgctttccatcaattgaacaagcccagttttgataactatcacatttttacgttcatatcaaaggcaacagacaaggtcttgggcttgtattgctgaaatgtgaggttaggcactagttggttaatgtaaagaaactacactctggccttgtttaggtgatgagaattgagccagaattttacacaaaatcagcattgacagctatcagttatctataatatttttatagttcattgttgggtatgctcagttcacagccaaccaattttcagataaacatttgcacaaatgctatgctaatgtagaacatctacaatcaggcatattaaacatttgacaacctgtagttattgattgacgctactaattgtttcttcacaatcgggttttgcaggattgttctggaaacagatgcaaaggcgattcttgaaaaggtatcaggtcatggattggaaggatccgggtctctcactgagcaggtatggcaagccgtcgcatcaccttaagtgcaattgcacaatgagatgcaatcatggtgtcgtaattgccaccaaaccaacatgagaaaattcccaagtgaattaattcttttttgtacatgcagaagttaagcagtgccctagcaacggcaagagaacactttgcgagatctattttcagctgatggcgtgtcatccttcaggttgacgatgagcaagcctcagatagtgtctctgttagcagatcagtactcccagtttgcaatgtcctttgaacatttgccacgggttagtggtaggtgcagcttaactggcgatcattgtcatcctaagaaggttgtggtcggcacacttgttactcttgtggtttcatgtcgatcttggctgtaatcgagcacagtaaccatgtagcaacatgtttctgctcaaagacgagccagtttccaaattgtcttcagtatacagccgccatgttttgacgtagtactacatacatttacttcggcctggtttggaatttgaatggtattctttatagctaagttgcttaataatgtttgactaatttcagaatacttgctatcaaaaccgaccaatcatcgaaagtaaccaaaattcgcattacaattctatcacctgttggtatgtttcatctcatgtcaaggtaaacaaaaagagacaaaagtaatcaagcaaagcgaccagaatcacgccggcaaactgctgccaatcctgctcacatactggcacagctggtccctcagcgcggccgcgccgacgtcggcgacatcgctgaactgctgccggtagccgtcgtcgtggttgtgcgacggcggcatgccgcccctcgccgcgtcctcgaggtcgatcatgatgttggtgagcaggcagcagacgtagatgatcctcggcagccggtgcttgtccggcctccacagctctcccttgagaacctgccacctctccttcagcttggccagagcaccctgcaccaccatgatcgtcgcggcgtgccgcttgttgaagtcggctttcgccggagatagatccttctcacggtatggagtcatcagccagggaaggagagggtagcttgcatccccaagaatgtagtctctgaccactgacccagctggctctcctggaagctccgtttgtccgtccagcctcgcgcctttctcgcagagcctgtagaatcctgaggtgcgcaggatgcacgagtcattcaagctgccaggccagccactgacaacgtctctgaaccgcatgtcggcatcgacgatggcctgcaggaccatgctgttcctgttctcgccgtcgagccagacattgctgttaggctgagctgaagagcacatgaggatgtgcgttgtgtctatggcgccgcagcagttggggaggccctgaatcttttcaaacttagatttgacggttgccatctcctcaggagtaggccacttaagatgattggcagcgcgctcctccaaggcctcaataaacttccaagtgatgtttgagatagctgagtggttcatcccgaagcggttccctatgctcaaaagcgactcaccggtggtcaatcttaacagagcaacacctacttgatcttccacgcctagaattgccttgtctccaaacctgaaatttctgaaactttgtgtctttcttgtgaagtccccactaatcagagagcaaaggtagtcaaaggtcttcctcgacatcttgaagacggactcaaagttttggcagtctttggaaaattgtcctgtggacataagacatagtcaaagatcgcagtggcgttagtcgagcatatcataaattatttggcagggaacttgaaagcataaaagggaaaattcagatatattgaaattcaaagaattcgattcgttctcctcatattgaaattagaagggcagaggaagaaacggggtaaaccttatgatagcaaatttaacagaagagattcaaatctaatagaacatggtccacaagtgtcgagaacagaaaatgaacaatactagcaatatcatgaatgaactgagcatattatatgagaaaaggtttagctgttttggcaatacagtgaatatcgattcaaaatttagaagaatcatcagtagaagggacactgcccttgttaaatagatgactagaatgctatcattcctgtatctaccttcttaaatcactcacacttgatgctcaggtttgtactaattgttcaaaatgtcactcttgtcaaaatttgaaaattctaacaatgtcacttgtcataaaggataggtaggcattcaaaaccaatgttttccagtgtttcagatcatttcagcaatcagggaagctcagaataaatatcactaacgacttcaagaattcaaaaatatattgtctatgtttttgtaagaacatgtatgatcaaaataagaatacagcagccagacaaatagctatacaaatctactttatttgttcaagctaaattgtacttgtatgggctgcttcacccaatgatctctgaaagactcacttgaacaccatacagagaggcctaatgaatctatactcctggatgatctatcacattgaattataaaacagtatttgctgtggtaccaggtactataagattcaagaaacttatcgtgggaatccatttctcggaacacatcattcaaccgacctacctttgagccacactaatcattttctggatttgccagtcaatctattggaacccaatcccctcacgtgtttcctttaaaaaaaaatattaacagccaatcggatgatgaaattggggaaactacctgtgaacagatgagctaattacttaaaaaaaacgcatatgctacactttacaattctggactgaacaggcaaagcaattcgatggcaagtacagactaattgttctccgggagatgttgttttccccttagcaaaatgaagttacttcataagttgcaaagagaaaagaagttagttcttgcaatgtcaaggcatgaacagtcaaccaacctattctgaattagattgacacaatgggcaaaagccaacagcacccgtaaatttctagccccaaaataccattgcaccaaaggcttcatagatctggattggagaaggaaacaacaaaaccacagatggcacaaccaattcttctcccaaacacggtctactcgatcgatacccatcagagcaacggcattcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29236 - DNA, 243 bp, Oryza sativa
cctttttcagggcctaatcttttcacttatgcttatgcttatcagtcaaaatttaaatttttaactttaaatttgaagttgattttgaggttttttttatcgaatttatttttcagcatttatttgtagatcgctaagatatatatatatatatatatatatatatatatatatatatatatatatatatatatatatatatatatatatatatatatatatatatatatataatttgtattt

SEQ ID NO: 29237 - DNA, 727 bp, Oryza sativa
ttcctgcagcccgactccggcgtgcgaggacgaggccaatctccgccgctgctgccacaccataccactaccaacggcgatcggcggtgggcggcggcgccgtccggggcggccgaccccccgacggcccctgtggatgctggggatggtgagatgatgcgcgttagtggccgtcggatctgcggtgcctagttgggcttgggcaacggcccactgataaatcactatatgttgtacggcccattcaatgggctcctgcaatccggtccctgtttaggagtgctattttggttcgctattatggtacgggtatataacattttcgattttttttcatttttaaatttttattttttaaatatttacagaaatattgtaccggcgaaaatatttacagaagtaggcctgataaaaaaaattagaaaaatacatttttggcaaggcgaaatttgcatttgcccccttgcagcccttgcagagggtggcaagggaccttagtacaaaatgcgcacaccttgccgccctccacttggacggcagtggccattcctgtaaatattttggatgatataatatttctgtaaatattaaaaaataaaaattttaaaataaaaaaaattctaacatcttcattccggtccttttttcagggcctaatcttttcacttatgcttatgcttatcagtcaaaatttaaatttttaactttaaatttgaagttgattttg

SEQ ID NO: 29238 - DNA, 548 bp, Oryza sativa
  unsure (1)..(548): unsure at all n locations
nnnnnnnnnnnnnnnnnnnnnnnnnnnnnnntgaatcttcttctccggcgaatgggcaggtgctgcagtcgcagcggggaagcagaaggccgccgccaccgccgccgccggccgacctggtgcgagaaaccggcaagccctcggcgatatcggcaacgtcctgaacgcccatgtggtcgacgggtaaggagcagcacgacatcatcgtcgccaaccttccccgattcgttcttcctctcgtttccttctctgaaaacctcgtgttcttcttgcaacagcaagatccagctgccggaggggatcaatcgcccaatcaccaggagcttcggcgcccagcttctaaagaaagctcaggagaacgccgttgcggcgaacaaggtacggagtgagacacaccccccttctgtttctcgtgttcttcttgcgaattcagagcggttgatttgatccctgatttttgattttggtcgcagattgtcgtgcagaatccggccaagaaggagccagctacgaagccggcaaagaaggtcgtacccgtccggagaacg

SEQ ID NO: 29239 - DNA, 1329 bp, Oryza sativa
cagctggagcgccggccgacagactacatgagcagccaggtcgaggtgaaccccaagatgagcgtcgatcggtccaacgtacgagataatcagagaaagaagaggaaaattgccaggtggcgactcatctgtagcctgcgccatcccgcccatatgcaattgcacagcactacactagctagcgcgcagaagagcacagattttctagagatcgaccttggtcctcgtcagaatcgctgtgtgctcttctacaacttttgttctttagattccaggaagctgttgaattgattggttattttacgagtttgttggggcgattgacgcggtgtggacttctttagctttcgttcggtactgctgcttatatgttgggtggggcaggtgtgtcattggctggtgtgtttaggttttgggattagattgatgctattttgtaggggtggacagaaaaaaccgaaccgaaaataccgagacagagaaaatcggtcattaattcggtcctaggaagtgaaagatcgaattttgttaggttaattcggttagtctcctcggttatctgaaaagaccgatttaacaaaaaaaaaaatctagatgcaacctacaatccactaagttcaataggataaactctaattttcacatctctacttcttataggcatgcaacctaataagagtctttactcatacgtgtttacaaattttttttgtgatttttgtgttgaaaattttcattatttctttgcatatatgaaaatgttgttgaatttcggtcaagaccgagaccgaatttatcggtcctgatattttcgcgttgagattcagtattcacttttcaaacaccgaaataccgaagatcaagaccgaaattttcggtcatactgaatgcccacccctactattttgaaccatattattgtctggtaatatcgttcgtcctatcaaaactttacaatgttgttaatttacgaaaactttaatattattaaattttggaataaattattttgatgcaatctgaattaagactcccagttttgatgccaaatcgtccgttcacacaaattttaagatgcgggagaccgtttcggcccaccctatctagaccttaggccatctggtccaacctggccggcacaattttcatttgttttcaaatgaaaaaacacatgggccaatcttttgggcctggatttgacgaggtttgggccgtttgactaggtctactaccacgaataccagccgatttgtgctttgaatctgggaagggatttgatttctactttttctgactgaggtgagttgattggtactacataaaccactt

SEQ ID NO: 29240 - DNA, 526 bp, Oryza sativa
ggcagtagtcgaatatgatcacgtcggatttctcgccggtgcacgccttggacgcgtcccgcaccaactagtcgagccagaaccgacagctggtgccattgccgccgcagacgatgccaccacgtctctgcgcaaggccgtacgcagtgtccggcaccgcgccggtcgcgttctcggcgaaccccgatgtcaatgccgccacggctgcggaaagggagtagaggagagcgcaaaggttggccccaaagccacggtcgtcgacatgcctggagtcggcgctgcttgtagttgaacagcaggtcatcccggcgttctccgtgatgccggtcagcagaagaagtagtcagaagctcataagggcgcgctcgggcttactcgcgcccggcacgcagtagaaggcgtcggcggcgccattgatgcggtgttgccacgcctccgcagggcgtcgcgtcgcgacgcgttgctttgtttccgttcagctcttttgaggagaaagctacaactcgttaatatcaatgcgtgtagc

SEQ ID NO: 29241 - DNA, 717 bp, Oryza sativa
atataatataaggcacacatgcgttttaagattcaacttttaaaacatttgattaactattatgaattttatttgctgaaaataatacattggattgatatttgaatttaatttcatatggttatagtttacttttatattgctacaaacattatactatatataagaaattagaatccaaagatttgttttaaagaccgtactaagtttaaccgacttatattatgggatagaggatgtatgtgacaggggggctgtcaaggaaccttacccttacctgagtaaggaagcagccatcaaggcagggtttgtggacaaagatggcacagttcagtgggctagttatctcgatcatgtcaactttcaaacactcatgggggaatgcctccttacgacgaggaagcatctgctaaggaggtgagtgactgggaagaagctgtgaagcagcaggatgtgaaggtcgatgaggcaaccatgaaggccaggtttcaggactggatgaaggagcacaaccgttcgtacagcaccgaggaggagaaggctcgctgctatgaaatattcaaggagaccgcgataagggcagacaaggctaatgcggtaagaccaatggatgtccctttcgcccctaacggattcgcagactggactgatgaagagtgcaatagtctgtattcccatcctggtagctttgactgggagaggtacatcgatcacatg

SEQ ID NO: 29242 - DNA, 582 bp, Oryza sativa
  unsure (1)..(582): unsure at all n locations
nnnnnnnnnnnnnnnnnnnnnnnnnnnnnnnnnnatgtgaacaacatacttataatcagcacacaaagaaatagtagaacagttgtggcatggatataagtgaaacattatcacacaactcttctttatcacaaggaacaacaagtaaatcaacttgtgacaaaggcaactcagcaattgattccactaatggttgctctactatagcatgaaaagtggacaagtgtagctcaccttgagaatactcaccttcatttctctcagcaccatttaatttaccttgcgaacttttttcagacatcgcaggtgcttcatcctctttcttctcaagtataccattctccttttcttggatgtgctgatcttcctgcaaaacgttagtaacaggggagacaaaagattgctcctccaatgtttgcacatcatcattacataagtatattggggattcagaaataggagataaatcacattggtcatgcatcctcgcctttgatatgatctgactctcaatgctacgagcaagcatgaataggtgcccaatatgattatatgggtaccgagctcgaattcgcctatagt

SEQ ID NO: 29243 - DNA, 695 bp, Oryza sativa
  unsure (1)..(695): unsure at all n locations
nnnnnnnnnnnnnnnnnnnnnnnnnnnnnnnnnnatacagatggcccgatcgaagaagagtcgtcggaatctagtagtgctaagttacatatgagatatgatggcctaacattaacactatcagcagcatctgcacgacaccaacatggctgcagcagcctaccgaccatgtacgcctggctttgctcacaaaacgcattcccagctgcagcaacacaggcataggtagcatggagatggccaaactagcaccggtctctgttgttgctgctgcagctggctcctttcctcttcctcttatgcttggatctcctcctccatggatctcatccggcggcgccccaacgtccacctaagctgctgctctctgttgtctgcacactcagacgctgctgcctgcctgcctcccaagtcaaggtgatctcagcaacaacaaaacacgacgatgaaaagcaaccggagcagacgaggaagaagaaacaccagtggcacaaggaaacaacaacaagatacaccatgaggaggctggtggccgcgcgcggccaagtgcggcttctcgctgggcctcgccgtcctactcggcctgctcttcagcagcgaccacggcttctggtcggggctcatcgtggccaccaccatggtcgccatgaccgccatgggtggaggtggggagggagacgagtggattcgccatg

SEQ ID NO: 29244 - DNA, 4664 bp, Oryza sativa
aacctccccgtcccgtggcggctggagagaggagaggggagagagggagagatgaggaagaagggtagggtgggaacgacatgtggggcccatgtgggccccaccatttttaattattttttatgtaactgatatgtgggtcccaccagttttattatttttctggatgaattgccatgtaagcgccatgtcactgccatgtcatacgaagaccgagtcaaaatagccacgtaggcgccacatcagcgaaaaccgctatctaaaccaccgagggaccttatctgcaccggttttgatagttgaaggattcgttgtatctggttttagggttcaaggacgaaaattggattcgttgacaagtttagagacctcagatgaacttattccttttaattttggaaaaatacatcgaaagtctcttgtattgtcatcggattacaaaatcatcctccaaccataaaactagatatatgtcatcctttaacttacaaaaccgggtcactctaagttcttaggaagttttgaccccggttttatctgacatgacaaatgagtcggcgtgggccccacacgtcagctgctatttcccctccctctccacctctcttcctctgtcatcccatcctccctttcttggcaaccaaagtcaggggagaggagctgggcgcggacgatggctggtaggggaggagttgagttgaccctctctctttccatcttctatgccttcctcctctctcacttttctcgtcggtgtggaggaggccggcgggacgatacgggagaggaggaggtctggcggcctctcgtcgtggctgtcgcagcgattgttgctaaggaggagtaggcggttgctgccaaggcaaggctgtgtcgggcaggacacggtagcatggacaggggcggcggagaccatccgacaggcggtcaatggggagaagggcagccgactgcaatggtggacggatggatttgtggtgggaggagcgggcaagctcaccggcctccctgctcaccggcctccccgctcccctcgctggacccgtctcctccctctccatcactcgtcgttggcctccctgcgcccctcattggccccacctcccccctcgacggcagctttcctcgattgctgctaaggaggagtaggcggttgctgccaaggcaaggctggagggaggaggctgtgtcaggcaggacacgagcagcatggacaagggcggcgaaggccatccgacaggcagccggtggggagaagggcagccgactgcaatggtggatggatggatttgtggtgggaggagcgggcgagctcaccggcctcttcgccctcctcattggacccgtctcctccctctccgttgctcgtcactggccttcccgcccccctcgttgcccccctggacgacggctttcctttgtgcctgcggcctccccttctcctgtgccacccgtcgttgtgttgccggccgccgatgcccttctcctctcccacctcgacctgccgacctccttcccacttgccggcgagcctgcctagagaagagtgagagagagagagagagaggaggatgaaggggagaagaagggaaagagagggtgatgacatggtcaccctgacatgtggaatccacgctgactcagttgccacatgagacaaaatcaggatcaaaactgtctaaggacctgagtgatctgattttattagttgagggatgacatatatttggttttacggttggggatgattttgtaatctgatgacaagatgagagacctcatatgtactttttcctttatttttattttttatttttggatatgagggccatcaagtatatgtatgcacgtaggagtacagtatgtcagtataccgtagtggtacaggacttgctctgtaattagtactgtatcggctgtataattttggcaaatgtaattttaaaaaacgggcttccgcacgttgcttcaactcccacggaggcacccaacgtacataaaaatgtagataaatgttaatattctacaatcctgtattatacagaaaaaaatgtataacgttgtacaatcctgtaaataccaaaaaaaaatcaatgtttttttcacccttgcactccacttgatttttttttcacccttgctttctcaccatgcataaaattcgtaccaaacgtacatatttacatacttctttaaaaaaaataaaggtaagtaatagaatcgagaacctaaacattccggtgtcaatctcaaattctgaactctgtaaagcaacggtgaatagaaatctgactaggccgcgtagtcaaccaaaaaaaaaatcatattcagacataggccctgtttagatttccacctcaaaatttttcacctgtcacatcaaaacctttgaacacatatatgaagtattaaatataggctaaaaaacaactaattgcccagattgcgactaatttgcgagacgaatcttttaagtctaattgctccatgatttaacaatgtggtgctactataaacatttgctaatgatggattaattagacttaataaattcatctcgcggtttactgacggattctgtaattagtttttttttattagtgcccgaacaccccatgtgacaccctatataatatccgatatgacatgccaaaactttacatctctggatctaagcacccccatagtaactgaaccgagactttgcgcgcacctgaaaatatttaatcagtaataatattaagtgaaaacagtctttctagtggttcttttcaatattttccatcaaataccagtagctactagtaatttacccgtgctaacgctaccgcggtaatacatgtagaaacacaatgcatgtcatggaaacatttctactactccactattcatttaactgaactggtgagttgggtcaggtagactacttgagtatgcataatgtggtttctgaacatttgtaggaaaaaaagaagaagcttggagtacaactggggccaccgcttcctcaaaaggacttctgaacaattttgaaaatgtgcacttcaagtcttgaaaatacatactattatacaaaccaatagccatataatgacaaggaagaacttgtcggtgaatccgctcaatacgaccaccttctaacttcccaatgtttactggactaagcacaaaatcgcatgattttagccttttgagcagcagaggcgcgcggtgcgacagatgcctctttcctcctttgcctatagttagggctcttctgtatgtaccacctaaagggcaacaaaacaactccacacaaatattagcacatgatttgcattaaatacatgaaaaaaaatcaatgaagcatcacccaagctaaaaatggaatctgacacattgttaaattgtcagaatatctatagtaatttgggaattaaacacacataatcatattgacatgccatcaccaaagcatatggtttacgagcaatcagcttatgatcacaaacatgtttcttttctgttcctttagtaaatacactttatttaaaacccttcctttgtaccctcagaggagcagctgcccattcttttgaccacaaactgaaatatttgttgagtcatctcataaatccaggcagcaaatgtgattccttctagcaggtcctttttatgctttttatgaaccagacaaaatatacgattgtgtgcaccatcttaaaggataatgatagaatacatgggcatgtgcagcaggagcaccaggggaactcaaaaatattagcaatgcagtgttcatttgactataacatcagcagcaccagtgataaactcacacatgtaaaacctataaaatttggtcaccaattcagaattgcatggtaaacaggaatcccattaaaaaaaatctgaaaactcgacaatccaaataggaacaccattatgaaaaatctaaaaacttcagatcccatatgtaggagttaagggaatagtgaagaaactggttgtaccttcaattcagggaatgagatacaggaagggacagtagcagctgtttgcagtgatacgggaatggataatcaccagcgattccttaaggaagaaacaacggcgaggcaacgcccttgatagaagttgttctgcatatggatatataatgacatcatatttttctcaacggagagtcaagaaaaaaagcatatttgttatattttaaatgaacaacaattgacaggaaatttttcagtaactaagtttgcaaatttgttttgatcccatcactacctgcgtgacaactcgtacttatttttttcctactctgctcaaccttagaagcaaatcgcccaagcttatgttacactacattttgatttttcaaaccagtggtgacaaagaatgtctttttgcttctttaacaattaaatgatcaacacacataagcagtttgttttaacttccatttttttcacaaatttgttgctctgcaatcaatatagtaattctgggcagggttcaaatttgatactatggagatggacacttcaagcactgaattagattatcaacattagcatcaaatggcacaaaaatattgggccaacgaaatgattgcaaagtgaaaaaagggataacagaactgaaatattaggaaacatattagggatggggagacagagaagggg

SEQ ID NO: 29245 - DNA, 20997 bp, Oryza sativa
gtcttacactgaagttgtggccaagttgcagcctgcagcagtgtcttttccttctaaaagtccaaatgctcctttcaccggcctaaccaggaaattgcagacttgactcgtcacttggggttcatcaagcttgactcttgacaacttgtctcgtactttcctgtgctaatttaactgcataaaccatgtagagttgaatcagtttttgatagtatccactggtagcaacacaaagtcttcgggtcaatactagagatataaccaagttgagtcccccagcatcctcacctgctgttccgattcacatcccggcagattgtacactaattttagagaagaggcattgctgcccagctttatactgaaagcataacagattgtacactaatagactatgccaatcggagaagctgtgctgtccgcgttcatgcaggcgcttttcgagaaagcggtggccgctgcttccagcgagctgaaattccctcaaaacatagctgtggagctgcagaatctatcaagcagtctgtcgacaattctggctcacgttgaagatgcagaggagcggcagctgaaagatcaggcggcaagaagctggctttccaggctgaaggacgtcgcctatgagatggatgacctgcttgatgagcatgctgctgaagtcctccgatccaaacttgcaggcccatccaactatcaccatctgaaggttagaatctgcttctgctgcatttggttgaaaaatgggttatttaacagagatttagtaaaacaaataatgcggattgaggggaagatcgataggcttattaaagacagacatattgtcgatccgatcatgaggtttaacagggaagagataagagagaggcccaagaccagttcgttaattgacgactcgagtgtgtatggtagagaagaagataaagaggtcattgtaaacatgttactcaccacgaataactcaaaccatgtcaacctttctattcttcccatagtgggtatgggaggagtagggaagccaactttaacacagctcgtctacaatgatgtgagagtaaagaagcatttccagttaagaatgtggctgtgtgtttctgaaaactttgatgaggccaaacttaccaaggaaacgatagaatcagttgcgagcggattatcatccgccacaacaaacatgaacttgcttcaagaagacctctcaaacaagctgaaaggcaaaaggtttcttctagtattggatgatgtatggaatgaggatcctgatagatgggatagataccgatgtgctctagttgctggtgcaaaaggaagtaaaattatggtgactactcgaaatgaaaatgttgggaaattagtgggcgggttgactccttactatctaaaacagttatcatacaatgattgctggcatttattcagaagctatgcatttgcagatggtgactccagtgcacacccaaatttggaaatgatcggcaaggaaattgtccataagttgaaaggcctaccattagctgcaagagctttaggtagcttattatgtgctaaggacaacgaggatgactggaaaaatatcctagaaagtgaaatatgggaattgccatcagacaagaataatatcttaccagctctgagactgagttacaatcatcttccacccatattgaagcgatgctttgcattctgctcggtctttcacaaagactatgtgtttgagaaagacatattggtccagatctggatggcagttgggtacatccagcctcaagggcggagaaggatggaagagattgggaataactattttgatgaattactgagcagatccttcttccaaaaacacaaggatggatacgtgatgcatgatgccatgcatgacctagcgcagtctgtctccattgacgaatgcatgagactggataatcttccaaacaatagcaccacagaaagaaatgccaggcacctatcattctcttgtgacaataaaagtcaaactacatttgaagcttttcgtggatttaatagagcacggagccttctactgctgaatggatataaatcaaagacaagctctatccccagtgatctgttcctcaatttaaggtacctccatgtccttgatttgaaccgacaagaaattacagaattgccagaatctgttggaaaattaaagatgctccgatacttgaacctatcaggcactgttgtaagaaagctgccttcatcaattggtaagctctattgcttgcaaacacttaagttacgaaactgcctcgcataatcttgtaaatctcctatccctcgaagcaagaactgaactgatcactggcatagccagaatagggaaattgacttgccttcaaaagttggaggaatttgttgtccataaggacaaaggatacaaggttagtgaattgaaggctatgaataagatcggaggacatatctgcattaaaaatctagagagcgtgtctagtgcggaagaagcagatgaagcattgctaagtgagaaggcacacatcagcattctagaccttatatggtccagtagcagggattttacttcagaagaagcaaaccaggacatagaaacactcacatccctcgaaccacatgatgaactcaaggagctgacagtcaaggcatttgcaggattcgaatttccacattggataggctctcacatttgcaaactatccatctgtctgactgtacaaattgttcaattctgccagcacttggacagctgcctctactcaaggttataatcattgggggttttcctaccattattaaaattggagatgagttttcaggtagtagtgaagttaaggggtttccgtcactgaaagaacttgtatttgaagacacgcctaatctcgaaaggtggacttccacacaagatggtgagtttcttccattccttagagaacttcaagtgcttgactgtcccaaagtaacagaattgccacttctcccatcaacactagtggaactgaaaatttctgaggcaggcttttctgtacttcctgaagttcatgctccaagatttctaccatcattgacacgcctacagattcacaaatgccccaatctcacatccttgcagcaaggattgcttagtcagcaattatcagccctccagcaactaaccatcactaactgtccagaactaattcaccccccaactgaaggattacgaactttaactgctcttcagagtcttcacatttatgattgtccaaggctggcaacagcagaacatcgtggcttactacctcgcatgattgaagatctacgcatcacctcatgctccaacataatcaatcctcttcttgatgaacttaatgagctctttgctctcaagaatcttgtcattgcggattgcgttagccttaatacttttccagaaaagttaccggctaccctcaaaaaattggagatcttcaattgcagtaatctggcctccttgcctgcttgtttacaagaagcctcttgtctaaaaactatgactatcttaaattgtgttagcataaaatgcttgccagcacatggacttccactgtccttagaagaattatacatcaaagagtgcccatttctggcagagaggtgtcaagaaaacagtggagaagattggcctaaaatatctcatatagccatcatagagattgacgatgatagtgccatgccagataggagcataaggagaagattatgctaaaagcttcttagcaactcaacaaaaagggtatgaattaattgccttctctagtttcttttgtctaaatataatagataaggctggctgtgaacatcatactcaaacctattctctgcaggtgcaattggtatatattcagtttattatctccagtgcaaagttctattttaacataattactaacatttatcagatacagaagtaatacactcgaaatgtaaaaactatggtaaacaactgtagcgatagagtacagttaagattgagtgatttccaccaaacagaaaacaacagaaaagaataaaagaaataacgggacaaagaatttcagtactaacaatgtaactaaaaggaaccaggaaggagagcatgtatatctcttttatgatagaagaattttggagcatgacatatgtaaacagttttttgtccacaagaaatgaaattcagattgtcatggtcaacacttatatcttcatattacaaactaaaaatttgaagcagtttcatcggttctgataggaagaagtttgacgagcatgcaaaaatgaatgcataataacagttcatttggtcagttgtgttatgcagaacagttaatatcattgccttttaggtggaaacatctacaccccccgtcccccccaaaagaaaaccctcttctgggcctatgtccatattcaaacccatggagtgggtgttttttgggacagagggagtataaattaaaaatgctatattacaatcaccatttgatgagaaaactatagtcaaatggtatgcgttactcatctgttcgcctttatgttggaccattttggtttggtgccaattcttgccctaccaattctttggtagttttgaatagtgcatgttagcattttggattggagccaaattttgccaaatcaatagagtggagccaaatctatactataaaaaaaattttgccgggtcggccaaaggttggccgaccaatttcattaagattggggagaaaaacaaaggaatgttacagcgacattacaatgtcgcgctagtccgggagagatcccagacacagcgtgaacaaacgaaggagaaagagacaatacaacaacgattactcgctgaattgggagaagatcccagctaccctccacaccacgatttcttcttttatattctcggctacttactataaaaaatttggtagtgccaaaatatgcccaaggtttggtactaccaatattttggtagggtttcaaaccaaacaagcccgttattttcagaactgccatctagattcctcatgcatggcaatgtcagcgtttcaagagaatctcatattctacctgcatcaggatgtgctatgttaatgtgacagagaaggacgaccagacaatcaatcaatacttcaaagaatcaagtcaagtttgaattgattctttctctttagatggtctgggacactgagtcttttgttacagatttcccaaaattgaactgaagaaatcaatgaagactgaattcttgcttctatttatgtctatcaagccatattcgaaggtccaaaattgaccagttaccactccagaagaatgtataataatcttcttatcaaagtttggttatcacctaatatagttcaactaggcatatgcttatccattcaaaagggaaagaaaactaagcatggtccaatgttcacctttacgtttccttttcctgaccaactgtattacacagcctatcccataatatttctctaggtctgttatgattggggcatttcaaaattaagtaattttccaaaataaaactatgaacatcagtacaacgataccatatatgtatagcacaatatacggtgatcaaatctcagaggcgctttctctgacctaattagaaaaacccgactagtaaaaatccacgaacttacagccaaaaaaaacgaaggacgcgttgtagattcgctccacacacacactcgctatatctctcctcccccttccacgtctccggttcgcggagatacgaaccggcggtagccccgcgccgcggcggcggcgccgccgccgccgaagccgccgcaagccgagaatttcccccggagaagtagaatgatgaggcccaaatttagattgatactgtagattcgatctctatcgggcctggatgcacggcccaccaaatctaccatatgggctgggtatgggccttgaacgaatgctgcccggaacaaattttatttgttcatttcagtgtaaaaatacttatggccccagcacagcctgacaattcgaatttccgtgttgggtttggaatttggagagggacttgattttttttctgcgaaaacaacatggactacttgaattacctttcattctttgcaatagactgttgttatttgcacatatgtttactgacctcatatacttgatcagtttgaacaatggcatctttctatttccatagcctctgattctagtgacaatcaaagggcaaactaggtcaaaaggtatctgatggctacaccttcaatgcattggttcatgattcattcacctgttacaaatatactcattttgacacacactacgccgtcttgcccaaaatggtgaagctgcaagaaaaagccgtttaaaaaagaaggttatgttcatgaacctaacctgttgcgtggagatccctttaacctttccatttgctcatatgctattccaaacatgttcacaagaattgcactggaactcaaaaattatttatccttttgtcactcaggcatttccaacagcttgagaatagcaggctgaaaattactcaattggagaaggaacttcagccaaattgttcaaaatcagccgtttggtcaacacaagagtgaagtgtcagggtcagggagctgacggtaaagcattttcaggattctactttcccaagtgattaagcacactttctcacttgcaaaatattcacctgtctgactgtacaagttgttcgattctaccagcactagccactaaagtttttcgaagattgggggcttttcctgccattacaaaatcaaccaagagttttcagacagcgatgatgttaaggggtgtccgtcactgcaggaacttatgataatctcaaaagatgggtcttctgttcaagatggccagttgcttccatccatcacaatccaattacaccattgtgttcgttgcaattaaatcttcacaacaagatcttacatgattatattacgataaaaatatttatatttgtaaattacttttattatatactaagttacttttataatatatataagttacttttagatttgactaaattacttctatacattcataatgctctaagttggttatttttattattgttcttagttaattctatattttgtggactttataaatcttctctacactttacttgcgaattcactctacatagtttcttatttcagctcactcacaatataattatttctactacagagagttactcctccgtttcataatgtaagtcattttagtattgcccacatttatatagatattaatgaatctagatatagttctaaattaaagttactttctttttttataagttacttctataatatatgtaaattacttttaagctttactgaatttacttttatatatataagaagtaacttagtgaaatctagaagtaatttagacatatcataaaagtaatttgtgatttttcatcaaaatataatcatgtgagatcttgttgtaaagatttaattgttacgaacacaacggtgtaattggattataaatcggatgagtaatttaagagaaacttctctaagaagaaaaaaatatatagatattgagtgtactagtagcttttttttggatagaatggtgtctctctttagcactatccagctagtactctcggtgtagttacgtcctttaaaaacatgctactctctcaacccaaaatataactctacctttaaacttttgtacaaagttcaaatttcagtgaaaggcaaattaattaattgatgcatgtaagaacaaatttatgaggttacaaaactactttttagaagcccatagtagttcacaatacatattcataccgggaatcctaatgcacgcatgcgcgatggcggaggcggagcaagtagcacagacgagcgcagcctacgtcaccctcaccaagccgctaatctctagcacttagcgctaatcccttttttatgggtaaactattttttaaaaaaataaataattgatataaaatttttaaatatgaattgaaagttgaactgaaagttttcaatttttatttgaacactttcaaattttgagctaaaaatttttaaaactgaatttaaattttaaaattttagttgaaagtttcaagatttaaaatatatatttcagttgaaagttttcaaaaataagttggaagtgagttgaaagttttcaaatatgagtttaaagctttaaattttgaactgaaagttttaaaagttgaattcaaagttttcaaatataagttgaaagtttaaataattggtagagtaaattttaaagtggaagttttatattagaattaaaaaggggaaaaacacaataatagtttgtttgaaaaaagtgttaacgttaataacacggcctaattacgaaaaaaatagaactaataacttgatgtatgcgaaaggaaaaaaaaggccctagcactgcactgcatgtggagtccgaaaataacatgagtggcgccacctggcatcactctctggaacgccatgttagcgtaaatcggcgtgacgagctgtaactaaatcaaaattcacaaaacactataatcttaatggtttctgtcgttatcgatacgtgaccaacaaaatgcccgtgcagtgcggtggataatagcgaggtggatgaagtttaacctcaatgattcatcgaagcacctaagtatgatcataagtatcggtgacatgcacagttatcttaaagatatatttgtgtttggacaactagtccactctaattgtgcggggtgtggatgattatgctaatgaatggtctcgatgatcgtagcattggagaaatggatggccgaacgacgcacctctgcctagaaggcgatgatgaaattttaggagaccattaattattttgaattacatttttatgaaaatcttataatctcttttcacaattgatgattgttacaacagttcattgatataatcacaatgtaatgctctgtaccgactaaaccaaaatagtgccagccggacctaaccattctctttttattttctagaaaacctttacgagtaaaagtcattagcacataattaattaagttttaattattataaacttaaaatatacatttatttggtattttaaattaacttttatatagaaagtttcacgccagtttccgcgtttcttaaaaaataccggtcgatttatttcctagtaaaacacatatccggtttccatgtttttttaaaaaaaaataccggtcggtcactatccttcctgcgtacagtacaaaataatcttattttttgaacggaaaaattcgtcaagtgttgttgttcctttgcctaaacgggcttgcagctgataattatagttacatcgcattaccactcaagaacgcaccagtggtctagtggtagaatagtaccctgccacggtacagacccgggttcgattcccggctggtgcaatttttattttttccctcattgttctttgtttgctgcaagttctcagctcatgatgtttttcattccaatttataggtggcttgtttaaattgcaaagcattgcaagcctgctcatttagtaagctgattattaatcctgaatcacgccaagtcgataaatacgcaacaagagcagagcttacattgcttcagacttttagctccatgttatgtcggattcacgtttagtgtatatattccctccgttttaaaatgtttgacaccgttgactttttagcacgtgtttgaccgttcgttgaataaaatttaagtaattatttattcttttcatatcatttaatttattgttaaatatactttcatgtacacatatagttttacatatatcacaattttttttattcttttcatatcatttgatttattgttaaatatactttcatgtacatatatagttttacatatatcaaaaaaaaatttgaataagactttttagcacgtgtttgaccgttcgttgaataaaatttaagtaattatttattcttttcatatcatttgatttattgttaaatatactttcatgtacacatatagttttacatatatcacaaatttttttattcttttcatatcatttgatttattgttaaatatactttcatgtacacatatagttttacatatatcacaaatttttttgaataagacgaacggtcaaacacgtgctaaaaagtcaacggtgttaaacattttgaaacggagggagtatatccttcatgtatccattcctataatcccatggtacatagcctctccatccatcgggatggttgtggcggtgaacggggttggcgcgacggatctatcggcaatgggatgtcccgtgctagggagggtgatggcggcgatggggggagacacagtggcgtggtagccttactgcccgtcgggttctcttaggttgaggggcgtcggtgctacggtgtttatgtgtgccgacagtggtttagatggtagttatagaagtttggctgtgacaaaagggggcatgtgtaggcacaatcgtgaaatccttactacaacgacatatcgacactacttttgagcgttgagaaccctatattgacgttgttaaggcgtttccctccatcccttgcgggactctctaagtgaaaaccatatccaaaatcccttggatacatggcatagacgctttttggcgttatgtcatcctgaaggcgtttcctaagagatcttgttattgcctcaatttgaccaatgctcttgtgatgggtctctgactctctgtgcatgacaagtggatctttttttctttctccttcattctccctctacgaccattttgttctggtgatgtccgggagatcacaagcgattagactgtttggagttcagcgtgggtgggggggggtcgtcgtggctcctctgtaggtctagcgatgatctgtcacacttagcaacaatcaaattggtgttagttccttcttcaacattgcattgacggtgtttggcacagttattggagtgcttgtttcaaggttcatttaatctcttttacctaaaaaaagggttactttaatcttcacgtttcaaattatccaaacaattcttcaatattcatcatttggctcaatctagtccttggaacttaaaaaatggcatgtggacatgtcacgtcatcctcacatgatccccattattgtcattttcttgttttcttttctttaaaaaatctttatttttcactatggtatatataatggtataatggtcatttaattgttgaccttgcatgtgaggatggtatgacatgcacacttgatttttttatggggacaagtactatattaagctaaaagataaatttaattagagatttgtttaaataatttaagactaaaatgatcttggagtcaaactttaagataagattttatccctcattctaaaataaattaacatattatagaaatagatatatcttagtagtataaatttagatagatattttatttaaatttataatattaaaatatgtcatatcatatactagattaacttattttaagatgaaagaaatacctccgaaggctagtcttatattaatttttctccgtataagatagacgatcctaactcatacagtcgtactacaaccgtatcatactttctgcgttttaaaatatcgttacctaaatttcaattggacactttctagaagccaaaaaatatttgtatccgtgtcaccctctagaggagcagcggaaggttcgcagcccgttcgtgtcgtgtgcacgctgttcgtatccgtatcatatgagctcaagattttatttattttttaaggaacattttatttatttatttaaggtgcagataccaaccgtcgtttgagttcttcaaaactcctgttgcattcagcagaccagataaatttttcttccttcttcaagagctgtgtcattggcttagcaattttagagaagttctcaatgaatcggcggtaatagcccgcaagtcctaagaaactccgaatctgagagactgtcctcggtggggtccacttggtaactgactccacatttgctggatccacagccactccttgagcacttacgacatgaccaagaaactgaactttcttaagccagaagtcacacttgctgaacttggcatatagctggtgctcctttaacttttcaagtaccagccgaagatgctgctcatgttcttcctcggacttggagtagataagtacgtcatcggtgaaaactacgacaaacttgtccagaaattcaataaacaccttgttcatcaaattcatgaagaaggcaggtgcatgtcacgccctgaagtttccccccttttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataattttaaccaattaaaaatcaccaaagtgcaatttttaaatcccaggaaaatcctttcttttctttttctttttcctgtttcctcctttttcctcttcttgggccgtcggcccagtccacccgtcgcccgcgctcggcctccccttgtgggccggcccgttcccctttcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgtccctctccgcgcccgcacctcgcgcccacgtcgccgcctcttcccccgcatctcccggcccgcgcgcgcgctcgagagggcgggattcgatttcgaatccacctctctcactctccctccactccccacgtcgccggccaaatcggccacctccccggccacgtccgccccctcccgcacctataaatcgctccccgcgtcttcctctctcgtttttcgcactcgccgcgctctcccgtgcctcctatcgcgctcgcgccgcttgttgctagtgccgccgcttgccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccgacaattcaagccgccgtggtcgtcgtctcctctcctaacgcctctccatcttctcctagggtgtcgccgccgcccgtccgtgcctccgcgtcgccggtcatcgccgctcgtctcttcccacgccggtcgccgccatcgcctcggtgaggaatcccctttcctccttcctttcctctccccccgtgagcgccgccgccctccgcgcgtgcgccgtcgtcttcggctgccgccgccgccttcgcgccggccgccgccgtctccccgcgccgccggtcaccgccggcggtcgtgcgccgtcgtcgcctcgccatggccggccggcttgagccgtgccgagcatgtcgccgcccactccctcccccttgagccactgcccgtggggcccgcttgccagccgccccctctcccccccttagtgccgctgatcagtggggcccgcctgtcggcgccaccccctcccctcgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgttccctgtttcagtagtcttatagcatgttttgcttgtgtgctttgtttgtcgcgtaggtttcggccgttttgtcgatccacggtttctcgaagacgttgctgaggtctcgtcagtgcgagagcaaggcaagtcatgaaatacgtttgatcatattgtacccaatttacaaatatcccgcatttctattaaatgttgcattcttttacaatgtaatgtgggatgggtcctattcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgctttccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatgattaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcattcctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggattttttttttaaaaaaaaaatgagctcagcctagggctttagaaaaattttagttggagtttattcgatagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttattgatttgagtcttcttttgctttgtttaatttggatttgagcatgaattggttcctatcccttgtctactttagatgtcagtcctatccctcgtttgcaagcgccgcctcgagcttcagagtcaccgcccttagctttatcgccttcttagtctgtttgcttgctagttttcgtgtttaggtttgatgcttgtgggctagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcagatggagacaaggaatggttcacgcgactcgaacaacgccagtggcagcgaaaagccgatcaatggagcacgtgccaacagtgcatctgacaacagtccgtccccaccgcccgagaacccaacaattgctcaggtgttggacaatcagactcagatgatgacaatgatgatgcaacagatgcagcaacagtaccatcaggtgttgcaacaggtgcagcagcaagcacagctgcagcagcagaacctgcagtttggttctccacctcctcagtccaaactgctagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacacaccagctgcaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaacctcctcgcgcgctacgcccctgaggacgtgcgtaccgatgccgagaggcaggagaagtttttgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacgtcacggtggaccttccaccatgattatccgacagcaccgtccctaccacccgggtagcttcaacaagaaccaccataatggcagtcacaacaacagtgagcagcacagtctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatccttagtgaagcttaagataccaatgcgagtgcatactcctggaggtggcatgaccacaactcactactgcccatctgtgacagttgaaattcaagggttgatttttccagccaacctcattcttctcgaatccaaggacctagatgtcatacttggaatggattggttaacaaggcacagaggagtgattgattgcgccagccgcaccatcaagttaaccaatgcaaaaggagaggtggtaaccttccagtctctagtgccgcggaagccagggatcagtttaaaccaggctgctggtgaagaacaagaggtagcagtggagaaaaccactaagaagctggaggatattcccatagtcagagagtatccagaggtttttccggacgatctgacaacaatgccaccaaaaagggatatcgagttccggattgacttggtacctggaactgcaccgatccacaagaggccttacagaatgggagccagcgagttggcggaagtcaagaagcaagtcgatgagcagttacagaagggatacatccgcccgagcacgtcgccttggggtgctccggttatctttgtggagaagaaagacaaaaccaagaggatgtgcgttgactaccgcgcactcaatgaggtcaccatcaagaacaagtatcctttgccaaggattgatgacctgtttgatcagttgaaaggagttactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatcttcacccaacctgatctgaatctccgacagcgaagatggttggagctaattaaagattatgatatgggaatacattatcatcccggcaaggctaatgtggttgcggatgccttgagcaggaagagctactgcaatgttgcatgggtagagcaactatgtggtgaggttcaacgcgatttggaacatctgaaccttggtatagttgagcacggattcgtggctgccctagaggcacagcccacgctggtggagcaggttcgcatagctcaggcaagtgatcctgaaatagcagagctcaaaaagaacatgagggttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagaaaagttctggtgggtcagcatgagaagggaaatagctgagttcgtagcactctgtgacgtctgtcaacgagtaaaggcagaacaccaaaggccagcaggtttgctacagccacttcagattccagaatggaagtgggaagaaatcggaatggatttcatcaccggtttgccaggacgtcatcggggcatgattctatttgggtagtcgttgaccgactcaccaaagtggctcacttcattccggtgcacactacctactcagggaagaaattagcagaactctatctatcaagaatcatgtgtttacatggtgtacctaagaagatcgtgtctgatcgaggaagccaattcacttcaaagttctggcagaaattacaagaagaattgggaacccggttgaatttcagcaccgcttaccatccacaaacagatggccagaccgagcgagtcaatcaaatactagaggatatgttgagagcctgtgcgcttgactttggtggggcatgggacaaaagcttccgtatgctgagttctcgtacaacaacagttaccaagctagtctgcagatggcaccatttgaagcactgtatggacggaggtgtcgtactccgctcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgttttccaagtaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctctcagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagtttccccccttttgcttgctttaaaaattggctaaataaatcgtccgaagaaattatcttaattaacctagagctaattccctaattaataaatgcaaataataatcggaatcggcatgtggaatttttcttggattctacatgtcacaatatattaacaggatttttagtggaattttcagagccttggaaataa

SEQ ID NO: 29246 - DNA, 4032 bp, Oryza sativa
tcttgtagatcggtgcagttttaggtaccaagtcaattcggaactcaatatccctttttggtggaatggttgtcaggacatctggaaaaacctctggatactcgctgacgataggaatatcctccaacttcttagtggttttctccactgctacttcttgttcttcaccagtagactggttcagactgatcccttgcttctgcggtacttgagggaaggtccacgagatcaccttttccctaacaaattaaggttaataatacatgcgatcgactaaatcataaaaagtatttgatctcctcaacaactagatcatcttcatccgacatcgacatgccatacgcctattccacttgctcgacgataggtatggtgtccattacctaaaattggcaaacaaatacacagttttagaatccaattgatctctatctagaaacaaacaaaattaactctacactagagaaaaactgcacatatttatactatcagcacaagggcatcagtgaatctcacaaaagaaaagaggagaagtgtagacaggttctacagttgattatgaactataatctatcttgatgtgaccatggctactatggatatgaccattgctcacatcatgaatcaacaagaagacatcaagatcaagtcctccatgtgctgcaatctgattcggccacgtgttacattgctgatttcaaacggccgccaaatctacatacgtgctccgttttgggcccgtgagtacttgatggaaagctctcgaagtcctccttccaacggatccagcctcatctcggaattctatctcgtttggccacaatcacagaagcaaggtgctgcgtcacctgtattgggccaatgggcttgtaactttgtctgggacccttggggcccatgtggggtgcaccccaatctggtggagcacgacccttggaccctcttggtcatcctcccacctctataaatagttaggtaccccttcagggtttcttgggttttgatagattaaagtttagccattgctacttgcttgtagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcaagaggaactcagggttcatcaggtggtatcagagttttcgttgctcggtgagttttatctacccataaccagaaaattgccatacaaaaaaaattgtatcctgtacctagccatattgtgccattgcattgtttttatcagtttttgctttgttgagttttgtgttgcattgtcgagtcgtgttgctggtcttagcgtttagttcgtttagagtttcgagttctggtcacgtttcgtaccactgtcatcacccccgccgtgtctttgttgtcgtcgggacctaggaaaacggaatcatcttgttgtcggggtttcgtttttctagttttcagaagtttttgtcggtcggtcttggagttgctgagttgcatcaagggtttgtcgtctgtattcggccgtgcttgtttctcttgcgcgaggaagaggagagaaagaaaagataacagatctgtttttggaggaagttttgcagactagatcaatcaggttggttagtttccatctaaggccaaactttccaaactctccccacgcgtgaagaccggttggcgccatctccttttgtcgcccactttagctgagtccgactccctccctctcacgtcggtttcgcctgttccgagttgtgtcaaacaccttggtgaatttttgtttggtgtcagtttcgagatccgtttcgaaaaacggaatcagtataaattcagcattccatttttgtataatttttaattttggtttggacttttacagttgagtccttgtaattttcatatttacatttgagtcccagtaatcttgcattgaggtccttgagttgtttttgcagaaaaaaaaataaaataaaaaaaagaaagtaaggaaaaggcaggaaggtgcataaaaagaaaaaagaaaagaaaagccgcaccaaaaaaaaggagagaaaaaaaagaagaagaaagaaggaagaagaaagaaagaaaaaaaatcagttgtatttttgagctgaacatgatctatcagagtgtgcctaagttaaaaaaatcagttgtatctttgagctgaacatgatctatcagagtgcgcctaagttgtttctagtgctatcctgtggtatcgcttgtgtctaggctcacgtctctagtacgttctagcctaggaccagcatggtacttgactttgaaccattattcaactttgcattctctgatttgagcatttgctatccctttgctacatatttaagcctacccagagctccacagatctgattgcagccgtacaacaagtgtttgccaaggcatcgatacatccaacctctattggggtgcttggttaagtcggtgtacatcaccattccgcttgctttggtaagaacttgtaagagcttggttaaaagcttgagtgtgtgtgatatttgagctgccactacctagtagttgataggagcatgcatatttttgtgtgtttcttgtttgctactaaccatggcaggattgcgtaagggaatacgagaacatcgacttctacaccttcgacgagatatgacgacttctccaaatgatacatatgaggtacatgactataattttgaacaagttgcatctaagttacccttctatgatgggaagtatgattctgttgcatacattgattgggagctagcagtagacaatgaatttgatatatatgatttttctgatgctcaaatgattaaggctgctagtaataaatttacctcttctgcattattttggtggacttatgttagtaataaacctgaaacttgggatgaattgaaaaccatgatgagaaaacgctttgtgacatcttattacaaatgtactcttcgggagaaattagaacatctgaaacaaggtgacagaactgttagggagtacattcatgaatttaaggtctgtatcatctacagtggtctcaaagagtgcaatgaaaatacaacgcgtagatttttcaatgggcttaattctgaaattcaggttttgcttgataatgtgacatataatcatattgggcacctattcatgcttgctcgtagcattgagagtcagatcatatcaaaggcgaggatgcatgaccaatgtgatttatctcctatttctgaatccccaatatacttatgtaatgatgatgtgcaaacattggaggagcaatcttttgtctcccctgttactaacgttttgcaggaagatcagcacatccaagaaaaggagaatggtatacttgagaagaaagaggatgaagcacctgcgatgtctgaaaaaagttcgcaaggtaaattaaatggtgctgagagaaatgaaggtgagtattctcaaggtgagctacacttgtccacttttcatgctatagtagagcaaccattagtggaatcaattgctgagttgcctttgtcacaagttgatttacttgttgttccttgtgataaagaagagttgtgtgataatgtttcacttatatccatgccacaactgttctactatttctttgtgtgctgattataagtatgttgttcacattgctaatgaagtagaggaacgcgaattgctatcttctttaaatactttgggctatgttcagtttgatgatttttgtgagctcgataatttgaaggagaaattatttgctaaatctgatttgccatgtccaactaatgctatttttcatatctttggcgaatataatgatagagg

SEQ ID NO: 29247 - DNA, 33041 bp, Oryza sativa
tgtagcgcgcgtgtcggctagcccgtccgtctgcttgttcttcggaaccccaacttatcatttgtattaaattcctatttgcaataccagattgcttttatcttgttctggcttgtttctacgatttgcttgcaggaatagggttgatatgcaccggcaagatcaacaacccgcggagaggtgtatcgatcgctaaggcgcaacacaacgtctcatacggttgtagtcggatcgtcaacgtttctcccaaatcgtagttatcacaactcaccgaaagatcgggccaacaacagccttgagtgtcgagaggaactcagggttcatcatatctagatgtttgtaagcctgcacagacaagtgataatggaaattacaagatgcaattttcctttgggggaaaaaaaggaatcaacggatttctttgtaaggttggaaattcagtatcacctcttctccggctggttgttggctgctcgacgccttctttctgcatactttgcagctagttccttgtccttctgttttcatccaagatgctaaaagttacaaaactttccaaacagataaatgtatttgcagctaaaatcagaacgataacaggaaatgacctggcttattttgttgaaaaaaggaacacaatttgtgatagagacatttgtgattagaacactaattattttgcaaataatttccgagataactagatacaaattgcaacgagcaatgcgtgaggaaggacatattagctacttcatgaatgaccaatacaacagctaaccgcttagtggaaactgaatgattattcggctacgcatgcttgaaaattagactgaagaaacaagcatatttgtccgtgctaacagtaaccagcagttctgcgttcagtgcctctatagtgcagctgtgagtactttgctaatgccgcacaatgactagcagttcaagatcaaattattagttgctagctgtttcgtgagtaaccaatcagcacctttcaccaattgataactgaaacagtaattagccaattctaatgtagaaaaatgggaataacagtataaaccaatccgattgccaatgtccaaaacaaaatcagattccccagtcaccgatgctcattttaattcaaggaaaaaccgacactttatgggagaaagttagggataatatatatatatatatatatatatatatatatatatatatatatatatatatatatataggacactcatatggggcaccatggtgcccgggcaccatggtttcaaatgcacaaaatcactcaaatttttcaaaattttcaaattatgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttactttcaactagttagtaaagtagttaatattaatacctaaataattaaaaaagttttatgctcatttgaattgggtatatactcaatttcaacaatggtgcccaggcaccatggagcaccaaacaaatttactatatatatatatatatatatatatatatatatatatatatatatacaccttctttacagtcttgattgccaatgtatcccccattagcattcatagtgttcatgtgatcgatgtacctctcccagtcaaagctaccaggatgggaatacagactattgcactcttcatcagtccagtctgcgaatccgttaggggcgaaagggacatccattggtcttaccgcattagccttgtctgcccttatcgcggtctccttgaatatttcatagcagcgagccttctcctcctcggtgctgtacgaacggttgtgctccttcatccagtcctgaaacctggccttcatggttgcctcatcgaccttcacatcctgctgcttcacagcttcttcccagtcactcacctccttagcagatgcttcctcgtcgtaaggaggcattcccccatgagtgtttgaaagttgacatgatcgagataactagcccactgaactgtgccatctttgtccacaaaccctgccttgatggctgcttccttactcaggtaagggtaaggttccttgacagcccccctgtcacatacatcctctatcccataatataagtcggttaaacttagtacggtctttaaaacaaatctttggattctaatttcttatatatagtataatgtttgtagcaatataaaagtaaactataaccatatgaaattaaattcaaatatcaatccaatgtattattttcagcaaataaaattcataatagttaatcaaatgttttaaaagttgaatcttaaaacgcatgtgtgccttatattatattatgggatttaggcagtaaccccttcctgccttcctcctgcagctggagatgtacatcaacaggtaggtggtggtgggcatggttaggtcacctggatcagagctaactaacgaagagaaatctaaaggcttttgttttgtttttttttcttttttgtcaattcatacctcctgacttgtctgtgctctcgttgaaatacaggattgtggccaatccagccaacgcaatcgtggctacaactccataagcgccaccatcaccaacggcgagatccctctgtatcatacagagatgagaacacatgagctgcgagtgcacacaagaaataaaattttcgatctgagaaccgggtgaaacggacggagatttcaccagggcgcggagagagcgtgctgacctccccgccgtagcctgagtgaagatccccagcgaggactccgcctccgcctgcgcctgcgcgcgtggcgagaatctcctacaggtgagaagggaaccgagggcacggagagacatggtcgccacaggagagctccttcttcctcctcctcctcgatttactcttcgctctccgccgccgccgctcgcctcgtcgcctcgattcgactgtagggtgtgagacggacttcgcttccgatggacggggcttgtatggccgaacagaactggaatccgttatcttaatgagtttgaattgcgtccatgaaccgtgatatataggctgtttttatactgggataaagttttggcgtgtcacattaaatatacggacacatatttaaagtattaaacatagactaataacaaaataaatcacagaatctgcttgtaaactacgagacgaattttattaagcctaattaatccgtcattagcaaatgtttactgtagcaccacattgtcagatcatggagcaattaggcttaaaagattcgtcttgcaatttacacgcaatctgtataattagttatttttttcgtttatttaatactctatgcatatgtccaaatattcgatgtgacatggtgaaaaattttgccagatgatctaaacaaggctatagtataacacggacacccaacttataataagttgccaagcagagcttctagaaagtatatagttctaggttttagctgacatgacaagtcaatatgaaactcaacatgaaccacacatatcagctttctcctctaatcttctctcccattccagctttcttcctcctctttccccctcgctctctttctagtcttcaagggagcggaccagcgggataagggggaggggcaggggagctcgatcctcttctcgcagacgaagaagatagggttcttggtgagacaggtgtaatatggaacgaaacctctggttgagagaacggtacgagtacctacgagtaccgacatacagctgatagcggaatgtgcaagccgcagcacctggggtttgccaaccatggcccccaacaccatggccacagcgtccgctccatcctcacctcgctttttcttttttcaaatttaagttaactctagaatcctagaaagttttaaattttgagttaaaagtttcaaaatttgtgttggaagttttaaaattaaattgaaagcttcaaattaaatataccttttgaagctgaatagatatttctctattagaaatactcatggttggaagttttcaaaatcaagctaaacatttttaaatttccaatagaaactaagtaacaaattagaaattaaatctactatatgacttgattaaacccaaaaaaaaagaaaggtgacttcatgcatgcaggatacgatatcgctaattagcaatcaggcacgcccaccacctcccgcctgatcactatccgtacggtaagaaatacgcgtccatacgtataaaatatactccctccgtcccaaaaaaaaaaaagcaaaccctaagtttccgtgccaacgtttgactgtccgtcttatatgaaatttttttataattagtatgttcattgttgttagatgataaaatatgattaatactttatgtgtgacttatctttttaatttttttcataattttttcaaataagacggacggtcaaacgttagacacggaaaccagggtttgtcttgttttttggaacggagggagtatatataaacattttacgtacatgtataaagtttgtacgactatatatttaaaaaattatatgtcaaaaatgtatacttgtacgaataaatttataatacataaaaattgtaaagatgtgtaaagtttatacataaatgaaaacttggtatataattttgtgtacttatgtatgtataactatgtatatgtacatataaactttgcatttatccaagtataaatacaaagtatataaatacgtgtacatgactgaggaaccgatcccgcgggtgcagctctagttgtcccccctccggaacttgcctctatagtaaaaaaactcgcgctacttgcattgatattaacgagttgttgcttcctcctcgagagagctcaacggcgacgaagcagcgcgacgcgacgcgacgccctgcggtggcgtggcaacaccgcaacaatggcgccgccgccgccgtcgccgccgtgccggccgcgagtcaagcccgagcgcgcccttctgtgcttctccctcctcctcctcctgaccgccaccacggcgaacgccagcatcaccgactgcccaactacaagcagcaccaactccagccatgtcgacgacggtgccttcggggccaacctccgcgctctcctctcctccctttccgcagccgcggcggcatcgtcgtcggggttcgccgagaacgcgaccggcgcggcgccggacacggcgtacggcctcgcgcagtgccgcggcggcatcgtcggcggcggcaatggcaccagctgccgctcctgcctcgacgactcggtgcgggacgcggccaaggcgtgccccggcgagaaatccgccgtgatcatctccgactactgcctcgtccggtactccaacgcgagcttcgccggcgccgccgacgagcggacggtgaagctctggtggaacacggacaacgcgacgcagccggagaggttcaagtcgctgctggggacgctgatgggcaacctcaccgacgcggcggcgcgcgcgtcgtcgccgctgatgttcgcggccggcgagaccgacctcccgcccttcaccaagatctacggcatggcgcagtgcacccgcgacctcgccgccggcgactgctaccgctgcctcgtcggcgccgtcaacaacatcccgaaatgctgcgacgggaagcagggcgggcaggtcatcacgaggagctgctccatccggttcgaggtgtacccgttcttcgacgcccaggccgccaaggcggccatgtcgcctgcgccggcgccggcgccggtgacgacgcccaccggggtcaatggtaagtcaagtcaaaggtctctcccgtgcgcgtttgcacttgcgtcgctttctccacgcgtttgcttgtataggtcgcgaaaagaaaaaagtttagttgtcatattggatatttgatcagatattggaaggagttttcggacacgaatgaaaaaactaatttcacctggaaaccgcgagagcacacgtgggttactatattacttatgactaattatggactaattaggattaaaagatttgtctcgtgatttccccccaactgtgcaattaatttttttaatctatatttaatgcttcatgtatatatctaaagattcgatgtaatgtttttggaaaaaatttatgggaactaaaccaggccttaaccaggccttagtagctggttgcaacttgcaactttctgactctaaattccgaacacttgttctcttcttcaaccgtgttttctccttcaaccttgtcgagtggacagaacaaagtggtttgcacccatagattctgatagtacaatgacttttgtgctctgaatttgtgttttgaccatggtaaaacatgtttatgcaggaagtaatcacacagtcagtaagtctgtgattgtcccagttactgtgggagttgccgtgttactagtggtaatactgctgctaattgccctttgtctgtgcaagaggaacagaaaaccacataagcatatgatgattggaagcgtcggtaagtcctcaaggcttgaaacaactgcattagcattatagcacatctgaagaatatttaagggcttaactcgtcagtttttcctatgaacagatcttggagatgaagacgaaatgagaggctcagaatctctcttgtatgatttgagtactctaagagcagcaactgccaacttctcagaagaaaataagctcggagaaggtggatttggcccagtctacaaagtaagttaagtctgcaacctgacaatcaagttcagttctaattagcctgtaaaagtagctcacagattcatacttgcagttatgcaagcaatgtgatctacattacttgaacttaccgattctgatgctgttgagttcagggtacactgcaaaatggtcaagagattgcagtgaagagattgtcagcaacttcccatcaagggcaattggagatgaagaatgaggtagtcttggttgcaaagcttcagcacaagaatctggtcaggctgctaggatgctgcatcgaagaacgggagaaaatcctagtttatgagttcctctgtaacaaaagcctcgacactatccttttcggtacttcattcagataatctaagcctatttaattttatatatccttgtttagtaagctaatcaacagaatttacatggacaattcagacacttcaagacagcaagaccttaactgggagcaaagattcaagatcattgaagggatcggaagagggcttctttatcttcatgaagattcaaggctcaagatcatccaccgtgatctcaaagctagcaacatcttgttagatgtagacatgaaccccaagatatcagacttcggccttgccaagttatttaacatggaagcgagcgtagcaaacactagcaggattgctggaacctagtaagtgcttcagatattagagtcctctcttgaaaaagtatatctatactaaatgagcactcgaaggaaactcccacgttaacttatgaaagatttgaccattaattagataattgtattatcatgaccatatatcatattaagagtttctgtaaaataaaacaggtggttttaaatcagtgagctcattttagtttttctaaaatatagtaatattttaagaattcggaattgataaatatgaaattgtacccatattgaattctcaatttagtatgtcattgatttaattttaagattcgaaaataataactaagaagttgtaagttgttaatggcatatggtctcttttttcaacttgaatgtcactccctccgtttcatataataagtcgtttggttttttttttctagtcaaagtttttaaaatttgatcaaatttataaaaaaatatatattattattttcaacacaaagcgatcatattattagatttaatgaaactaatttgatattttagatgttgctaaatttttctacaaacttgattaaatttaataaaatttaactatgaaaaaggtcaaacgacttgtaatattgtaatatgtaatatgaaactgatagagtattacattactatcatttggaaatttgagctgagagcattagatatacctcttgttcagcggatacatggcgccggagtacgcgctgcacggcatcttctcggccaaatccgacgtcttcagctacggcgtgctcctcctcgagatcgtcaccggccgccgcaacacctgcctccatgactccgaggatctcctggcatttgtaatccccgcgcaaatcctatctaaagtttaatcacaaacattgcaatctgcaattcgaaagacttttgcatggatatacaaccgtctgagactgattctgctcgccggcgtgcaggtctggaggcactggagccgcggcggcgccggggagctgctcgacggctgccccgccgccggccgccggccgcaggagcttctgcggtgcatccacgtggggctcctctgcgtgcaggaggacccgcagctccgccccggcatggcggcagtcgtcgtcatgctcaacagccgctcggtcacgctgccggcgccctcggcgccggcgttcgtctccgcgagccgtgggatcggcggaagcccgccgccggcggcggcggcgggagatgcgccggcgaggagcacggatcacgaggttcctacggctgctcgatagccgtcgatcaacggcgcttctgtctctgaactagagccccggtgacatcggagattcggaggactgacggctgggcccggcttatgtttctgctctgaatttgaaaatttgttgctcgttttgcattcaaaatttctctcggatttaatgcatttctgtatgccgttcagtgttggagtagttaagtggatatgaaaatgtaatgacggctttgtaatttaaatttttcgacgagcttagcaattcaagtggtttatgtagtacaaatcaactcaactcagtcagaaaaagtagaaatcaaatcccttcccaaattcaaagcacaaatcggctggtattcgtggtagtagacctagtcaaacggcccaaacctcgtcaaatccaggcccaaaagattggcccatgtgttttttacattgaaaacaaatgaaaattgtgccggccaggttggaccagatggcctaaggtctagatagggtgggccgaaacggtctcccgcatcttaaaatttgtgtgaacggacgatttggcatcaaaactgggagtcttaattcagattgcatcaaaataatttattccaaaatttaataatattaaagttttcgtaaattaacaacattgtaaagttttgataggacgaacgatattaccagacaataatatggttcaaaatagtaggggtgggcattcagtatgaccgaaaatttcggtcttgatcttcggtatttcggtgtttgaaaagtgaatactgaatctcaacgcgaaaatatcaggaccgataaattcggtctcggtcttgaccgaaattcaacaacattttcatatatgcaaagaaataatgaaaattttcaacacaaaaatcacaaaaaaaatttgtaaacacgtatgagtaaagactcttattaggttgcatgcctataagaagtagagatgtgaaaattagagtttaatcctattgaacttagtggattgtaggttgcatctagatttttttttttgttaaatcggtcttttcagataaccgaggagactaaccgaattaacctaacaaaattcgatctttcacttcctaggaccgaattaatgaccgattttctctgtctcggtattttcggttcggttttttctgtccacccctacaaaatagcatcaatctaatcccaaaacctaaacacaccagccaatgacacacctgccccacccaacatataagcagcagtaccgaacgaaagctaaagaagtccacaccgcgtcaatcgccccaacaaactcgtaaaataaccaatcaattcaacagcttcctggaatctgaagaacaaaagttgtagaagagcacacagcgattctgacgaggaccaaggtcgatctctagaaaatctgtgctcttctgcgcgctagctagtgtagtgctgtgcaattgcatatgggcgggatggcgcaggctacagatgagtcgccacctggcaattttcctcttctttctctgattatctcgtacgttggaccgatcgacgagtggttccagccttccagaaatcaagcacggcgacaactaatatagctgtcgaggaatcggtcctgtattattcacttcggtttttaatctagacgctctgatggattgattaactgcgtacgtggttcaaactctactgttgatttgcaccataagagacgtgtgctttagagtactactctttggtttccttcaagtcacgaccagttcgttatctttgcccgatcattttgcctttctgctcggttattcgtaacgcgtcgacataagtatatctgattcgtaactgtctccatctttcgttacatgtaaacgaaaagaaaactgatagcctatcatgcgcgccaagctatggcttacctaagccaacgcacgcagccaccccctaccaaacagaagcttctctctccctggcaccacaactaaaagcaggtacaatagcagactataaaccagctataaacatatttcgatgagataaaagagaagagagagtagcaacgagctatagatttgtagccagctgcagcacggactccaagatacatgtgtgtatgacaggtgagaccatatattaattatgtagtatatgtttatagctaactattgtacaaattagctattaagttggctatagatgatttggagccggcagttggctatactattaaacttgctctaagagcaggtacaataacatgctataattaagttagctaaaagcatatgttaataagataagagaagcggactatagatttatagtcagctgcaagcctatagcacggactttaagacgctgtacgtgtaattaataatgatgtagttaacgattgtataaattaactattagattgactgtagatgatttacggctagtagttgattaaacttgctctaaacaacgggagaagccttctagatcatcgtgttgaaaaaaaatggcaacagccaacgcccaacggaaccgcccaagcccacacgtcgcgtttacctctccagcacggtcactggcatgtgggcccatgagaaagtgggacccacatgtcaatctgtgtccgccccactaccgcctctacaaaagcagagcgcgcgcggcggcggcagcggcagcagcagcagcaaatcgatcgttgtcgtgtctcgcgagatggaggcgctcgccggcgggaggccgctgtcgggacgggcgcggcaggtcggccggagcagggaggaggagctgctcggcctcctctccgacttctccggcgacagcggcgagttcggccgcgagctgtcgttcagtgacctcgtcgtagtcgaggacacggcgaacaaccccagcccgagaggaggcgatggtggtggtgacagggcagctccgacggcggcggcggcggagaacggccaggcgaggccgtcgtcgtcgtccgagcaggaggaggcggcggaggcggcgtcgaggcggcagcagcagcagcaggcggcggcggcggcgagggagaggaggctgcggagacggcggagcgacagcaggggaagctgcgggggcagcggcgacggcgtgctgctcaacttctacgtgccgggcctgctcaccaggagcatgacgacgccgcggcccgccgcccgaggcacgcttcccggcgccgccgcggccgcggccgcgccggcgacggcggctgccggcaaagctaggtgagtggctgtacactgtacacggcggaatttccggcatggatgcagacatgcagggatacgtagctatacatatacggtgaagtattaattatcttggaaagcaaattttgcatcattggtggttggtatcatataggagtatacatgtcaattaacagagtcaatcatgcagtctgatgaccctagcaacaggagtcaaattaactcttaatcatcttgaaatctttctccaattatgagattataatcatcatgtagtagctgtagattttgctagtgaggccaattattccacatttactacaactgcattagatccaactcttttcttctttctttttgatctgcattagatccaactctacttatattgtaagacgattacattctttgtggaaactacatgtgtcatctagtcaccgtgttctttccaaattccagcacagatcagtcatagcccctatagaaaatccagtgcatgggttgtaccattctttttaagtgaaacagcactaaaaggagtaatcagtgcatgctcctttttttttctttgtcagcatcaatttcttttacaattccaagcaacactacagtccttttagaccacatgaccctaaacatcctttttgacttagccagcttactgagtcaaaaatatcgatcaattcgtcaccaggaaatcaatgaaacatgggtcaggggatgacaatctgaccaaagcatccacaggatttatttgactaaaatgtgttaatttttttctagcataaataaattactatcttagtatttcagatgctggactgacaggcaatatcactgtagtaattaatggttggccagtagagtagcatgcatgatataacaaccaccttaaaattctgaatttttagacgatggaagcaacttctgagcctgaaatctgaattttatctgaactttcaggatggatgcgcctctggccgtcggatgctggccggcgttgtggggcggcggcggccgccgcgaccgccgcaagccggcgaaaccggccgccgggagacgggacaccagagtggtgacagtatgagccaagcataatcgatctactccttctattactactagcagagcagctagctttgcttaatggctttagacttcagttgagatgttcctttcctctttgtaaatattcctctactcgtttttttgtagaccgtgacactgggtgggtcggttcgtgtggacagtgagtgaagtttattggaaatttgggatgatcgtgacgtgtcaactgcaggggtagtacggttttgtgcctggattcacggcttcttcttacccgttttccatcagcgtattgcacaagtgatgacagtacatagttgagagaaaaacgtggcaaggcctctgcatctaccttgagcatttccaaaaatgctaacatttaaatctaaaaatgttagtattagggtcatataaaaattgggcaaataaattaccccgccctctaacaacgtctctaaatttggttttttaaacggcacatcattcgtgtggagggcacaacactaagaacatgggattgagattccgtgacttagtcattccctaatatccgtgttttttttctctgacttaagtcgtataattttgagtcactgacatatggattctctttgttgtggactcacttgccaatgaccttagagcatgagacagtgtcggtttctcgtgcgtacgctcactattgggggcatccatccctacctcaaatctggcttaatgatttggttaaattgaaaatacaaataatttgggatattttttcgccaacacagaaaatttgggactggatttaggcatttgttggagaggtgattttggccttaattcacaacaattataaaactgcgaaagatgcttagacctccctgggaaatgctctcatagaaaaaaagaagagttttaataagatcgttagaaaacagaagcagcttttctctcgagttcaatgcgtgatgttgtcgtgtgaaaaccgaaaaccgaatgtgagtgtgggagtgagtgagtcaccgaggaaacgggtccctgcgagtgggactgagttaaagctggcacgacacgacaccacacgacaccagcgatcgctgtagcgtgcgccgcattccgccggttttgcagggacagccacgtccaaattcgaagctgaaatcagggaagaataaagttgtataggagaggcgcacacgggccaatttcggcggcaccacgcgccctcacaaatttggcaggcagcccatcgaatcggcatgggccatggccctcccgttcccggtgccccgcggcgcgcattgggccgtgacttccaccgcgcacgttttggtgggcttcactggtgaaatggcccgcgttgaacagccccgcgcccccgcgccgtacaatgcagcatttctgaggaagaagttaaccttggcaacggtattttctctctcccccaaaataggtgaagttttaaacttttacatatgtattagtaaaatagatataattaaataggaaaatgatatgactggtcaagaaaatgaagtagaataagaatttgaatgatataagattgtaattggttgagaagaaaatgcatacgacgaaaagctcagattcacatttggacatagctggcactgtggtaacacattcacacggtaatcacagagatagagctggtacacatatgtactgctcctaattaagtaattactaccaggctaacactgtctttcagtagcaaacaaagcttaaacacagtactacagtacttgccatggatgaccccgccgccgaacacttgcccgtaataccagtccccaacggctagtttcaaccgttcactccgcccgcgtccgatcccagccgttgaatccacgccgcgccatcccggccgtcgatcctctcgaccgttggaggcgtcgccctccgctccggataaagctcgagccccccaccgcgccgctcctcccacgccaacgcatctccgcgtctctcctctccgatccaagcaaatcaagcaagaacaagaaattttagagagagagttggaagagcgaagagagaagaggaggaggagaggacggccgcctgcttcggtccgggagggagttcgccggagttcttggcgttcttggagcccggaggaggaggaggaggagcaacaggaggccgtacgcatggcgacgaggcaccagcgcgcggctgccgctccgcagccggcgaacagaggtgagcggcggtggctttgttctgtgttcttgatttgggttctttggggggacttgcctgaacttggggttctttggggttccaagctacggatttttctgtttgatgttccgaatctgtacgattcaagcggaaaattttgagttcttggtagtcgagtcttgcttggtgagagttccaggtctgttcgaatcctttttcaagaacggatttatgttgcgagggccaactgattccagtttccatcctttcttgcccgattcatgcaccaagaacggatttttgatgctgcccttcctgtgtttgattaggttttcttgatctgcttgtttcgatttatccccgtgtaaacgcaacccctgttgctaatcttcttctccggcgaatgggcaggtgctgcagtcgcagcggggaagcagaaggccgccgccaccgccgccgccggccgacctggtgcgagaaaccggcaagccctcggcgatatcggcaacgtcctgaacgcccatgtggtcgacgggtaaggagcagcacgacatcatcgtcgccaaccttccccgattcgttcttcctctcgtttccttctctgaaaacctcgtgttcttcttgcaacagcaagatccagctgccggaggggatcaatcgcccaatcaccaggagcttcggcgcccagcttctaaagaaagctcaggagaacgccgttgcggcgaacaaggtacggagtgagacacaccccccttctgtttctcgtgttcttcttgcgaattcagagcggttgatttgatccctgatttttgattttggtcgcagattgtcgtgcagaatccggccaggaaggagccagctccgaagccggcaaagaaggtcgtaccccgtccggagaacgccgccaaggccagcaccggcgccggcgtcaacgagaacaagaagccgtcggagtcggagggcgccggcagcagcagcggcggttcagccctcaagtactcaaggaagaaggtcgtgaacacgcttacatctgtgcttactgctcgttccaaggtgagtgatcgatcgaacacctgtgcttgcctgcttatttctgcataattgcactgtagctgaatctgaattcgatgttgttaatggcagcacgcgtgtggcattactgagaagccaaaagaagtcgtcgaggacatcgacaagctcgacggcgacaaccagctcgccgtggtggagtacatcgaggacatctacaacttctacaggacagcccaggtaaacctcagattcttccatcttcgtttcagtgaagctttcctcttcagatttgttcagaaactgacagtgttgttcttgcacagctggagcgccggccgacagactacatgagcagccaggtcgaggtgaaccccaagatgagggccatcctggcagactggatcatcgatgtgcactacaaattcgagctgatgccggagaccctctacctcaccatgtacgtcatcgaccggtacctctcgctgcagcccgtgctgcgcagggagctgcagctcgtcggcgtcgcggccatgctcatcgcctccaagtacgaggagatgtgggcgccggaggtaacgcagattcgattgattcaacaagacgaacaagaatcccaatctctgcttcacacttgtgatgtaactgaacaaaactctgcttcgctgcggtgaacggattttttcaggttcaggacctcatccacgtctgtgacaacgcctactcgcggcagcatatcctcgccatggagaagaacatcttgaacaggctgcagtggaacatcaccgttcccacaccttacgtcttcttgctccggttcatcaaggccgccggaggcgacaaggaggtaaaaaaaacaagaagaagaaacaaagaacttgatttcatttctggtgtgccatggaaattgtaactgtattctgatcagagacattgtgtcttttttcagctggagaacatggtgttcttcttctctgagatggcgctgaaggagtacggcatggcgtcgctgtgcccgtcgctggtggccgcgtcggcggtgtacgcggctcaatgtacgctgaagaggagtcccctctggacgagcacgctcaagcaccacaccggtttcaccgaatcacagctcaggtattttttcaactttctgaatttccattttccctgaaacctgaactttctgaacttccgtttttcctgaacctgaagtttctgaacttttcaatgatctgtaaactaacattagttctgattgttgggatgaattgattgattgcagggagtgtgcgaaggtccttgtcaacgctcatgctgccgctcctgagagcaagctgaagacggcatacaggaagtacgcatccgagcagcttgggcgtgtctctctgcgccctccggcagtttgcctagcctaggattagtactgttctggattcggtttagactgtgatggaatgtcgttcttgacagtatttaagattctttcgtgggtttagctaattggatcaagacaacttgagagcgattgttgttgggttttttgcggggttactctgaactctcgagtatactcatgtattcagtactgtgatacaccttggtgtaactactcttcataaattcttttcataagtatgaattgaatgaaaagtattctttttccataattcttttatgtctgccaatttacttgcaaaaagatgtgtgctcaagtataattctgcaatgaaatcaaacttttgaggctactgaaaccaaatgattttataattcttaactctgcaaataagcaaatgtgctgactatggaaggtaagttatatattggttccttttctgaacttgcacagccataaaagtttccaaatcaccatttgaatatctttttttttctcctgtaaatgaactagaagaaactttgctctggaagagaaatctagtactaccagtagcattcaggctgtgtttagatccaaagtttggatccaaacttcaaacttcagttcttttccatcacatcgacttgttatacacacaacttttcagtcacatcatcttcaatttcaaccaaaatccaaactttgcgctgaactaaacacagcctcagtttcaaatagagaacaaactaaaagcttatttcaaataagtggtttcaggcaaacaagtttcagttcttgaactctgaaatgtagttgatcagagacgtcacgtctctgtaggaagaaccaccctcttgaaccgcggcgcgagaggcctctcgcatcagcgaagctctcctcctcatctccttcgcctcttccgccgccgccgcatcggaatccatcaccatcagcctcctcaccgccgcggcgatctcctccctcccgacgacgccgctgcagccgccgccgtccccgttctccctgaggccgtacccgatcctccactcgtcggcgacgagccgggcgacgatcggctggtcgaacgctatggggagcgtcagcatcggcacgccggcgtgcaccgcctccagcgtcgagttcatgccggagtgggtgaagaagccgccgacggaagggtggcacagcaccttcagctggtccgtccacggcaccaccatgccgccgccgccgcggaggatgtctcgcgcgccggagtcgccgcggagcacccacaagaacgtgaccttgctgtcggcgaggccggcggcgatctcgtcgagctgcggccgtgacaccgagaggaagctcccgagggagacgtacagcaccgagcccaccggctgcgcgtccagccacgccatgtatggctcttcttcctcgtcgccggcgtggtgttcgtcagcttggagcgccatgtatgggatgcaagggccagccgagaacgccgggtaagggaggtctcgccggagagcgtccatggcgttgctctcgagctcgtagaaggaggtgaagatgacgcactgtgcttttctggcatgggagtaggcttcgaggatgaggtctaccatgttcttgttcgtgtgtgtgggctcaagatcgctaaacctgatcgatttcagcccaggaatgtagtttccgacctcatcgccatctgcatcggatcgagcaacaaattttcatttgcaacgaaatttacgatctttcatgatgttcagagcttcgtaccggcgatgtcggtggccgtgggcaggcggtcgaagtgatagtgcacggagaacatggtggcgctgagcggcgagaggacgcacaccggcaggcccctccggttgccgacgccgaccgcccacggcagcacgaacgtgtcggccacgatggcggcgggcggcggcggcgccgcgccgagagcgaggcggtcgaggaggcgctcgaacggcgcctccatcctggtgtacacggcccgcacgaacccgagcatgtcgccggcgcggccgtgctcggagggcacgacgttggggatggcctcgaggcggacgccgccctccgccgccgcggccgccgcgccgccgagcaggccgagccactcctcggtgacgacgacggtggcggtgacgccgtcgcgcgcggcgaggatgcggcacaggttcagcatcgcgttgacgtggccgcgccccgggtacggcaccgccacgacgtggcacggcggcggcggctcggccgaagaccccattgcacgcacggcgcggcggcggcggcgaacaagctcggagctgcacaaggttcacgaagtcaaagcgagaagcgaggttctgaacagtgagacatgatccgccatgggagtccgtgacctcggcacccgccgccgcctcgagaatcgtgatgattccaacgctggaatcacgtgtagtaggccaacaaattctggccaacctggagcccaaggccttacttagcctaatgggccggcactgtgggctttcgactggaccataagctttgcgggcattgtgggctttgcttcccaagcttcaacttcagaagagcagtgtttgaagggtttgtacttaaaatgtgtgagttgagtttggacttaaaattttatgaattgatatttatatatattgtacgaatgttgtcaatttattttataatttttaatagctatttatatggttttttaagacatatgagaggacatccctaagggtttaaaagagtttcttgtgtttgaacggtcttcttttttttttctagttaaagagagttttattaatgactgaataatggattatgttcctgatttaagaagtataggattcttgaaggagaacaaagtctccactccgcataaaacctagtactcattgtcagttgagttaaaacatgtgctaccctatttgtttctcttcttatctcgtgcatttgcatctgttagaataggtgttgaatatactagtcctatttggttacagttggacttggaattgtaataggtgttagggggtggagttagagtcgaattctgtaacccggcatctctcttaaatagagaggggggcaccacaatataaccatagcgactacaatgtagcgtagacacgcagggagaggatgtcggcgtggccatggactcgtagcagctaggagctatattggttggggaggagcgcccataatcagagccccggggatgtaggcttcggctgaacctcgttaacaaatatcgtgtgttcctgtgtcgtcatctggcatgtcttgggtgatcaatgattgaagcgatcgggaaggttagtcgttgttccgctatatcgactaacttttataacaagtggtatcagagctgaaggtttcagtattggatcaagaagacatgtggaggaggaaacacgaggcagggatcgcgcatcgacaggagatcgtcagccgtggcgatgagatcgatggcgacaatgaggacattgcggaggcgatgacctcgctcgcgatcagaccggcgatggcggaacgtgaccggaagacggggccgggcgtggccgaaggcgacaggagagattggaggggtagcgccatgtacggcgtgcccgacgcccgcggcgaatgcggatccgcggcggcagggaggccactgatggaagggcgaaactggcgagcgtggcgcggcgcggcggacgtgtagggccgatgacgacggggtcgtggacggtgaacacgagggctgcgactgcggtgcgtgcggaggcacggacagtgcgtatggagtatgtactatacacatgcacaaaatacacgtgttggcttacagacgaacaggaagccatgggcttaatgatgcagacgatgacgcagcaaggaagacgataaaattgagttcaatgcagaagaagacgcagatcaaacttgactcggagaagatgtggattcggagtcgacatcgtaaaggactctgtttggtaggcgtggatcggagttaggagcaaactcatgtatcgaaatcggcagagcggatcgtggactcgtggtgcttttggcttcagttcgtgtaagaaaacagggcaattacttggctgcatgcaatggggattagtagtgcaagtttgggcatggactatggtcatgtggatcattaattgcataaacatatcactactattacaaggtcacgtgaaaagcaccagcaggcatgccgttctcacgtgggcttggtggcgcacgagaggaggttgtgcagtggagttgcaagctacatcaagcagggcacggagatcaaaacaactaaacggacttgatcaggaaaattgatggatcaatgcggtggacgagatggcaggagtcaacttgttgcgtacggcatggacagatcaaattgacctggagtttgggacttggtgattggtgcaaggctgtgattcagcggagcggttcatgggcacaagacaacaaacatggtgtagatatatggtgatcaaggcaatgcaatgagtatacttgtcgagacaaggtgcgtaagatgtgcatgtatgacggttaaactgggccggcagggtggtcagaccgatggactggttagactgcgaagcttggacggttagatcgagtacaacggatagtgattcgttgtagaaacttgtgaatggattcagaataagggcaagaagtttctacagtctggatagtttgcaagtgcaaaaggcgagtagactggtggcaacaggctagtcaggtcgcatatcgaattatctggcgggaacatgatatatctgggattcgacgaggagttgagatatatggagttaagccaggactgaagaaaaggacccgggcaacagcgggtcaaatatcgttgatgggatcagcgatactgtttggcagtacaggctatatctaggatatgcgggtcggtatgatggggatatatggaaatctgcgtcactgaagaggaagagcgaaggctatcgtggtaattcttcgggtgatttaaagcaacagtgattttctcaaattatcaggaattcagtctacggatgcgggaaagcgtgaatgatggatttattagttcagttcataagacgacaaggaagaaagggttcagttcttcatgtctggtgagtttggtttatctatttggtgatgacaagggttatttatccatggattagatcaaatcaaatttaagacgaagatggaagtgaatagctaagaaggaattcaatttcgcttcgcaagacgactgagatgataggtgagaaggtggagcactgttgcaggtggattcaagaggaagaaattacagggatatcggagtctcttgaagacggtgggtctggcgtagactcgtcgggcggctttgcggtgaagctgcaaagaagacaacccaagtctggaggacaggtggatcggcatggtgattctactacttctaggtggcgtatatttgtcaaggtggagtttgttaggataggtgtcgaatatactagtcctatttggttacagttagacttggaattgtaataggtgttagggggtggagttagagtcgaactctgtaaaccggcatctctcttaaatagaggggggcaccacaatgtaaccatggcgactacaatatagcgtagacacgcagggagaggatggcggcgtggccatggacggctaggagctatattggttggggaggagcgcccataatcagagccccggggatgtaggcttcggctgaacctcgttaacaaatatcgtgtgttcctgtgtcttcatctggcatgtcttgggtgatcaatgattgaagcgatcgggaaggttagtcgtcgttccgctatatcgactaacttttataacagcatctttttaagacattgtatgacacctttgatttttgcaatcgtcatcgaccaagacatctcaatgaaactttatggtttaagattctccaacaatattagcatatgaatctattcaatacctacccaaagaccgaagtccttctaaacatgctagtgcttcagcttgagcagtgaaaccacaaaggtgcagggttttatgcgcagccaacagcaccagtcccctacaatctttgattctactaaattcactacataaattattaacgttcgccttaatttgacaatatgccctaaattctaaaacactgtcgcttctctatttttctatattattttcttattgtaaataatttgctattgagatgtcaatgtgtcatcggtgtattgtacattgcgcctatagattcatgttatgtgactatcccctcaaatggaggtccagttcagcctcatatacctttgaagtaatatctatatggtaaaaatccgccgaaaggttatgtaccttacgagtatacccatattcatggtaaaaaaatccgccgaaaggccgctgccttcaaaggatcgatggtgaaggttgcgtgcattgagatttgagaatacctgaatctctctggtaaatgtccacgaggcaccggttataatgggacacataagtatactttcttacctgtaatataaaaaagaactagcatatcatgagcatcattttgaagtctttttgaagacaatgaaacaatgtttacagttttgctctctactctacaaatagtgagcatcttttctccccatttcccttgcttcaggaccaatatgataaatccaaccatcacggaatatgtgctcatgtaacaaaccgcaagatcgatcgcagagacctgattgacgtgctggagcgatttccgaccatgcactgcacgattaaacaaaacgtaattaggcctgaaaagtggcaattaactcgcctgtcaacgcatcattctccatttctccccaccaaaaaccggaatcagagagtgagagagccagtcactcgccactgccgtttgtgcgctcccatctgcatccggatgccactgctcgctggtctgtctgtccataaatataaatattttaacggtttaattttgtttagaaacacagtgcaaatgtatgcacattcacccctatgaatgtatgcacacgtcctaccttatgagcacctccgaaacattggatcggcatatctatgagcatctccgaaagattgggttggtatattttgagattgacgaagtcagctgtcaatgagtatgtcgcctaccactgaaaaaaataattatctataaatacgagtacacggtcaaatatagaatttaaaccgagtgaactggttccatcataatgaacctaaccagttaagctgcgctcacttagctaaacagtttaaaatttgtttacaaatataagtgcttagagagtgttatgtatctcgtcgattgtctcctattcaaagttttttatactctcttcaggctgataatacttatcattttagacaaaactaaggtcaaactttagaatctttgattataaatcatttttaaatatttgtctttcaaatatggtgagtacatgtatagtttagtcttaaaagtactttaattaaatcatatatttgttaccacttttatatatattataatagaaaataatggtcaaaattgtttttttagagaccgtgctctttttcaaaacgataaatattatcaacccggagagaggattttacttccaatcacctcctaccctaaccattcttctttttgtaatgagcgtcgacatcagagtttttctaattacttgttaaaagatttaaaatatttatatttatgaactgaaagagtcgacgagtagtctagtctgatcactatgttacctcctcctttagactttttaccccattcttcaggtagttaaatcgaaaggtccgattttctcttgattcgactaacgtagaccagcatggaaatgcctgttctgaaaggaatctctccccccttttgcgtcacctgatgatctgtgcttgcgtgcattcatgatgcatgtcaaccagtgatttgctgcttatacttcctccgtcccagtaaacgtgtcgttccacggttccagtaaagtcccaaaaaacttgcgtgcattcaaaagtactccctccgtcctaaaataagtgcagttttacactattcacgttcaacgtttgatcgttcgtcttatttaaaaaaattttatgattagtatttttattgctattagatgataaaacatgagtaatactttatgtgtgactaaatatttttaaatttttcataaatttttcaaataagacggacggtcaaacgttggacacggatatccacagctacacttattttgggacagaggtagtatttgctgtccaacgtgttgtgtgttgtgacatgacatgacatgacatgacatgatcaaccctctcgttgaggtgaatctgtcagtattacttatcctacctgaatgctatcagagagaagctaattgccctaagctttgtttgctgatacttgttctgtttctgacgaacaatagagaacattcactttttgaactttgataattcatcttcttttatatatactgaatctagaaacactaaataacattatgttattaaaaattattgtgctctaaatataagcatcaaactattttcacgttagtctaataatttaaaaacgatcgggatcaaagtggtcgctatttagaaacggatggagtagtaattaagtttgaaaaaaatgctgtactatcatgtactactacactagtaggattttgcaggttatttgctccttggctagctactgtttgtatgtcgtggtgtttgtactatgagcttaagagtgctaaaaaataaaaaaaaactcttttttttgaaacctaaaaataaaaaaacttcagttaccaagtgatactgacatactgtaagcatggatgaggacaagtacagcttcagttcaggctatgtccagattacagaagatacgaacgacgtgagtgcgtggatgacacagacagcaaaagccaaaaagagatgcttaactccataccaattatgtcgtatttattaatagaagcacctttcacatgatttgataagagtatttactcctatatgaggtgatcatttattccgtttcaagaactagttgaatgtttatgttctgatacaaataaataaaatgtgcttacaactaattaatgtgattgtgtcaaagattagcatatacaaatataggtgcaccaactttaacattccttaatgcgtacacccaatttttgggcttttcaggagaaaataagcttctaaaacagtcaagtgcactaaaaagaagtaaaaaaatatcttttgtttgtttgagttaagaagctgaattgggctttggtttgaatatatatgcatagaactatcagatcatccatatgttctctgtctagtctcatcgaaggagtgaataatccgtttgaactttggggtagtatagctttccgccatggactccacacaaaagaaattcctttcttctgctgtgtttggagatgtagctgtccgaagccgctgaagaatattgcattattcttttggaaagtgatgtagtgaccacttgctggttctcatctcaaagaaacaatacttgcataaaacagaggagaccatgactcaaaagtttgcctcatatattggcttgtctagtctaggccatgaacaccatgcctgcctaacaattcaactttgttgtttaaatagcagttatattgggaaaaaaaacacatgttataacacgcgagaggagggatatattagctcaccaccatataaataacctataagtggtttgcaagtcatcataaaactttgaactttagagcttgcttatttgagacacggttatacaattttaaattttagagaataattttagcattaatataaggttttttttgtcctttttaattgtcatttggcattggctttagaccgccaaaaaaaggcacaaaagttttacactaaaattgcttcatccgtcaaccgagagagatgtgagagttgaagggatagcagggagaactcaccaatgactacgacaatgacttcctatgtgagcctctagatgtcgttggcatatgaactctggcaaagcatgtatcaccaggttaggttttcagggttggtcgatagaggggcaacaagggtggcttttgagtaaactctgaggtggctgaggaccaacgttagatggtggagatacgaggacgagcgatggcactgaaattgtagagatggaagagagcagtgaatgaggttggaaggaggggcaaagaatgcaatgtggttaggaggaatgcggcaatagttgctaagcagcgaggagagaatcgaagtgttgcgatggatggttacagagagtgagaagagttgactagtgttagggttatatgggatgtatgaatagagtaaatcttggcatttaaaaaagtgacttgcatctaaaatatctttagggtaagtgatcaatgtttttctttaccgcagcttgtttttagttggcttaatcatgtatctttgatttataaactgcacccaaaaaataccttccaaaacaacttttatggtgtgtttgaaactaatatatgttatcaacttctactcacttgtttttcacgcgtacactttaggaattgtttaacagtgtgttttttaaaagaaattcataggatagttgatttaaaaaatagctaatatttaattaatatgttaatgagctaatccgttttcgggaccgagcgcaccctaatctccacagagtgacagaggtgcaccgcaaccagtaagtatgagagcatcagcatgcaatttcaagctccagcaaagctgccgtcacggcgtgattctccgtgtctgctgctctgctccacgtattaacgcattgcaaggcacagagaaccctctacctcatttaaaaatctgaattgtgcttctccttttccccttttttttttttagaaaaagataggtccggatttctactcggaatccactaaaatggccattgagcaggagcgcaaacattttcggaatatacgaatccagcgttgcactggcccacccaaagtggggaccaccttactcacacaaatttctttcacagagaatcaccgaaatgcccctgcccataaaccctataaattgactgataagcaacggccatttcagctcagatcagctcaattcagagtgtgtgcctctcgatctagatctctgagttcttgccatctttaatttgaaaccgaaatcatcagctgcaatcttcgagattaattaggaagctaagatcgccatggcttcctgctgcggcggtttcatggagaaggccaagccctacttcgccatgatctgccttcagttcggctacgccggcatgaacgtgatcaccaaggtctcactcaaccatggcatgagccactacgtactcgtcgtgtaccgccacgccttcgccaccatctccattgctcccttcgcgctgatcctcgagaggtatacaatccgttgttttaacgtgtactcgtatgtacccttattgtcggtttaagcttctggatgaactggtcggtgcacggacttgattgttattgtacattgatcatatgatgtgtaacggaagctgacgtgtcgctacaaattaatggcattatgacaggaaggtgaggcccaagatgacgtggtcgatcttcttccaaatcttcatcctggcgctactcgggttagtgagacttgtctacttacagcgtaattacactataattatactataattatattttaaagatttttaataaaagaaatcttatacgcaaactccattgcgtatgatcttgcagcgcttttaataaaaaaaatctaatgaaggattgattatgtttagtgagacttagtctagttataatgtagttacactacaatttgtaataagaaaatcttgcagcttatgttttaaaagatagtctcatatgcaaactctaatggaggattgattatgtttctgccaaagaaaaggaaatatttgccaatgaaaatttgcaaaggaaaaaaggaagcatagcttgtctctggaatgacacattggattcacctgttcttggtttgttggtgcagaccggtgatcgaccagaacttctactacgccggcctgaagttcaccggcccgaccttcgcctgcgccatgagcaacatcctgccggccatgaccttcgtcatggctgtcatcttcaggttcgttctccaccacgtacgatctctctcaatgcatccatggcgatcgagagctagatgtgagctggtttgacgttaatgcatggtgttcgacaggatggagaagctggagctgaagaaggtgaggtgccaggccaagatcgccgggacgctggtgacggtggccggcgcgatgctgatgacgctgtacaagggcccgctcatggagatggcgtggagccggcacgccggcgccggcgtggcggaggcccccgccgccgccgccgccgccatctccggcagggactggttcctcggctcgatgttcgtcatcgtcgcgacgctcgcgtgggcgtccctcttcatcctccagacgcacaccatcaagcagtactcggcgcagctgtcgctcaccaccctcatctgcctcgtcggcacgctccaggccgtcgtcgtcaccttcgccatggagcggcgccgcccctccgtctgggccatcggcttcgacatgaacctcctcgccgccgcctacgccgtcagtaccatcctctcccatctccggcgccggcgatcgctagcacgcactctgacgttcttggtttcttggacacatgcagggcatcgtgacgtcgagcatcgcgtactacgtgcagggcttggtgatccagaggacggggccggtgttcgcgtcggcgttcagcccgctgatgatgatcatcgtcgccgtcatgggctccttcatcctctccgagcagatctacctcggcggcgtcgtcggcgccgcgctcatcgtcgtcggcctctactccgtgctctggggcaagcacaaggagacccaggagaagcaggctgacaccaagctatcactgcccacttccaaaggcgccgccgccgctgcggaggcggaggagatcaccggcgccggagaagacgacggcgacggcgacgatgacgcggagcgcagcaagaaccaccgctcgagtggtggcgtgaggtcatcatcggactccaatggacatggagctagtgcggtttgatggacacctaaccccccaataatttggttgcggccgtcgacgcgtcgacgcgacggcgaccgtcgccatcgccatgcgtgcgtcgacgtcgatctctccgctttaagatatccgaactgttcgtctacggcgcgtgcactacgacgacgatggcactaagggctcgttaaatttggaaatggaggtttttgtttggtaggaaatttttgatgaacttttactgtgttaatttccctgcaaaatgtaagcgtttgtcacctcgtcagatgttcagaatggtggcatgcatatctctgcttttttttttatcatgtttgatcaaagctgctacgctattttgtactggtttcatcctctgtccatcagagagagtgtattgtgttttgtaaattttaaactcttcttttctcgttactccacgtttacaaatagtacatatcgttttgaacatcaacacagtcatactaacttcaactttttaccaatgtttaacaatttgtcttattcaaatttttttgcaaatacaaaagtatttatttcatacttaaagaatatttgatgataaatcaaatcataataaaataaatgataattatattaaatttttaataagacgaatggttaaacacatctaaaaagtcaatgcgtcatatattgaaaaaccaagggagtatttaactttggcgctatagctccaactattgtgtctacatcagtttggtggttttgctgtagacaactggataagactgaattcctaaatgctaatcattatcaaacaaaataaggcagagttgagtacatcagttaaatatataagtgcactgcaaagcatccatacttgccagttgccacaaaagattcaccaattgaaagatcctttgagcatctccacatcactgttaattaccatactgtttgcaaaattgcatgtgtggcgtcagccaggaatatgtctgatggacttagattcagattccactgagaattatagtgccaaatttgttgctttctggtaactggagcgatcactttacagcttgaatgctagagcaattaaccagagaaccatgacagtactagttgtgaggtgagatgaagggtagtaaaaaggacagaacatgcttaccacaattcttgattatcttattgtcagataatttgacagatatatagcatgaatttgatattatctaaaaagatgtagcatgaattgacttgtccatcaatggactagaacaaactgattgagtgattgaagtgaactactccctccgtttcacaatgtaaaactttctagcattatatgtctagatttattaacatctaaatgaacgtggacaatgctagaaagtcttacattgtgaaacggagaaagtactgaagaaagaccatatatataatgttgttcatggataactcataacttgactatttgcctctaaaagtctcaaagctaagcatgtataaaattgtggtttagaatattggccttatcttgaagcaagaagaaagtacatataacttcattccgttatcctattgctaacaacactagtgtgtatatatactgtttttagctacagatgcattattagttctctttctggtgagccatgccacattgccactagctctttgctgctgacatcctgatatgaatgtataataaagtgatacggtgcactaaatttacaggccttccgcccttccgtattggatgacactgagcaaatagcaaaaccttgtactagtcatactactttcagtgcaaaaccaagaatggatatcaaactctatcatgagagggagttgcatagcaactcttatcatgagaaggagatcataactcataagcactattaggaattgcattttttttccttccaaatttcaggtctctgacggtgggtatggccgaaattttttaatatgtttcaagttagcaaaagattgttcagattcagtgaaaatcactttaaaactcgcaatttttttcattttaaatttcctaattttttatccttcttttttcaattccaaaatgtagacccctgcttgccacatgaccgatcaaagcacctgcagggaaaccactaaccaacttttcagaatcatgagtttttttttttcatacgcaattagtggtttccttgcaggcgcacatagcaaagctacgcaatatgcactactagtttgtcaatgtgatga

SEQ ID NO: 29248 - DNA, 6091 bp, Oryza sativa
ccttgcaggcgcacatagcaaagctacgcaatatgcactactagtttgtcaatgacgaaagctttttttcaccaaagtcctgagaaaaattccttttgcacgatggatctacacggttacatctgctacaacctgctgcagcaacaggtagacgcattccttcacagattatcactgcattgagctgcaagcttatcagaaaaacgatgagaagaacatcgctttcgcaacgaggcacgcatgcgtgtgacatctgaataacaatgatctctcccattatagaattataccaatcaaatgaaaatctttttcttgaaaagaattagcctgaaaattctttatgcagtgtatcacaatttggtgagaattgctagctcaacgacggcaagttgctgcttattcaggtatccctactcagatagcaccgagacaatgcacatttagcttggcacaagtaagcccagctttgcctctctttttttctgcctaaaaaatataaaaattgtgactgtgagagttggggtttgcaactttaaattggcaattgacgtcttgcagattcagttgaaatgggagagaaaacttagggccaatggcagtgagagttcatgcaggtgagttagatccatggatggagcataacagttagcacggaatcttcaaaggggttgtgatgtcactcaggggtttgatttgggtttggcacataagatgaggtgtcgattctgggatgtagtaaaagccagagttcgatctgtttattgttctgcatgagatgagcatctctaaactctgggaggaaagacaagtgttaggtattgtgatacatattttatcttggtttccattaacagatttttcaaactactaaatggtgtggtttgtgtaaaagctttctatatgaaaattattttaaaatagcaaataaatttattttttaagtttataataatcaaaaattaattaattattctctaattgttttttcatttcatgtgtgttaacttaatattcatttttgtcaacttcaaacgggataaccgttgtggaactggattggttctctttacataacaaaatatcgtttcttccgtttccatatatcccacttcgaatcaggattaattttttctccattgctgggccgacatgggcctgcttcgtttgagagatgggccgtgcgacgatagaagcaaaggacctctcgtcctctccgagccgtgtgtaataagttcatctcaagtcccttaattttacaccgagtccgattttcgttcttagaaccccaaaaccagatacaaccggccctcgaactgtcaaaaccggtgaaaacgaggtccctagcggttttgaagacggttttggctgatgtggcgtctacgtggctggtttgactaggtctccgtcccatgtggtattgatgtggcgatgacgtggcaattatatcttggaaaaataataaaaatcatgggcccacatgtcagccacaaaaaaaatctaaaaatggtggggcccacatgtcatctggttgtcgccgtcgagcttgtcgatgtcctcgacgacttcttttggcttctcagtaatgccacacgagtgctgccattaataacatcaaattcagattcagctacaatgcgattatgctgaaataagcaggcaagcataggtgttcgatcgatcactcaccttggaacgagcagtaagcccagatgtaagcgtgttcacgaccttcttcctggagtacttgtgggctgaaccgccgccgctgccgctgctgccggtgccctccgacttcgaaggcttcttgttctcgttgacgccggcgccggtgctggccttggcggtattatcgggacgaggtacgacctggccgacttcggagctggttccttcctgaccgggttctgcacgacaatctgcgagcaaaatcaaaattggggatcaaaccaaacgctctgaattcgcaagaagaatgaggaacagaaggggtgtctcacccgtaccttgttcaccccaacggcgttctcctgagctttctttagaagctgggcgccgaagctcctggtgatggggcgattgatcccctccggcagctacatcttgctgttgcaagaagaatacgaggtttcagagagggaaacgggaggaagaacgaatcgggaaaggttggctatgatgatgtcatctactatatgattgtgtgcgtgagatcgttgtcttctactccggatcagcgaataggccactagttattcaatacgttatcagcacgagattgctcatacgctaatcccggtaagtgttctagtagatcaattgatttcagtactaatcagattgatatgttatctgtgtactgctcgtcgccggccaacacgaccgcccgctcatgcgcacctgcacgccgcgctcgacgcgtggctgatggtcgccggttacgacgccgcactggagcatgcacggcagcaggacgcatccagccgcgcgtgcccgaggcaaccagccaggcggctctaccacacgcagtacgcaaccctgcggctaggatccaggagcaaaggatcaagcagacaagcatacatgcacatgaatgtacagattggtttatgaaccaatctagtacgtgcacgtattgatcttcaccaagcctataacaacatgggtgtgcaacgacgtgtcgacagtgctgggctatacacagctacaccagcacgcaactcgtcgacgccgcgtcgccgatacgctatgcggacgtgcataagcggatcggctacctttacatcggataaacgagataagtatcggtttcatctattctaatactttgcagtagcgagagtaatatgctagatcatgcctctagtcgttttattttctcgcatgaatagatgtatttgtctggccttagcggcgactcttctcttgttatatcgctgaccacgaagtttggcaccacgcgcccgaacgcgcttaccgtgcacaccagaaggtgcacatacataatccgttgaattgaatgatggagtgctgtcccgaacgacgacacctcacactcggtaacacacgacaccacctagaagttgtcgtctatctggctaacatagtcgtcgatctatgaatatattaacacactcgtcatcaccgatcttatggatcagcgtgcttgggacaatgttggttgtgacttgtatgttaataatccgttatattgctatctatatgaagtagatggtaacaaatctgagtcatcagcacctgcatgcgccgccacctgcacgtagcgacacccagacgccaccacatgacgtcttcccctttgtcaatggttgccgaatcaatccagagaccttccctcgtcgatccgccatctgaaacaccgactcgacggcctttcgaggccatccgcaacgcaattgacggccgtcgcccgtagcgatgccgaggagcttacgcccgcctccccttgccgccgatacgcacggcatgcctcccacgctaccgcacgcggccgggacgagggtcgaagccgccgtgagtgcccgccgccgatagccgtccgccatgccggcatgtatgccgagccgagtttcgtcgacacgtaacatggagctatgattgtcggacgctggtcacggcctgatgccaaagaatgccggtgtcggtgctactagatgttgcaccgccgctccgcctctgaccatggcaacttgccatagtcgtccatctctaccgagggctcactagcacgtttgcaattggttccatccgtcgtctccattgaagaatatcaattagatcatacctcacccacttcttgtaggagaaggtcgtagtagctcattgggcaacatatgagatgggctggccagattttcaagctagccagtataaggagggggccaagtagaaattggcctattaaaaggactcgggcacgaaccgtgattttggtccgaaaacggcattttatttcaaaagtccttggtttccaaggcattatgcagaactcggaaattatacggataagtcctatgggacattagaaactacggggaatatacattcgccatttatactttgaaccttcatgaattgggtttacgccaaatagagaagaactaaggatttataccttagtcccgtatttctaagtatttgctttaactatttagttagtttcttgaataacataatcaatcctagaaacattgtttttaggcaaaagagcttccatgaacttgtgaaacccttgttttagcaccccttttggaagcatcatattttatggtttatttcctggcaattgtttgttttggggtaattgattgttctgtgggttagtagttctgtaaattacacatacctttgaatagcaaaaaatcatgttaattgctaggattgtaataaaaggtgtgtatagaaaaccattctttactattttgtactcgttttgtgcactttatttactagaagtaaaccggtagaaagttgcataaaaggacatcatgtaagtagttgcatgtagcaaatacatttattgggcaaatgagtaatagaattattcatatatcttctctttgtgtaattgtcgccacatttgtagaaggcacaattatatattctccgtatagaataaatgtatacactcatcatgaagaaagtatattattgacttagagatatttcttagtgtatgactatcatagaagataagttacaactaatttatattaattgtgtccaagtagatacaatgtcatcgaatttgtgaatatatagacgagaagtctatatgccaatatgccctacacaaaattatctatcaaaagactatgtacctatgcagtgtctatagttaatttgattgataatgttatgtccattttccacgtataaatgaatttacaaatgaagtattgtttttatgaatgtatgcacatcaattttggcctatatgcaacatgtttagttgttagaattaatacacaagaagttgtattactgtcaacatgtgcatttgcacgcacatatatgacttatactattaatatattcatgaagaacatgcatactcaaaatttgtggaaggaaaggaatttggtgtatttgaatttgatgttcaactcagggggagatgaatagtaatgacagtaatcttgcattcgttcttttgagatcgtattttacaatacatgagttacattacagattagattaagttcaatatgaagaacatggttaagctcatgtagagcttctttatcttttgctttaggcatagaagcttctgcattagattactgaatatttttttatataggtcatctcaccttacctatattgccttttttttacctgtagtaattctttaaccttttgtagaataaaattgtaaattatatgtctaacattgaatgtaaatatttgtcttgcctattatttgaagtatttttggcgaatgtattcttattatccactaagcctcaatcaaccatgtaggttggtagttctaagtgcattgacgccatattggcatacatgtagagctgttcacttatgcacatgaacaattagaatatttatgtttaagcattgaagcttaaatatatccacctgcaaccacattatttctttttagaaaagttgtaccatgaagtcacaacaaatatgtgggtttcacgacaactttttagtaaattttcttatgattggcgtgaaaagggggaggaatatgtgtattttgcaaattaatttcagaatatttataataaagaagcataagaaattgtggatatgtggcaggcaaattggtgtgttataggtcaaatgctagaagcaaaagatagcccaaactattagcgaatcatatttgggataattatgaattattgtcacacaacgaagtgtgttatttattggccattgaaaattgcatattcatcaaggaagtatgaaattgcatatagctatttaaaagctattggtttacttgtagtaaacaatatcctaaaaataattaatgaccttttggattcgaatgattctgaatgatcaaatgacaccacatttactttggcgtaatgaataaaag

SEQ ID NO: 29249 - DNA, 5548 bp, Oryza sativa
gaaaaagatctttataagtaagaataacgcacaagccaaactaaactagaaggtttagtttattctcctgtaagccagaagcgggagcttgccagataattatgaattaaaggagtaatcagaagttatgtttacttgtagtaaactttctgctaacagcggtataccccgggttttgaatagtatatccacaaatgcagagtgacatgttagtcaatgttctaaaatctacggggacgcctgcggattctaagatctaacgactattgtcaatgtacccattaataactccttacaactattgtagagtaatcaccatgaaggtgaattgcctcatgaagaggttcatcatgaagatgaaaacccagaattaaagtgcgcacatctatctaattctgggatgcggaacaaccatatatcttatgtttgggaaatgactaagatatggtttataatgaattaacctcacggaatgagtatgtggagaaaagaatagttatcgacaacatcgcctctatgattgctaatatttctctaatgagaatccggatccggaaccaaagtccatggcagagttgcatagtagcactcatattggttctattgaagaaagcaatgaggttgaaccatagtcgctaaataagtctatgtgaacatggaagttcatacttaataggaaatgaagtggtgaaaagcgacggttcatatggtcatggaaaagactgatattctcctactatgaatgtattaaattccgctatatatatcgctggcaaaaggtatgaattaataaatgatatgcagtttatgggttatgaaaatccatatgaagttttcactagaaagaaaacaatttcgcaacatatatgtaaatctcatactaattagtgtcatgaagcacactatattctcaagaagagaattgcaagactcgtagaagagtttatgatgactcatgaagagtttttctcctagaagtgagaatatttctcatagcagagaaaatgacttccggaagaataagttgatctctgtaggactatgctaatgtatgaattgccggttaatctccatataacaccaataactcgtactcccatgaagtggacagacccgtttaaacgaatgaattggtccactagcatgcaagtggatcggtagttttctacatactatgaaggtgtaagaatttatatatcatgaagatatactttttgatggtatttggcaatcttattaattcccctaatgccaaaatatagaccagtttatgtcactctaagtggtttaagctaattgttgaagattagtgaaacaatcaaactggtaatgattgataaatccactaagagaaagttgcataatatttaacctcttgtattgagctaattattttatacataccgcatatgtgtaacgttgcaacttattttcccatagtcctccgtaaggataaaactttgtttgtattgcacatttgactaagtggttatacatattgctcctatacgttgatttatttctcatgttcatagtaaaacttatgaaataagtaaatgaaagattaaacattgtggtaattttattatcattgttttacacattaataaaaatatggttatgacattggaacatgaaagtttcaacggatgtcttattgagggggagcatatatgctaaacatttattatcatacttaagacttggaagtcttatatttgatttaccaagaattaatcaaattaatctttgttttgataatttaccttgaaggttactaccgctatattgttgtgttaatccaagttgattaatacaataaagcatatagatcattggctatttatgaagaatgtatatcttaaagattatgcgatcaagaagatcgtgtgttgtactctttttcccttagtgagtttttacttgaatatttctcacgcaaggtttttaacgcggcaacaagtgcgatataactagcgtgtacgatgtactcttttctcctatccttttctcccactgggtttttggatggagtttttaatgagacatgtgtatagcgcggtattcgcccaaggtggagtgttataaaactattatctcctgccagagataaatatggactcataccaaatatatggaaacgtatcctaataggactcttcctattataggtatatatattgagagagatggcttgagaggttggttgatgtatccacatatgagaaagcaataaagctgtgatgcctctccctatatccgtgttcattattcatctactatatgattgtgtgtgtgagatcgtcgtcttctactccggatcagcgaataagccactagttattcaataattgcaaccctccagataagcagcggagttcagacagtgtggcaacgactaaccgtacattccatctatttttctagaacattcatcttataattactagaaaaatacctgtacgttgcaacggatgaagttattttaaattttttattgttattgtttggttaagatgaaattcactgtgttaaattcacttggatatatattttgttagaaaatcatgagttgtaattgggagtccaatcaaattaacatgtgaatttttaaagatatttctttacgattcttctgtatttgcaaaagcgaacgaacttaaaaatcgatttaaatataaatttgtattttcaaaaacgaacgaacttaaaaaatgactcatatacagatgacataccaaagtattagtaaaaacatcttcaatttttataataagtaaagatacagatatagatataaggtataagctatccttagaacacctttataataataaaattaaatcacaaaaaaagtaataattacttttttttctgaataagccacggagcatttcgaactttcagtacagacttgacaccatgcgccgagccaccacctaccgtagcgtgtacagtgtatatacaaaacccaggccgtagagccggtcgtcccatagaaatcaggcccacaggaacccagaacgcatctctcgccaaacacactattccaatgaaaagtttgagtatgattcactcgtgccagatttgtgcagaatctgcagcatgttccaactgcagagctgaaattagtttgtttgtactactctgaatgggtttttttttctttttttctctagacattgtttctttgcacggtgattgcaaacgcagtcctgtagccagtcatctgtcctccttgggatcttctgtgagtgttagcaatggcccatgattagaccacttaagtaggcccgtagtattttcagacaaagaagcaggcccgtaattaaggtaccacagcccgcatttgatttgaaagcagagtcctagtttcaaatttggaattctgaaagtttcaatggatctaccgtaaaattcaggtaggattccagcgattttcaatgtttttcgtgaacgcgcaagagattttcaatgtatcttctggaattcctttcttcgtagtaaattcgatcagctcaccttctcttgttctgtgtagtgcacacagagtatttgtcgctctcgtacgagtcaaatgagacgcaggtgtcgttgcaatgcaaccctccagataagccacggagcggagtcagataatgtgccaacgactaaccgtgcattctatctgtttttttatatcattcgccttatttcaaatataaacatatatgaataaaaaagtgtaagctatgcttagaacacctttaatggcaaaattaaatcacaataaagtaagtgttaattaagtcatttttctgaataagccacggagcatttcggaaataggactttccagttcaagcatggtttagttttcaactttttctcaaacttttaacttttccatcacatcaaaatcttcctacacacataaacttccaactttttaatcacatcgttccaatttcaattaattttcaattttagcgtgaaccaaacacaccctcagacttcacacctcactaacacaatgcgccgagccactacctaccgtagcgtgtacagtgtatatacgaaacacaggccgtagatcccgtcgtcccacaggaatcaggcccacagaaaccgagcacgatccatctctcgccaaacataaaaaaccaacacactatgaaaagtttgagtatgattcactcgtgccagattcgtgcagaatctgcagcatgttccaactgcagagctgaaattagtttgttaggagtagtactttgtttcatgtaaaccactaactcatagtagtacaaaacgttctcaaggacccctgaactcgaaattttcgtctatcgtatttcacaacttttttttttgaacgagtcgtatttcacaatttgcgcttcttgaattttgctggtttggaacttttttgagagaaagtaggagtagtagttttggtcaacagtgtttgtgatccaagtccactgcaagcttggaaaccagcagcagcacctggtatcatcggtggttggtgaaactcggtcttcttagaactaagcaagaacagctcactggaacaagctcgcccacttcaaccaagcacttagcagttaacactagtaagtcactaacacacgaccagcccatgttttatcacagaaaaaaacataattaacattaaattaacctcaaacacactgtttgctctgacaccactaatagtccaccaaatttataatcctcaagaaccaagaggaaagaaaaatagcaaaatgagcttatgtcaaatggttagtttttctgtgctgaaactagttcacattttagacttgatatatgtacggttaattattttcttagtggtaagcgatgtatttgtaaatatcgacagcaagacatctgtgttcacttcatcatatcctgactcaatctttcggggtgcccataagaatagggtttatgcatgtattcataggaattggtgtgcgctcattgtgagcatctgctttagggcaggtataatagcacatactacaagatgtaatatgcgtgtgacatgtaaaaccagatattactagtgtactattccctccgaattaataatacttcgttttggacaaaggcatgatctccaaaaacaactttgaccattattttccattacaatatatattaaagtgttaacaaatatatgattttattaaaatactttgtaaaactaatatatacatgtattctaaagtttgatatcacccttgtctaaaacgacaagtgttattagtccggagagaatacatgtttacaggtaattattgtataaattggctattaagatgattgtagataatttgaaacgggtaattggctttactattaaacttgttcttatatgtttatatataataaaacaagaaaaaaaattgtagtggaaacaagaggggaaagagggggaaaaaatcagtgtggtgtggcccactcacctaccgccaacctccccccaaatccgtagctttccggcgagtataaattggccgagctcgccaccgccgctttcaccaaccacccccccccc

SEQ ID NO: 29250 - DNA, 11564 bp, Oryza sativa
gtgggcggagaggtacggcccgatcgtgtcggtgtggttcggctcgtcgctgaacgtggtggtgtcgacgtcggagctcgccaagaaggtgctcaaggagaacgaccagctgctcgccgaccggccgcgcaaccgctccacgcagcgcttcagccgcaacgggatggacctgatctgggcggactacggcccgcactacatcaaggtgcgcaagctctgcaacctcgagctcttcacccccaagcgcctcgaggccctccgccccatccgcgaggacgaggtcaccgccatggtcgagtccgtccaccgcgccgtcacccagccaggtaaagcttcaagaattttagtgttctttgtgtaattttgagcaaggagagggtgcttggtgcaaacgtggttggtatgagtttggtggttgtggcgtccttgtgtttggtgacgaattgttatgtcgtgttgactctcatgtgtcagctaaattgtgctgccttagatcagcgattgccgattggtactactagttgttttgcaggcttattggtgctcaatttgcatcgctccttgagggaaatggccaaggcgtggtctgccatttcgtaggcttcgctacgatatgctgtgcggatttggtagtggatcctagaggaaatgctagctattggtttgatctggtgggataataaactaataagaggagttgaactgcctcgagtgagtgggtgcatttctctgagatggatcacatggtgagcacgttgttagagagccaagctaagattttacttgctgaattgaaaatgtaggtaccatgaaactaggtagtgatcatactctgcccagctgtactgctgtagtgtgctgactgctgagagaccttggccctggggattattggttatgagctatggttcatgtcaagcagatatcgtaattggtatagttatagtaaagtgggcttcgtatgacttccagtatacacggggttggtaatcacatgctattttaagcttaagtgaagacagtttggtgctttctgcattattgttcattaaggcacttcacacctctctagtggacaagaattacgctattccctttttggtatataagtttgctctgttgttggcatgctattttagctcctcacatgataagtactctacttgctgtaatgtgacaccttgctagttgaaacaatactatgctgtttaagcttcttactggtatgccaagcattctcttgtgatgttatgttgtaccagtttgacagtcaaaaaaaacatgtttggcaacaaccttgtttgaactggttggaagtcttttttttttcttctaagatgtttgtacattttgatagcattggagtttttacagactaaaattaatgagctgctattatgtactttgcccatctgtctcaactgtgctgacagttgatacagcttatcagcgactcttttcaacttatttctgactttgcaaccaattttatgttccatttgtgttgctgtttcaatgtagtcctcaacattgacctagccttctctctattttccaatttagtttacaagaattaagccaggctgtttagaaaaatgaatgaatttagctttatttatactctgttggaaaaaaattttggcctacaaatgcatcctatgaatacctggtgtcaaactgtcaattgcaaatcgatccactagctgatttgtttacatgtgtacataagttagcaaagcttttttttttgttggcctaaagccatgatgggttacctcaagaaaaaagaaaaagaagtatattgtgcacgacatacaataatggaacaattacctagcacggtaagagtctatttgcattggaatgaagtttttaactaacagtcattttatcgatgtgctgttttcaggtagtgaacataaaccaatcgtagtgaggaatcaccttgctatggtggccttcaacaatataacaaggctagctttcggcaagaggttcatgaatgcaaatggtgacattgatgaacaagggcgtgagtttaagactattgtcaacaatggaatcaagatcggtgcatctctttctgttgctgagtacatttggtatttgaggtggttgtgtccacttaacgaggagctttacaagacccacaacgagagaagggatcggctgaccaagaagatcatagatgagcatgcgaaggccctcaaggagagtggtgccaagcagcactttgtggatgctctgttcactctcagagaacagtatgaccttagtgacgacacagttattgggcttctatgggtatgttggatgttcctttcatacttatcagtatctatcctttttgtcatccaatttcagatatgataccctactggactattaatatcaatgctctcccaattacttttacattatttgcacacatgttaaatatcatctctcaaagtcatggagaattttttccactctagtcagatttggtacatagtttgtgtggcatgtcactatcttagggttggtgaagtatggtggtatttggaaaagtttctgtttactttctagttggaagttaggttgtgttttatggtttcaatcatctacctactaaaaatgcgagaaagttggaaaggttagaccacttagctagtggcaactaccaaaagctttcaatggatgcctctgcatgcatttccctatcttgcatcgcacatggataatttgcatatcaagtttgttcagactaggaaatgaataccataataatggaagataaaaaacaaaatcccgataattgtcatgtgcctgaattttctgtcctgctaactccattacatttgtgagttcttaccatccctgttatgttccttgtgttcaggacatgatcactgctggaatggacaccacagtgatatcagtcgagtgggcaatggcagagctggtcaggaaccccagggtgcagaagaagctgcaggaggagctggaccgcgtcgtcggccgcgaccgcgtcatgtcggagaccgacttccagagcctcccttacctgaacgccgtcgtcaaggagtcgctccggctgcacccgccgacgccgctgatgctcccgcacaaggccagcacgaacgtcaagatcggcgggtacaacatccccaagggcgccaacgtgatggtgaacgtgtgggcgatcgccagggaccccaaggtgtggagcaacccgctggagtacaggccggagcggttcatcgaggagaacatcgacatcaagggcagcgacttcagggtgctccccttcggcgccggccgccgcgtgtgccccggcgcccagctcggcatcaacctcgtcgcctccatgatcgggcacctcctccaccagttcgagtggtctctccccgagggcaccaggccggaggacgtcaacatgatggagtccaacggcgtcgtcacgttcatgagcacgtcgctgcaggtcatcgccaagcccaggctcgacaacccggacctgtacaagaggttccctgtcgagatgtgatcgaacagtttgctttgctgcctgctgctgctggttatacagacagactggagttctgctttcaaagtttcagctattgctcatgatgttgttgttgtaaaatttgaggtgttaattgccttgtgaatgaacgaatcaatcaatctcgtaaagttatcgagagcagatcgacttttgtaatttgtacaatatgactatgtacttaaggtgttttgttcagatagaattttgtaatatgattaacacgacaagcgatgtattttgaggtgtcattaatgaataataataatgtaatgtaatctgcaatttttctttttttttctttctgttctgtttctgttgagaaacaaagaattaagataattatgatgatgataacatgacgtgggggcgaccttatcttgaggcacgtccaaaaacgtctgcggttgttacacctaaacccagataaagcaaagagcccaaaacgagcgaaggacacgagacgcgctcccagccgtcggatccatccggagcccccgaaaacggacggtggatggagacgccagccccctcacgtcacgccacccccccccccccccaccaaactaacgtggggcccacaccatctccgcttcgggggtgtgatggtgtggatggatagaaccaacggctgacgtgtacccgaacgcgcaacgcgggggagtccaagctaacgtgggccccacacccccctttcccctcctcctctctcttcagatccgcgcgctgaggtcactgtagaacacggcggtggacccggtccacgggattaagccggtgtagtgtagacccgtctgggtggggcccacaacattggtggatcggtctatgcaccgggtccacggaacgggtctcgtgtagaggctctctctctctctctctctgggtgggggttgggtttgcttcgctcgcctcgctttgcccgattcggccggggtcagggtcactggccgagcaaattagggtggaaaattttttatttatttatttccgcaaagaaaaaaaagttaaatatccagtaacggaaaccctaatccccaaatcacaaatcgattcgattcgctatttaatgtggtgtggttttcttctccgattcgatgtcctcctccgctccggccccctcatcgatcgagctcgcagccgccgtgttccccgccggggaaggtcgtccttgccgttgggtggtgttcccggcgctggattgacgccatgaggaagaagctggacacccgcttccccgcggtatggttcatatatgcgcggattttttttttcagattagaaattgttgttcaggtgtagatcctgcatgcgtgtatatagattctgcgatcgtgattggtatgtttatttttttcacttttgcctgagatgtgtttgttgcatgcacgcttgttttcggtggttaggttttgctaacaatttgatgcaatgaaattatggtgcatgtcttgcattttatctcccttgttaggcttcgcccatccacatattaggaattattttttgttgtaatttgccggttattttctatgtttgtttgcgagcatgatatatatttttattttgttttaacggtatctttagtgagataagtaatgaaattgcggttttgtgtgggtgtgattctgtatgaaactggcttattcgatacacatatccagaattctggagcctgattggtaattatgatgtgaggtagccagtgagtatttggggattcctaaatccagtactcgtacatttgtcatgtatgaggatgcctgatgtgagaaattttggtttaatttgctgcttatttgcataatttgtaataatagactctgttccatgtggtcccacctccaactgtgatcattaaataaggttatgctcctgagcttcatgggaaaaattagttgcccatatgcattaacattttactaaataatacattatcatgatttgttcaataatacgtcagtctaatcatcactattaatagtaaagaaacgtcaatgtgtgttttacagttctaatgctagtacggaccaccaatcatgtacctcttgatccgaattagatgcttagatccatatatttgatgtaatgtgcatttttccttgcatggatgttccctcattttgttaaagacacatggagtccttaaatagaataaaagtgcactatttatccttttggcctctgcactgtagcaaaatggtatcatgtagaattctactacttgctgcgggtctgctgtacaacaagttgtagctaaatccttatatgcttaaagccatgcattctgaggagatgctttcttaattaacctttgctcttacaaggacatgcagaatcatttctttatatatgttagggctaatgcttataatctcatttaacatgcccttaaggttgacatggtcggagctctttagtatatgttagttgtaattataaaaattgcatgaatcagattcttttattgttaccagtgctctttcagacaatattcttattttgtttgatgtctgtcatgtgttgcagcctcggattaagaaaatcatgcaagcagatgaagatgttggcaagattgctttagctgtacctgttctagtgtgtgagttttccactctgtttaatcttccttttattttattatatagctatttaactctcagtaacttattagtattcggtttagaggctcataattattttcgctacaaactgcactcctttctgccactaagagttaagtagcttatattttagaggccaaaacatatgagccttggagtctatgtaacaggaaatcatgttctgaatgataatcgatcttttcggtttctagattacaaatcatactgcctgcaaagcattattgattgtattagggaagacatagatcaaagctggcaattattgttgattaagggggaggggggcaggcttactaccaaagtatgttaggtcttactttgggctgttgtaatattgaaatcaagtgcatttgtacatgtactgtagacttactccctgtgtcattcacaccatccttaatcatgtaagcccattctccttcaaatttcacattgcatgtcaggtgcactatcaccaccacatctttattttggattcatctctagcgacctagtctacatctctgccatattagaatcaaccgatcctgtatgagcctgcatggccatgttttctttattcccctgatatccacctcgcttttttttttttgcgtgagtcatggtggcagaagttggggagcaatggggttggcattgttggttggataggaagagcagtcagatatgatgggggttgaatttggtgagggtgaggggaactagagaagggagattttggagaagagtgtaggagcgggagaaccggtgtccacatggtgcagcactaaagaacattgaatcaagtggatatattacagacaatttggctttatggcacggtatggattaagtaaaaacatttggatgtgagcccatatttagctttcctggaggaagataaaaaggtaaatgagtgaatgtaaaaaaggataaaatagctccatgcaaaataatatcattgcaaggtatagatttaatttatttgtttgcacttgggtgctttcttttctcttctgctagcatgcttctttgttttcttcgattgatatatctctaacgttggcataagattggcaccatccatagctaagcatattctgcactttgacacgttggcaagcatattttccgtttccatctgatttgatttaacttattatgatttgttttattaatgtatgatgtgatctttcaggctttcactttacatatatttcattattgtccattgttgcagcaaaagcattggaattatttctgcaagacttgtgtaataggacatatgacattacagtgcaaagaggggtcaagactctgagttcttcccatttgtaagttttgttgacctttccatgttttttttttctgagtcaatggagctataggtggaatctaacgactctttattaggatgcctgagaacctttttttccttgtcattaggtttttgttaatcataggttgttctttcaagctatctactcgtcatgctcttttgcaagtttctgagttgtgtgctgttgtcataatctgttcctgtaccttgatcctagaatgcatttttaagcatgtgttgttgtcagatcatgaaatccagtattttgcctcctttttttcaggaaacagtgcatacatagttataatgtttacgatttcttgagggatgtcgtcagtaaagttccagacatgggtacatctgatgctggtgttgatgataaacttggcaaaaggaggtaaaaaccttttcatttaatagtgtctgatgttcaaatcaatttttattcagcaagctttaatgagtgctgaaattcatcaggaaaactgctgaagatgacagtgaagaggaatcaaagcggacaagaaatgttagtttctccattatctttacctttatgtggatgttgcacatttcacaatttctgtcccttttgcattcttagtattagtatttgtatcagcacttgaaagaattctttactccagtcattccgttcatacataattaaaacgttcacctttgattttcatctcatttgctaataaggttgtatgcatgcaggaggcagcaagccagacaagcactggtagagggcgtgggaggggtcggggaagaggccgacgtggtgggcgtgtgtctgagagggagattatttccgcttacgaaaaatttgaggagaaccatgagtttcctccaggtcaatttagcaagccttctcagctgaaggtagatgtttcagttgatggtacagatgcaattgaaacaaaggaggctaccccattaagcaacgcaagagcttctctaaggaacattgacttaaacatagagcttactgactatgatgatgagggttcagctccactggaggtccagcctccagctccggcagcaggtgtggttacaacctcttcaggaccacttgtttcggaggtgaacgaagaggcgaagaccaaagactttctaggatggcaattgcctgagctgaccaagatggccatggaccctgttcagtttgccttgtcttcaaaccataggttagaggaggatgaggattatgacaacgaagaatgataacttgccccttttaggttaagaagctgatagatagacatgacttttgtctattgtacatccttgtagcccagcttaactctgtagctgatcttgtataatatgtgtacctgctgaagctgcagtagtttaggatgttacagaggtttatcgatcgatagctagcaactatgttgacagacagattcatcagttgtacatcctatctgatctccagtttatgatagtttgcaatgttcctgtctgtttgtccattgctgtattccctgtgcctactttctcagggtgctgaattttactgaaacagtgagctgcagggctgttgcagccaagactgtttccttctcccaaaggagagtgatacaggtatgatgaaattgtgaaaagtgaaagtgaaaacttattacaatttacaagcaaagcttggccatggccaagaacacaaggagactgcgaaaatgttgtgtattgcactaggaaatacagaagtgatatgtctattatgacccggcaaagcagcaggttttattcatcatattacaccttccagcaagaccagtaacatgttctagtagcagataattggatcactggatggctctgctttaagccgatgattcagcagccggacgatgatctatgtacctgaaattatcagcacctaaattatcagcctcctgccaatgatgacgaaccatttgcaattcgcaaagcacaaagcgcggcgattcattcaagaaacgatcaacgaaagagaggtttgaatttgatgttttacgtttaggcggtggcgtcgtcgaggggcttgaaatcctggagctgcttgaagttctcccacgccctctcccacaccttggcctcgtacagcttattggcgccgccgggttccttcacctcgacggtgaggtagtgcatgaacccgcccaccacctgctgcctcaccttcaccaccctctccaactccaacatcgcgttctgcaattagcttagggggtgcttaggttaagggtgtaaaattttagcatatcacatcaagtattatgtaaggtatcgcatgaggtgttcgggcactaaaaaaaactaattataaaatacgtcagtaaaccagaatttattaagcctaattaatcagtcattagtagatatttacggtcacatggacgaatcatgaagcaattagacttaaaagattcgtctcataaattaatcgcaatctatataattaattattcttttagcctatatttaatactttatatttaatactttattgtaaaatttttacgtggaaactaaacatgcccttattgtattttatatttttaccacaatccacacggcgatccacgcaatttacaaggggaaaaaagaaaggggggcgggtgttcttaaatcttacggccttgctgttgtgctcggcgacggcgaaccgggcgagctcgacggtggtgaggtcgttctcgcgcccggccggcgcgtcgtggatgccgcccaccttcacgccgcgtggctgctgcgcctcctcggccatcgccggcgagccgcgaccggtggagaagaagagggtaacgggaacggcggcgagacgaggacaacgacgacgaccagcagcagcagatgtagtgaacaccgattccgcgaagagagatgatgcccgcatagattgaagcggacgacgggggaagcgggcgatttttatagcgaagcgggaggatttcttttcttttcttcttcgcgttgatttgctcgtgtcgtttcggcgacgatgcgattgcgatcagcgatcgcgacagccacgggaggcaagtgtgatgcgtttctatgcttagcatggaaggcagcgatgaagacgaagtaatgacgcggggcgctatcggtacgtggaagacgggaaggagagtcccgcttcctctatgggcctgcggccctgcgccaatacgcccataaaccattattgctaaaaaaaaagtctacttgcctccctcaaatctgattcatatcctttgatcacaaatgggtataacaacccatccaacggttaaaatgggtataaaatgacgactaggcaaaggtgatattggctgacatggcagtccagtcatcacatttttcctcctccctcccccctcctctctcctccatatttcctctcggttatgacatctcagtagggcagtggcagggaagcagcagggtgacgactggacagcgagcttcggcggtgaacatggccaagttagcatgtcaaaatgcattccaagaggaggggaacttgttgatagaggtagagtaggagtggctggtagtgttggccatgacggctatcatagcggcgtgtaggaagaacaagatgggggaaaaccttctggagcgtgcaagtgcatgcagacagttcaacgacaatcacgggtcgccctatcccctccttcacaaatgtggggtggccgccggcgagctgcagttccatcgacccgtcatcgtcgtcgcttctagatctcgcctttattagttgtggaggagggatcatggagtatacatgggtcggtgtggtacgcccctctcctctatgtgctcgtaccccctggccgtcgagccacttcctcgcaacagtggcggccttggcgacaggcaccccaatgcctccatgccgagagcttgggggtgaggccctgcaggctggttcacatgacagcggtgaagattcgtccatcgccagcgaccggagggccttaaggaggcaatagtaggggcgtgtcgttgctgctctgcctcaaggccacgctagttgcccactcgttgagctctcggcatctaccac

SEQ ID NO: 29251 - DNA, 461 bp, Oryza sativa
  unsure (1)..(461): unsure at all n locations
gtcgactctagaggatccccgtccttagaagaattatacatcaaagagtgcccatttctggcagagaggtgtcaagaaaacagtggagaagattggcctaaaatatctcatatagccatcatagagattgacgatgatagtgccatgccagataggagcataaggagaagattatgctaaaagcttcttagcaactcaacaaaaagggtatgaattaattgccttctctagtttcttttgtctaaatataatagataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29252 - DNA, 497 bp, Oryza sativa
tcttcactgtcatcttcagcagttttcctgatgaatttcagcactcattaaagcttgctgaataaaaattgatttgaacatcagacactattaaatgaaaaggtttttacctccttttgccaagtttatcatcaacaccagcatcagatgtacccatgtctggaactttactgacgacatccctcaagaaatcgtaaacattataactatgtatgcactgtttcctgaaaaaaaggaggcaaaatactggatttcatgatctgacaacaacacatgcttaaaaatgcattctaggatcaaggtacaggaacagattatgacaacagcacacaactcagaaacttgcaaaagagcatgacgagtagatagcttgaaagaacaacctatgattaacaaaaacctaatgacaaggaaaaaaaggttctcaggcatctaataaagagtcgttagattccaactatagcttcattgactcagaaaaaaaaaacatggaaagg

SEQ ID NO: 29253 - DNA, 493 bp, Oryza sativa
  unsure (1)..(493): unsure at all n locations
acttttttcaaacaaactattattgtgtttttcccctttttaattctaatataaaacttccactttaaaatttactctaccaattatttaaactttcaacttatatttgaaaactttgaattcaacttttaaaactttcagttcaaaatttaaagctttaaactcatatttgaaaactttcaactcacttccaacttatttttgactcaaagaaaagttctggtgggtcagcatgagaagggaaatagctgagttcgtagcactctgtgacgtctgtcaacgagtaaaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 29254 - DNA, 555 bp, Oryza sativa
gtaagacagctgatgtgtaagtttatcacattcttcctcctgtgatagtcaaccatctaccttataattcgccaactcattttactgatcatcatcattggacaaatccaacgcccctcatcgctccgtcctcatcaaacggtccaaactcatccacgcgctcaccctctctccccgtaatttccgctgcccccttccccaatccccacagcgcgtaactcccgtcgtccccctatctcgcaattctaaaaaaaaaaaaaaatcgcccctcaacctcccgtcgtcagctcgtccacccgcccgcgccgatctctcccgtcagcgtctctgtcgacgccgtcgccctccaagacgatctcctctgcaccgccagaactccgtcgcctccctcgccgaactgctccgcccataagctgctgcctcctccatcaacgtgatgccgcctcaagcgccaccggtgccaacccatatcccctcctccacgaagaaaccctcctcccccacccctcccccttttctgtctccccatccctaatatgtttcctaatatttcag

SEQ ID NO: 29255 - DNA, 6567 bp, Oryza sativa
  unsure (1)..(6567): unsure at all n locations
nnnnnnnnnnnnnnnnnnnnnnnnnnnnnnnnnnnnnnnnnnnnnnnnnnnnnnnnaaccaccatcaaacaggattttcgcctgctggggcaaaccagcgtgcaccgcttgctgcaactctctcagggccaggcggtgaagggcaatcagctgttgcccgtctcactggtgaaaagaaaaaccaccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattcgagctcggtacccacactatagaatactcaagcttcggcgaccagatggggaacgcgaggtacgtggagcacgtgtggaaggccgggttcgaggtggtcggcggcgagctcgagaggggggcggtggaggaggccatccggcggctcatggcggagagcgacggcggcgagatgagggcgcgggcgcgcgagctgaagaaggcggcggcggagtgcaccggcaaggccggctcgtcggagacggccatcgtcaaaatggtcactcacatgctgtccctgtaatttagagtagtactccctcaatttcacaatgcaaaactttctagcattgtccacatacatttcacaatgcaagactttctagcatcgtccacatacatatagttgttaatgaatctaaacacatacatatatctagatttattaacatctaaataaatatggacaatgctagaaagtcttacattgtgaaacagaggaaattaagctacaagttgctttcatttgcttaattattgctgcagcagacgataacttacgaagggatcaaaggttatcatgtgcttggatgcttgacatactgtgggctgcttgatcgccagaacaaaccgtacaactagaaattaagttcaaggctatcatgtgactggcaaattgcatgttacagaatctaacgccataacaaagaatacacaggctgatgcacttcaagtcataagagaattcctagttgctaatttaaacatgactaccaagttgctaatgtaaacatgactaccaaattcctacgtagtagttgttttggcagttcaagatagcacaatatccctaattctctatgagtgcattgaatcatgggaatcaagaacagatggttgcagcaggatcaatccgaagtttgctacaccatttcagcatctgcttgcaggcatccagatcagtggaatcaccaaagatgccccctttgtattccaggagataatgagcacgctcacagtgaaaatcgatctgctttagctcgcgtttttctagagtgagctccgaaggttggagctgtttatccaagcacagatggaccaaggcataagctgttaccgaatcgattccctgcttattgcaaataccattaacatattaaccatttgccaaagcatgaaaaagctgagattatccaaatcattctggagtgatcatataaacacctttttatccatacttgttgactgataagagcgtgatctttctttcattgagaaaagaattttctttttgaatgataagagcgtgatctttctttcattgagaaaagatttttctttttcaagaggggaaagaacgacaaaacctgatttaacgaaatacaggagttactcacctttgttgtcaggaaatgcgcaaacctcataatatcatcatagcctctggggaggcaattttgggccttttccatatcaaacgagatgcttttaacaagttgtatagataggtcgagaatttcaaccactgatttagtgctagaaaataaatggtgcttagcatcctatcaaggaaaacgcactttgttagaaccaaaaactataccatgacgcactgtaagaaagaatataggaccatttttacctcgatttcacaagtctgcactgatccgcatgcttttccaaatctaagatttagacattttgagatagcaacatctccatgacgcctcatctgttcgatagaactcaactttcctagggttgtctcatatatggctgtttcagcgtttctcagggacaaaaccttctcaagcagttgccttagaaggttgggaatacgataattgattgaatttgcaaaccaggcaatgtaagaaagcttggaaagtgtgtaatcttcaggagaactgcatcatttagatggggaaaaaaacttagcatttatcagacttacggggcaagatatattgaagtatttcaggttatccttcccaaaaattttaaagcaaaactgctaaccgaaaaatggaccattctgccactttctgaaaaatagtcatgatgacttgctatttgttaaactaggtgaaaccccgcccattgctgcgggaatttagtatgaagatatacattgaaacattatgtgaattatgttggatgataatttaacatgtttatgtttgaaaagctcttaaattataaaaactataaagatatagcatgtttgcatgatgtttaaatgtgatgattgttagtggatgatgatgtggtatcttgttaattagtggatgatgatgtggcatctttgcatgaagatatacattgaaacattatgtgaattatgttgaatgataatttaacatgtttgtatttgaaaagctcttaaatcataaaaactataaagatatagcatgtttgcatgatgtttaaatgtgatgattgttagtggataatgatgtgacatcttgttaattaatggatgatgatgtggcatcttgttagtggataatgatgtgacatctttgcatgttaagcttaaggagttagtggggataactttatagtaagatattccctctgtttcatattgtaagactttctagcattgcttatatacatatagatgttaatgaatttaaacacatactatgtctagattcattaacatctaaatgaatatgggcaatgatagaaagtcttacactgtgaaacggaggaagtaggatttaggtgtaacttcttagctttcacttagcaataaaatgttgaattaaaagtatggagaatttaacaccagaaaaaggactataacaagtattctgtgactagctagtataacaattaaacaaagcttgggtatcatttctttgtttatacacacaatattatgcaagataaaattggctcaatcaaaagcgtatacaagtacatattcaaaatacaaaaacacattccgttttacacaaatagtcaataagccaagagaaaaatacagaagagggtggagacatggagggctagatgatcaggagattgagggtgaaaaaaaaactaaaaatagtggacaagtatcagcaaaaacctgagcctcataaatatgacaccatcggtagagcaaatgcctccaagacagttacgaagttttgaagcatcactgtctagctgtataattaaaaggacagaaaactggtattagatacagcacaaggcaatgggtaatgtaatattatatggatagtaaaccattaagcaaatacagatttattgtgatatggctggctatgttcataagtatgttttggttcagtggtagaatatagaaaattaccgctttgacaatgcgcataagaagactggtgccctcaatttctttctcaccaggaagaacaaacccatcattttttattgctaacaaaacgagagcagcctgcaacagagaattttcatgcaactttaactgaaccacatactacgaattaatgtatgctagaattaacaataatccgatgttaaagagtgaacaaaggaaaagggtcataattaaacaatgaaatgcttgagtatatatcttcccgaacaacacaatataccatcaaaactataaaaaatgctgaatagtaagaatatatcttgagaacttacaaaaaaaaagcagaaaaggaacctgaagttgtttcaattgagtcataatatgatcaatggagttcttggaccatgtttccagtatcatgaggcaactgtcacatttgctttctacggcaagaccctttgcttggtccccaatcatatcagcaagtgcttccacaatacttgtatgaacatctgcaccatctctccacttgaactttccaatctcaatgtcatcttctatcctttcaagagcatggataattttatttctttcactggaagatataataccctacaccattggatgttttttataagaaatttcatatagagatttttttatctagaagtctggtttcatatagaaaaatttcatataacggcattagttgcagttgatttcatttagttttatctgaggggatgtcgagatgtttttatctaggttcctggtttgttcgccgccatgttatagtatttctctcttcttaacggaagtgcttttgtttgctctttagagaaaatgtagtaaataaccctaaactagaacatacaggacgcagttttggcaaattgtcataaatccttgatgaatactaaaatattagcttgaaggataaggtatgaagatgctggattcaaaggcaactggtgttaagatatgtaatggttgactgaacaggatattctcgaaaggaagtatgagtgattgaacatggtgagaatacctcgttcataattccatctgcattgaccttgcaacccaaaattgcatacttgtatagtgttttgtcaaacacaatggaatcaacaaagctctcgtcaaaatttgtgtccaaggctctgatgtatctgttgttcattgcgttccgaagttgcatccaccccttatgctcctgatctttagagctagaattattagtgcatatatataactagaaaaaagtatcctaatttccctttatatgggcaaaaacaattaagggcatgttcactttgatgccaaaataaaccttaccaaattaaattttgacatagttgccaaaattttgataacttgccaaaattttagcagaatttcttatatagttactaaaatttggcaacaaactaaatgtagccaattttttggcaacttcaccaaaacttggtaaggttgaaaataacattaaagtgaacaagccctaaacctatatacaggacagatctaccgtactgttgtcagtcaagatcaatcaaagaagaagtcattactgtaccttgaaacatgattagcaatataatgacaagataattaatccgtactcaagaacattccgaacaggctataccatggtctagcaccagtaagcctgtcctcatctaagatagacctcaacttgacatcttttgatctgctgctgagaaagagatgatgctgctggggcttatggccaagaggaatggaagggcacggtggccggagaggttgatagtagcagcacgccctcattacggtcgaactgtcaacaaacaggtcatcaaaattgaacaatctcgagttgcaattcaagaacaatctcaggtttcacttcaatctcagtatgtatgtagatctagtagctactagcaagcatggcggaattaaagaagatactacctttggtaccacgccgcggcggcggcggcggaagacgagagatcgccggcgcggccgcttccaattcacctaaaccgcttctatttcggttcggtttggttggtggtctcctccgtttcgtgcagtatctataaatactgccgtgaccaaccaacctaggattcgcatcgattcatctccaggaaaatagcaaggggtagataagatcatgatcatatatatccgtctctcgtttacttgggaacaaaatcagtcgggctgatttctaaacaaatttgagcgaatttacgcgagacagggggagatcataacttatttaggaacaaaatcaaccggctgatttctagacgaaattgagcaggtttaataagcaagacaggtgaaaaagatcaagccatagttaagacaagatagctgctgcaaagttcacaagatagcccataggcgttacatggtagtagtagcaggtagtactagtactagatagataacatagtagtagtagtagcagcagcagaagcatcttaagctagattaggtgtaatgcgcgccaaaaacacttaaaagaactagtactactcttgactgagccctaattgccttccagttggttaagaacttgctgacagctacgcctttccatcatcaccatcgtccccttcctctgcctcatcctgctcatctgtgacgctcatgaaatcctttgcttcatccatcgcgtactccagggtgcgcatcatggacgcaatgagggactatcatcacaatcaaagcaaatttgcgcacttgttagtaaggtaattagtgaattcataaagaaaaaagttcgtttcaaaaaaaaagaattcataaagaaaatttgctccaccaccaagcaaaagttaattaatggatca

SEQ ID NO: 29256 - DNA, 61319 bp, Oryza sativa
tccagcagacgggccgtcatctaagcctgattactatcttgatgagcttcctcttcaatttgtttcacggaggtatggatggccataaggcccgaggcccggaccacggcccggcccaagcacggtacggcccgacttgggttgggcccgtgcctggacctccccaccggtacgctgggctgactcggcacgatgggccggcaggccaggcccggtacacaaagtatagggactaaaaatagacatattaatgtcacggtccaaaatatagggcctaaaaatagacttattcagcaatttatatgtcagctcaaagaagaggggggaatagacttttttttagctatatatatgtcacagcccaagaggagggagaaaaattagatttattctgtggaaaagcacgatgggccgtcgtgcctttgggccggcccggcacggcccgagccatcttgggccgtgcctgggccgtgtgtatggcccgtgggctggcacggcacggcccggtgtgtaggtcgggctgtgccggcccgactaccctcggcccaggcacggccgggcctgggccgtgccgcccgttgtaacctctgcctttataggtttttaatcaagctgtgattttatagttaatttcaatttttgcaatttgtagctattttctctgttatctctctaaaaactgatcaagctatattatttggaaaatgcaagcgatcgggtgcccaatcagcggcaaaaaagtcgggtgcccgccgcctcccacgttgtccccccccccccttccacgcgccccaccacacgcgtgttgcaacaaagcacccgtatattgcgaaaacatttctattaaggaaatccgttttattttttttgttccaccaacaatgttttagtaaagtatactcgtgatgttttactatgtatggatcaaatgttgcagtgaattaaaacattcgttcactatttgttgaaacattgtttttatatagggtgaaatgacgcccatttttttttaaaactgttgtttcatacgttatagaaaaatgtttcacgaggtgatttggttgtgtttcagctttttaaaaatagtacatgttgtagcaacctcatctttttgtttatgcttatcagctaaaatttgaatttttcaaccttaaatttgtagttgattttgggttttttttcatcgaagtttattttttagcctttgcttttagatcgctaagaatatgtatataaaagtttttcacagattatttttaaattccacgaataagcgaaatgatggggcgcagagattttaagttacttttgtgcacttaattattgctgtattggatgatcttcacagggatcaagattatcatgtgactggcaacttgcacattcataatctaatgccataacaacgaatacaggttcatgcactttcaagtccattagactataataggaccctaactcaatcttgatatatgagaatacatttgctaattaaacgtgatgactaccaaattcgttgctaattaaacatgagttcgagatagcacaatatccctaattctctattgagtgcattgaatcgtgggaatcaagaagagatggtcgcagcaggatcaatgcgaagtttgcaacaccatttcagcatcttcttgcaggcatccagatcggtggaatcaccaaagatgctccctttgtattccaggaggtaatgagcacgctcacagtgaaaatcgatctgctttagctcgtgtttgtctagaatgagctccgaaggttggagctttttatccaagcacagatggaccaaggcataagctgtgcccaaatcgattccctgctcattgcaaataccattaacatattaaccatttgctagagcatggaaaggctgagactaatacgttattattcctccaaatcataatggagtactcatgtttagctttcttttgtgagaaagaatgataagcctgattcaaatgaactcgagctaattaaggcatacggcaaaaataaaatgaaataccggagttacctataaaaaaaaaagcaaaactctcaccttcgttgtcaggaaatgtgtaaacctcataacatcatgatatcctcttgggagggaattttgggccttttccatgccaaacaagatccttagaacaagttgtatggatagatcgagaatttcgaccacagatttagtgctagaaaataaatagtgcttagcgtcctatcccaagaaaacacactttgttagaaccaatctataccatgatgtaggatgacacgctttacgaatatgctaatttaagatcatttttacccggcaaaaatttaagatcatttttacctcgatttcacatgtctgaggtgattcacgtacatttcgaaatccaatatttagacattttgagatagcaacatctccatgatgccttgtctgttcaatggaaccaaacttggataggactgtgtcatatatcgttgtttcaccatttggtgtgagtaacagtatattcctcctggacaaaaccttctcaagcagttgccttagatggttggggatgcaattgttgattgattctgcaaacgaggccatggaagaaagcttggaaaacatctgattttctggatagctgcatagtttagatggtaaaagatgagcaaaaaaattatagggctcatggggtattagaagtatttaaaaaaataggttttcctttttaaaaattttaaagcaaacattacgaaccaaacaatgtgacattttccctctttttagaaattagtcatgatgacttgctatatattaaaatttagaagtgcgtaacttcttagattgcacttggcgggcaagtttatgaagcataacaagcacaacatagttaaatatttataacacctagaaatagttgcgtttcaaaaacccctagaatagtcaaagttcctatgaagtaacatcggattaaaagtggagaacgcaacaccaaaaaaaaggacgattactaccattagtataataataactagcatggtagcctgcatgcagattgcgtggcaagcatccatatattttctatcataaaatagtatatattttttaattaaaatatattaaaatgacaacataattttaaattttgtactaactttaccaaactaccaatatgtagtattcatatttcgtatatacatgatagttattaattatttttaatatcggattttagttatttctaaattgtactcctatatactctaacctgtacttttaatttttcttatttttaatttctaattttcattagttccaaactgtatgttggtattgactctagtctcctcttccaatattccttatatttttagttttgaatttttagctattttaaattgtaggagtatttgtatatgtattacgtttttctttttctccgattaatatgagaatttctaggtcgcgagagctaacgtggaggcttatttttctattactttagtaaattaatagatagattaatctcccatcaaaaagtgcaataattaatcaagcctatgatatcatttctttgtttagagacacatatatggaagataaaattggctcaatcaaaagagtatagaagtacatattaaaaatacagaactatgcccctgttcacataaataattaatagaagcaagtgaacaaaatattgaagagggtgggagagctggagatgtaaattgggggcgtaaaaatgataaactagtagcagcaaaaacctggtcctcagaagcatgacaccatcatttgagcaagaaatgcttccatgataggaacgaagtttggaagcatcatagtctagctatataatgaaaagggcagaaaactggtttagatacaatacaaggcgaaatgggcaataaataggtaatgaaatatttatgtgagcagcaaacacagattcattgtgatatggcctgttatgttaagaagtacattcggttgcacattcccatctctatggttttggtgcagtcccaagactcccaaataagtaagtattgttattatgttcatctacgtaccagacagttttaagcttctttgatgaaatgatacgcaattctcttgcgtgtttgagaaaagaaaaggttctatgctgccaaggatacttgagtccatgttggaaaattaccactttgacaatgcgcagaagaagactctccaggcatgtggtgccctcaatctctctctcaccaaggataaccccatcattttttattgctaacagaactagagcaacctgcaacagaaaatcatcatacagctttaattgaaccacatactacgaatgtatgctaaaactaacatgaatctaatatagcgagtgaacaaaggaaaaagggtcataattaaacaatcaagtgcatatatatcttcccaaacaacgttttagagtataccatgaaactaaaaagataaaagaaaacaaacctgaagttgtttcaattgagtcataatatgatcaatggagtttttggaccatgtttccagtatcatgaggcaactatcatatttactttccactgcaagatccttcgctttgtccccaatcatatcagcaagtgcttccacaatgcttgtatgaatatcagcgccatctctccacttgaactttccaatctcaatgtcaccttctatcctttcaagagcatggataattttatttctttcactggcagatataacaccctacaacaacagatgttttcgtaagatatctcatatataaaaggcctattgacgagactatatagaggtatactaatatattgatcttccatggttgaggggcattattttatctacgcggttgtcaaaacatcgttatttagggtttcaaaaaaaaaacatcgttatttaagtgcttggtttgttcaccaccatggtatgtcatttctcttcttcttaacgaagaaacttgtgttttgtttgctcttgagagaaatttatagcaacgggccctaaactagcacatccaggaagcaattttggcaaattatcataaatcgttggtcaatactaaatcattaggcatgaagacagtggcatctggtgtaaataaatttaatgggtgactaaacagtatattttcggaagggagaagtatgagtgattgcacatgctgagaatacctgattcataatcccatccgcattgaccttgcaacccaaaattgcatacttgtagagtgttttgtcaaacacaatggaatcagcaaacctatcgtcaaaacttatgtccacggctttgttgtatctgctgttcatttcactccgaaattgcatccaccccttatgctcctgatcctcagaattagaattagtaaagatgcgcaagtagaaaaatgtaccctaattaccctatatatggccaaaaacaaattaaacctgtatacagtagagatctcccgtgttgttgtcaatcatgatcaattaatctttttttttaaaaaaaaaagggaagtctttgctttagcttgaaacatgagtattgagttattgacaagaaaactgacagtaacaatataatgaaaatgaaatttgcactcaagaatcaagaagatggttaagaacacttaagtttgtaaaggagaaaacaaattctattaccttcttctcaaaagcttcggcaggggaatcctcacagatgtcccagacagattcagggaagtgatcataaagatcagaaaaggacattccgaacaggctaaaccatggtctaacaccagtaacactgtcctcatgtaagatagccctcaacttcacatcttttgatctactgctgctgctggtcagcccggccgccttagatgcaacatgcagactctgatggctgctgcgaaagagaggttgccgctgtgccttttggccgcaaggaacggaagggcacggcggcggccggaggggttggtagtagtagcacgcccccattacccgtcacctgtcagccatgaacattgaacaaatctcatcaagtttcagttcgatctgtgtagatcgtgaagcggtagctagcaagcagggctgaattgaagcagataccttgggtgcgacgcgacggcgatggcgacggaagacgagggagcgccggttcaatttcacctcggtttggtttggtttggtttggtttggtttggtctcctccgtttcgtgcgtgccctatctataaataccatcgttgccgtgccctaactatcatcgtgggatctaggattcgcttcgattcgtctccaggaaaatagcttagagataagatcatctgtctctcgtatttaggaaaagaatcagttgggctgatttcttctaaacgaaatcgagcaaatttaagcaaagccacagagaaagaagatcaagatttaacaaaagggaatgaactattacttactaaaaagaagcagctgttgcaaagttcacatgatgttatttgataaccatcggcggatagcacgttactacatgatagtagcagtaggacttaattaggaatactaaacagcatggtaaggttccaaaacatcagaagaactaaatgctacttctccgtacttaggatgattactactgctgactgagttctaatgacctcccaaaaagtactccttcctcctttctgctgactgagtaacatctacgctttccctccttcctcttcaggaggtggaggagacctcccctctgcatctgcttgctcgagaggaacccccttctccgtggtggcgatgaacttggtgactgcttcaattgcccggtacagagagcacgtcagctgggcaacgagggtctatcacaattcacaagcaaaagcgatcgatcaatgcacacagacagtcggtcagtaagttaatccatacatgtaatgtagtaatgctcaaccaacaacaaaagctactactacaacagatcgatcatcgatcagtgtccttactctgtcagaccagttggttggtagctcggaggtcccaatgaggaacaagtcgaggaggtgggtgtcgatctgtcctccgggcgggacgacgaccggcggcgcctgtccctcgtcgacgtcgtcccggccggcgccgccgtaggcggagagaaccacggtcagcttgtcatggcagccgacgagcatgcggaccgcgtcgtggcccgcgatctcctccccggccacgaacgaatccaggaaacgggcgcactcctcttgcaggctcgacacctgcagagacatgtcggcgcagttggaattcgcctgaactctcctcaagaaaacggccgtcaccacggccatcctgaaggcgatcttgaccagcttcgtctgcaatttgccgcaaacagagaccaaattagccatcaaaactattattactagtttcaaagcaaccagaaaactgaagcttccgtttcagaaagggaaaaaaactgaagcttcaacagtaacaaaagcagtagcttggaaattaataagagatttggtgcatcagaagatcgaataggacgtcacaaacaaaatcctaaaaaatatctcacaagaacaactggaatccgttgtatttctaatttcttctctgaaaaaaaaaaggaaccacagcttcggtaaaaagagaaggaaatctgcaagcttcgcagcaaacgaaaggcccaaatatcgatgaacaggagcaaagaaaacaacatacatgcacgacttggtgcaagaaccatacacttgcagaaacaaaaagaaagatccccaagaaacacacctccttgaatctggtgcgtgcagggacgctacgcggacgagcaaagctgaaaatagaaatactccaaaagaacacacctgcttctgcttttcagaccgactttgcacaggcaaaacttgcaaggaaaaataaggacggaggtgatggatcgtcgataaacaggtcaaaattaaacgagcagatctgagtctgaccggtggtaagtacgtgtacgtgcaagaaatcaactgatcaaagattcctgcgtgataggcaagagaagaggaatagaggagcgaagcaaacaacgtgcgtacgtcgtacatgcacgatttggtgcaagaacgcaacacgagcaagcagaaacgagaaacaagagcatagcaaagcacgatctcgtgcaagaacgcaaacaggggcaaacaaaacaatgtcatgcgcacggtacgtctgatgtacgttctgatgcaagaacgcaacacgcacaagcagaaacgagaaagaaccccaagaatcgcacctgcttaacgcctgagcccaagaaacacacacttggtccgatctgacgcagcaaacgcatcatgcacagggagaaacaagaaagaaccccaagaaacgcacctgctcaacgcctgaacccaagaaacacatacttggttcgatctggctcaggaacgcgtcatgcacagggagaaacaagaaagaaccccaagaaacgcacctgcttaacgcctgaacccaagaaacaaatacttggttcgatctgacgcaggaaacgcgcgacagccgacatgcacaacagcacaagcagaacacaagaaaagacacgaaaagaacacgcttcgactacttcatagaccgtctttgtgcaggcgaaaacctgtaaagaaggaggaggggaaaggaggagatccatacatgcacgtacgtcgtcgtcgtcgtcgtcggaaggcttgccaaggaccggacccgtcttgccgccaccgcggccgacgcagcggaccgccatcgacgtcgtcgccggacgcctcgcgccgcaggctacctgcacgacctgcacccggctgccggcgggcacgtcggcccacgccgccgccgacgagccgaccaccaccaggagaacgggagccattctaacctaagccttctctctctctctctcgttctctggagaagtggctctagctattgcgtccttgcacgaagaagaggaggggagcgttgcatgatatacacgagatcgacgtcgtagcagcgcaaacccctctctctacttttgcgttgcattggctggtcatcccactgacgagcaacagctcgtacgtggtggagcccacacaccagtcacatacacgcagcgtcgttcaaacgtaaaagaaaacaaaacagaaacatgtgggcttcttcttcttctttttcttctttttcaccgcgcagttgccaaacaggtgttctttctcaccgcgcggcgcggttgcgcagcctttgccctccagcttctatttccagtcacgcgacgacaaaaatggtagcaggcgatgccgatgcagtgcacagtacgaactactcgatcagcgaccactaccattctaccaaccctttctccttttctttgagatagagagagagagcggcgatcaacagttcatcaccaacttactctgcaaggcaacccatgacggtcaaaccatggttattgggcctcttctcgtgtaccgcgggggcccgttactactggcctgcaaccgagcaggctaagtgcccgccggcccattatgcctccggttcactttcttgctcgctatttggccctgatcatcaccgagccgtcatgtctagctcgcttcttaatttcttccttccgtttttttcgatttttctagatcagcacatgtctcgcagtatcatttgatgtaccactcactcatcacctgttaatccactaggtgtgagccagatacatagtaattgacaagtcgagttcaaagaaacacacaggtgtctgggattaccgattatacataccaaggtgcttttcgcccttattatatcaccaaaaacgccaaaaaactgaggtggatgagagcaacgcagataaaaatgtcatcatctagccatcaagccatggcccatgggcatgtgcagtagtattagtataccatttcgatgcttgatcgacactagtagaacgccgaggtaggataggaaggactggactgcttcgtactgcatcctgcgccagccgcaggtcgatcgaaaagtggaggtgtgggggacgaacgaacgaccgaaggcgatatgcgaggcgacacgacacgacagcatgtggccgtggggacgacgctgcacacgttctgctgccgccgtgccccccgcgcccgcgacgccacggggacaccgcgctttcccctgcctccctctcctttctgcctctccctctcctcctttctactaccccttgctatacatgctactatgcagctactgatgtttgtttctttcctttctctttggacacttcagattatttttaatcaccccctgctggttgattaagcctcaaaggaatccagcaaccagcaggtacaaacaactgtcagctgtacgtacgtacctacatggtccctctcttgttaggagtaggagtatataattaagcatgagcatgcagcatctcatctcgctcgctccctttcgctttcgttgttttggggagcaattgattagcacatctgcataacataaacaaaggcggcgtaatctgataagcatctgtatgctggcctctccgatgggctgcaggccttgacgctttctagctgccctcaacttaatccaggttggcttcagttcgttcgcggcttcgcgtcgcttgcgcgcaaggcctagctatccacggaatggaatcacttcctccgcactttagagggatacaaacacaaaacagtctaatctaagcagcctggagatcaacttcgtttagctgatcagatcagtagctggggttaggccctgtgtagatctcctggtaaaatttttacactgtcgcatcgaatgtttagacatatgtatagagtattaaatataaataaaaataataattaattatacagactgcatgtaaattgcgagccgaatcttttaagcctaattgctccatgatatgataatgtggtgatacagtaaatatttgctaatgacggattaactaggcttaataaattcatctcgcagtttacagacggattctgtaatttgttttgttattagtctatatttaatatttcaaatatgcgttcgtatatctgctataacacattaaaactttacacctctaatctaaacacgggagcgtatcctatgcacacaggccctcgcgtcgtgtacaccaactaaaaattattacaaaaaattctaagaaaattcatacatgtactttcaatagtattacatctacgtgcaaagtcgcatcttcaaattcattctacatagagaataacaaaaaagataaaattctgacaaaattgcaaccttaaaactgtcagattttttgtttttttgttacggctaaaatataatgaatttgacgttaagattttaaccctaggtgtaatacaattgaaagtatgtgtatgattttttctagattttttggtgacattttttagttgatgtgcacgtgtgtacacgtgagggccggtgtgtataggatatgttgcctctgaacacagccttaatataggagtatatagtactcccatcgagtagcatgcacacgcaacgcaacgcagaatacgatctgttgttggcgttgataactgttgggaagatcttccatgtcagagctgagctagggtgtttagatggggctaaaactttttagcccatgtcacatcagatgtttggatgctaatttgaagtattaaatatatactaataaaaaaactaattccataaatgagagttaatccgcaagacgaattttttaagcctaattaatctataattatcaaaagtttaatgtagcatcccattgtcaaaatcatagcataattagactcaaaagattcatctcgcggattagtccaaggttatgaaataggttttataattagtgtatgtttaatactttaaattagtttctaaacattcgatatgaaagagacttagagagtaagtccctgcaaaccaaacaggccagattcgatccaacatgtcgctagctaaagctagagctgtgcaccgtgctatacctaggtactctactccagccatatagccgcgcatcatgcatgagcaggaggagacgagagctgagagtaggaacgaacactgtatgcatgcgtgcaggcagcagcagcagcatggatagagatcgacggagaaagaatatctgtcactcaactccgaccatctgatctctgcggcgcccattgctacagggccatgattgccaccaacccgaccttcacctcgcatcaatggtgcattgccgatcgacgacgtgacggaggctctgcatgcataaatccgtcctggttttctgcaagctacccctctcttctatctgtagccccaacttccgaggccactcgatcgacacattactctccactccactcctgtgcgcgccggcgaatcgacccgcgaatccgccagcctcgcgcgcgacgaaacaagtcgtgccgtgctcgcggatcggccgaatccccgaatccagtgcacgcatgcaaggaacgctcgcacgtaagccgggttattcctcggttgattcatttcgttcggtgaatctccttttccgcctcacctcacctctagctgaagtactccgtagacgtaaatccacagtgccatgtggacttctcctccgtttctaatgggattattttcataatcactgtggaaatggaattgcttcataatcacatgttcgcagcagcacagggacgtgtcatctggtacgttgggtacgagcgccaggatccaatggcggatattcatggatacttacacacgcagcgtacctgtagtacgtactgtacgcggtgcggccgggagtactgcactactgcagcggcggatttcacacacacgtgggcgtatttaattttgttcttcatacagcagcaaaccacagttttttcgtgagctgaatactccgtattgcagtgtgtttgtcctgtgaggcaggacggacgagatgtatggaagcacgcacgcacgaactgattgatttgatattgattgacgactccatccacacgtaccagtgcgtgatggaattgaagccggatacgcgtcggtcccgtctcccgtggccgtggcacagcagcagtgacaagcaaaagatttctcctcaggcacatgcacggagaagaaagagctctctctcacacaacacaatctgcacgtcggccttcccatctgtgtgatctgtctgctggtgctgcttgtggtgcagagcgtgccgacgtccagtgtgcggtgcgacgctgctgcctggctcactcgagcaaatggtgagatcgaggtgatcagagatgcggaggtgcatgggcggacatgatactactactggctactggaggagtactagtactggctagggctcacgaggctggccggccctgtgctgccgcttgtgctttgcttgtccgccgcgcgcggtgcgtgcgtgcggccgtgcggtgcgtgtcgccgttcgtgcaggggtgggtagggtggtggtggtgtactagtagtacgtactggtgctgtggctggtggcccgtgctcgtgttggccgggcctctgccgctgccgccgcctgccgccgcgggcgcacggtttgtttgtagggctcctcgacgcgacagcccatggctgctttcgcttcctcggcttctgttgctgccggaggcaatgcagacctgcagactgtacgtacgcctgaaactctctgcaagtgcaagcaagacgaagctcttcacaatatactcctatatttgacaaattttgttgcgggtcacccaaaatctatacaatttgagacatcgtgagaaagtgttacaaccaaaagatagttaaaaaattggtgatttgttgaaggatatttttgtctcaattagaacgataaattcttaaaaaaaacgagaacgccctttataccacatgcttcaaacataatattattataaaaactagcatggtgcccgcgcagattgcgcggctagcatcattatattttctctcatataatagcatatatgttttctcattatattatttaaatatattacaatgacatcataattttaaattttgcaataactttacaaaactactaatgtgtaatattcatattgtattttatatacgtgttagttattaattatttttaatatcaaattttagttatttgtaaattatatatattcatatatggactctagactcgtcttttaatatttcttttttttaattccgaattttctgtaaattgtatttctatatagactctatgctcttcttccaatattatttatttttattctgaatttttattatttctaattgtatttctatgtggactctaaactcatctttcaatattctttaatttttaatttcgaatttcagttacttctaaattgtattcctatattgactttaaattcttatttccatgtttttcttaatttcgaattttagttatttgtaaattgtatttttatacggactctaaaaaatctacttttaattttattatgtttattccaaattttagttagttttaaattcctatatggactctatactctacttctaatattccttattttttaattccgaatttctatttttttcttaattgtatttctatatggactctacttctaatattccttatttttaattctaaatttctattatttcctaattgtatttctatatggactctatactatacttctaatattccttatttttaattctgaatttcagttattttctaattgtatttctatatggactctagtatcctcttctaatattccttattttttaattccgaatttcggctatttctaaattgtatttctatatggactctgccttttctttttctccgattaatgtgagaatttctaggccatgagagcgaacgtggaggctcctttttctattactttaataatataatagatttagaaatcatacaactctaaatttatcatcagcctaaatacatcgttagtatacagcatgttttcatcttcattgtagcttcagctaaaaagcttttgaccctataagcattctcgtctttttaaaatttctctccaattgagccgaaagtggcatccaacaaattatcaggcttttatagtgtctttcagtcgtgatagctttttagatatctaccatacatatcatgtagttaaattggcctatatatttactcatgctatttacccctctacaggcaagcaagctaaatgcccggttttctcccaactagggccaagctgtgacagggccagggttcacaattccaatggaaatcggtcgaattctgcgaattttcgaggttttgacaaggctcgaaactagaagccgtttgagatttcgatgatcaaatttgaattgataaaaaacaaaaaaataaaataaaatcttataaacaatatgatattcatagaacctattaggacataaaatttcgaaaaaaaagatgtattccgtgtatttactgaaatttacagtagaaaagaaaagaataacgaatgaaaaaaaaagaaaaacactttcaatttaattacctctttttctagttaccgattgaaatttcgatgatttcactcggaattttgtcaaaaccgaccggttttcgcaaacttatcggtaaactcagagaatttgtattcaaattttggtttataaaatttgttcggaatctaccggcttttcaccagatttcacgaaagccgtcattccgccaaagcccgaaatggaaggccatctcggaatcgtaaaccctggacatggctcccttaaaaaaaaagaggatgttaggaggatttgtgggcttgtttggtttgttaccgtgctaaaattttaataatgtcaaaacttaacttttggtagcaccaatgttttttttttcaatttatgtgttattggtatcctttgctagcaaaccaaatgctagccaatgtactacttaaagtgacagtaatttagtatggcatatttcggcatcaaccaaaatgaccctgaatccttacgaaaaaattcctatggagattaggaacgaaagattaatgctttatatttcctttgaaaatcttataaaatgggccattctaaagggagttggtaggaaaacaaatccgaggtctttacctcatgattttttatgcttatttttttcatgcacattattcaattaaatgacaaaagaaaaaggttggacaccaagaaaggacttggtgtcaatggttttaagaacgaagaggtaaatatttcccctggtaagggcgctcgacaaggatcgaacccgggccaatggggtgcgtgccagcgaccctgccactgcgctacgagcgcatttcattcaattaaatgactattttgcgacattcccgtatgaattcacaaggtgagacatcctatatagttcattttttctatttatgtgtttttaaaaccatgcgtttcagaggaactttctctttaccggctttacatttgaattaactagtaggtgcatgcttgtaacctattacctccgtcccaaaatataagcacatgcttgtaacttattatctccgtcccaaaatgtaagcacatgcttgtaacttattacctccgttccaaaatgtaagcatttttagcttacattttggaacggaggtagtaataaatactattttcagtctgtttaatatttactatattttcttatatgatcacaattagatcgatggaggatggattccctttggaagagctttaatcattgtttgtttagtcaacatttatgcatctactttcctgctttaagcctgtccgtccactacctaaggtaacctttgtagcctaatttccttaaaaaataatttgtagcctagggcgataatgccatagaataacacattctctaatattcactgttcatgatgtttttatgtactccgttgttcagtaacacatgcatttgaaaaaactggaaccattttcttctgtgcgctgtgaatgcaagagtcgttggtccctaaagtctttgcttggtactcctggtcaaatcgatcgttgcttaacagggcagcatgtgatgtttatctgttaattaaggacgagaacttttgtttaacagcgaccttcctcgtaatgcatctttatctgtgcagcatgtgcccaactcgccgccgtttctcaccttacccaaaaaaaaaaactactactacaaaaacagtggatagattacctgctcacataatactcacagaacagtgtatataaactgttgacatgaacatgtccaaattgtgatggggaaagatggagcctattcagctatctccactttgatgatatgaccgcttgcaacaaggacaatttttgacaaccaattcgattttttttaaaacaattatgaaatttagttagtagtatgaacaactaaccaatttaattagtgttaaatttgatattagtaaatggtggtcccgttcaagactggctccaaactgctggtggtcccacgaaccagtgacaattgtaagttaggtggtcccactgtcaatgactattataaattattagtaaattaattacctggcaaaactaataacgcaaatattttctgcaaaaacaaccaacatgagctgaagcatcttgacaccaaaggcacgtggggccacgtcaaacgagcggggccacatgtcagtggtatacaaggttatcacgcttgggctacgtagcatcctgccgttgcttcagcagatacgagctattctgaattctttctgaaagtactctatctgaaacagaaaattagcgttactagctgaaaaactggaaaaggttagtgagtagtgactgaagtgactatgagctggagtatttgttatcctatcaataatttagttacctaactaactgtttgttttgttttggagtaatcattgatatacagatatcattggactgctttttttttttcaaatagataagttgcagttacctctgctatgtaaagcaaacaatttatacattgggccaagaatcatcctcatttatcctaaacaaatactagttgtttttaatcagaattatcgtctgtcaagataatatattataagctagtattacttttgtatctaaatttgggctagggattatcctcagcaatttgattatcatattacttggtcgtcttctacacatgtaaagcaaaatttgagaaaccattgtatggttatggcaaaccagtaactagaaaccacgttattcaaaagcattacgcacggttaaaaaaacacaatcaaagtgtgacaacgtaaacagtcgtgtgtagataaaaattgaaacacgggtagcaccgtagcagttctagagctataaatgaactataaatactctactaaaaaaaaatatgatgcacatataacaaaaacggtttcaaactaaaacataccgtgcacattcatagtttaactctaatataccggacccaccattatactggtttacaagacatgcattttatatgatttcttacagactttttttatcattttaccatgtttaagtcaaattcaaaagcattaataaaaggagaagaaaaaacccacagctaaaggctattagatcaagaggaaggatttaaaaaacaggagcaatatataaaggggaggaggtggagaaagggagaggaggaagaacagcagaaagcagggagcggaaagcccaccaccttccttggatccacaaccctaacacccccaccccccaccccacacacctaaactcccacccccctccccctcctcctctctcccacccctcctcgcgtagtagtagtagtagtattagtctattcgagtcctaccagtagctagctaagcagccgagacggtggcggtggaggaggtggtggtggtggtagtagtagtacgccggggagagagagccgttgctgctgctgtgaggtgagggcgagatctaggagggaggcgtccatgggagctcgctgctccaagctctccgtgtgctggtggccgccgcacttcaagtcgccgctgcttggtatggtgctctcgctctcgcattgggttgggtttgggggggggggggagggatttggttgctggtttcggatgtgcgcgtgttgatgatggagtggggttgttgcggtggcgccctgcatttgggcctggttttgctgcgttttttctggggatcttttttttttttttggggggggggggaactcggtttgcgtctctaattctcctgctttggtttgcggtcgtggagctgttgatcctgctggaattcgctgtgaaatgggtctgatccagtgggtggtttttgtgtgaacgctcatcaacgatcccattttttttttcactctctctctcgctctagcaacctgttgctgatttgatgtttttttttgtttgtttttttttgtcggttgggttgacgaattcggttgctcttgcgagtgtttggagttggttgcgtttgattcagtggggtaatctcttggcgtcgagagcattgcgacctcttcgcgagaatccgtggttgattccgacgcgcgcgtcgtgcttttttggtgctgatccgagctatctgtgtggttttgttgacgtgcagagaatggcgccgccgcggacgacggcagcggcgtgccggtgttcgccgagtacagcctcgacgagctacgggtggcgaccgacgggttctctcccgagcgcatcgtgtcggagcacggcgagaaggcgcccaacgtcgtctaccgcggcaccctcttcagcaccggccgcaccgtggccatcaagcgcttcggccgctctgcctggcccgactcccgccagttcttggttcgtgcagctttgctccatctgcatcagtgcttgccttgccttcgccgcttcgattgaatggctccgttcttgcgtgtgtgtgtgtgcaggaggaggcgagggctgtcgggcagctgcggagtgtccggctggccaacctgatcggctgctgctgcgagaatggcgagcggctgctcgtcgcggagttcatgccgcacgagaccttggcaaagcatctcttccactgtatgtgtttggtgctcaccttttttttcttcttgttctatactagctgcagctacatattgggctttggcaaatgttgtttccgatttggtagtacaaatgtaggcatcaaagatgataagattgggccccttatttaaggatggatgtgtttttgtcacctgaatctaatgttgaattgttgctttcagttggagacggttgaagtaattccttcaacaaactctttttgctgtttcttttgtctggtcctacatttgttcttctgggttaactagaaattaatgcatttattcttctataaatgcttgttattagtgttctgtttggagtactacactagtagttggcatcaagatgttttcattatttattgcctttctagaatatatatccaactcaattgcatctaaggttcttagtatgggttatggtaaattggagagcttttgcctcctgttgcatttaacgttttcagtaggagtagacactttgcatttggattatctacattttgcgctcatggtggttatccttggcaggggagacaaagccattgagctgggcaatgagggtacgagctgcattctatgtggctcaggcattggagtactgcagtagcaaagggagagctctctaccatgatctgcatgcatacagggttctctttgatgtggtgagtcagtacctgtgctacttagtaacttcttagcttgggcttccagtaataaggcatgtaatgttttgatgataaatcataggatggtaaccccagactgtcgtgcttcggtctgatgaagaacagcagggatgggaagagctatagtaccaatttggctttcacgcctcctgagtaccttaagactggtatgtgttgtgcatacaagcaagtttttttctgtgagttatgcatttcatgaattttatttgttaatgtttgatcatgaagtaaggacttgtaatatgagcgtaatatgagctaactcttagacacttgttgagtatgtccatgttctttgctagttattttccccagtggggtaaatcattctatgcaaatgttattgctgggtttccattgtttatttttagctattcacaccttgtttatttttagctatggtaccatggttatgaaccacagacattaggcaacaacgtaagctgcacggacttgtttttcatgaagggatagtatttagcattcgacctctctcatagtgaagcaacagaattctgtgttgcaaaatctacctcgttttcttatgactttgtccatcaaagacacagtctctatttctttactaaccactacattttctgcaggcagagtaattccagagagtgtggtgtacagttttggtactatcttgcttgatctcctaagtggaaaacatatcccaccaagccatgtaagttatctatccttcctgcttttctgcttacccaagataagtattcactttgcttggttctgctgtaggcgcttgaccttataagaggaaaaaattacctggtgttgatggactcttgcttagaaggccatgtctccagctctgatggaactgagttgatacgattagcatcccgttgcttgcagtatgaaggtcgtgaccggccaaacctgaaatcggtggtgtctgctcttggaaacctccagaaagatgcttctgtaatgtttctttttcttgctactttctagactagtaacagtattgtgtaatattgaaaaagctgcaggaaaaaaactccacacaatcgtttgataactattttgtcttctgtcaacgtgctacctttgcttttcatttgatattatgttagcataaatggttttttgaagtatgcgccaactcatctttctccttattaatgtgtcgcgcctgccagcttaatatttcttactcgatgtttaattgtctgtgcaggctccttcacatgctttactaggcatacaacatgataaggaaaatacagagcgaatttcgttatctgctatagcgaaagtttatgccagagcagaccttgatgaggttcatgagatgctggagaatgatggatattgtgaggatgaaagagcaacattcgaggtattaactttttgtcagttaagcttatcataatgaaatattcttgttggtaccatagatccttccctaactcattgctgccatttccctaaaaaggaataaactgccggaacttattactacattattgtcatcttggaatatttcaattgtgtagatgaaacaaaatatgttgaaagcccacacattttgtggcataggataggaagaaagtagatggtctatgttgatgcccatgctcttcgaccaatgaaacctaatggttagctcatgttttaagtgccattcttttgagctcgaggctaaacttttaactagtttgaccatgcttatttttattgctctataggtctgaaagtacaatagaacatttatgtatcttttgaagatatattatacatccatcagttgacctgtaatatatcccatacaaaacttaacttctcaccatgttggctggtccaagtttttttaacgtgaaggttttccatgttttcgcactgctcccgttcatatctgacccataccttaaaaatttggtgtatataacaggtatctttccattcctggactggccaacaagtatctgatagtattcttgtcaagaaacatggagacagtgcttttcaatccaaggattttgcgactgcagttgagtgctactcaagggtatgtattagagtatcaaatgttgtccatgaatctaattcactttcctgtatctatactctgttttcgatagcctcgctgcttgtacattaacaattacttttcctcaaattaagattatggttaaaaaaactgtgttcctgattgattttcaggttgctaagctgtgtttttaaacattttgcagttcattgacactggtgtaatggtgtctccgactatgctggcacgacgaagtttcgtatacatggtgctcggcaagctgcaagaaggccttgcggatgcaaagaaagcagcagacatatctcctgagtggcctactgcacactaccttcaagggatggcatatctcgccatgggaatggagcctgaagggcatgaagaactcaagcaaggcgccgctttggaagctgaaaggaatgctagatagagatgaactgtatagccctcaaacatgatgtgatgcctcctctcttctgtacctagatcgcctgcattttgggtgtcctccagtgctttgccaccaatagggctgttttttggtcttccctaacttgtattggtatttccagtggttttacaactcctaggttggctgttatgacacctccaatatattcataagtacaaaaaatgggcaactagcattcaaatagcaaaccgtggatgtgagattgtaaagctttaatgttatttcgtcacaattcatgtatatacacaacttgcagacttttctgaggcgtcaagagttaaagactgttgtgagtaatcagccatttttcatgcgtgttccagtgcaactgtgcaaatacccgatgttctttttctgattagtagaacacgtataacgtattcttgatgctatagcaccggtaaataatcattctatggcttaatgctatcattattttagccaattaatggctgagaaaagtaggggagtcatatatggtaccaattttctttaaaacaggagttcaaacagtattaaactagatggttacccaggcgttgatacagaagaattatgttatagtatagtagatagtagatacaagttctacaattttctttcttacctactatactattttttccatgtgttaatatatttttatacctttatcaattactatttttttcatgtgtttatatatttttatactgttatcaattacccaaaggttaatgattaggctgtatagtgtcttttggagaaagagatgcaatttacattctagatgaatcattcaaaggctaaaaacaattaagatgatgtggcttcataagtagagtgaattaacattaactacacttagtatatataggattatttatctgtttgtaagaaaattttcttgcgatttttccagaaaaccacacatggctgcatttggattgcaaagactaacactgggtcctccagttcgctttaaacatgacttaaacaaagcaaaaggttagaacagtccagaataaattgtctcaacggacagatattcagacaggcaagtataacaaaagagagcatcatttcgcagcaaaaatcgtcgtctagctgtaccaaattattataggcatgtggcctgttcatgattcagggagaaggtacaccattggaaaggaacattgcaatttcttttcgggcaatccattagtcggtcacactcactcgtgctgtgtacttctggcaatcggtaacattctaaaaccaatgtggagaaacatagcgacaatggtctggcctaatgcttctactgcttctcgcctcacatctgaggccggttaccgagcatctgacctaccatattagttacctgaaaaagattttaacccaaagttagacttagtggcgttggtaatttggtacaaatggaaataaattgatacaaatagaaataaattgatacaaatagagcaaaattaacccaacagtcatttcaaatgaatcgggaaaatagtattcagtgttcagacgaggggaaaactcgaaatagaaaaacatgtgctctgcatggatttcaaccactgcctatatgtccaactatacaaggcgtgaagatctatggaactcatattcaatgacatttgttcaaggatgaaccctatgatttagtaagatgatctaaattctctggatggagatcagatgcactaaaaagatgactttcttcacaacacaaagtaggaaagacagtcatgatacatattcagcatgttaccaccaagctaactattgctataaaaactccagacatctgaatcagcatcaagcatgacagcaaatatataattatcagttaacttgcctgccagtacttcgaaacacatcgatcaatgcaactgttctcacccatattgagctcagcttctttatacctgttgaaatagaacaaatcccaggggaaaatgcacagttaattcaacagatgatagttactagagaacaagacacatgatgaatagaaatgcccaatattggtcaccttagttgaaatatattgatatagatatattctttaccagcaatattttagtctatcatcccacaaccatgtatgagaatgctaattgaaaccaaacagaaggatgagaaaataacagcatgaaacggataactcagctatgtgaaacttaaccagacgatatgtaccttttctcaatgcacttgtcaaaacaagtctgtgtaagtctgcataaaggaaaaggacacaaaggcgtcaaattagtgccaaaaagatgaccaggagtgatgtgggctactgggccaatcaaaattaccactcaataagatacttaaatactagaatcgcacaaagcatctcagtacaaacaagggagaacgttgctaaaatatacctgggcctaaaaatatattaactacctgcccgcagaaacttaacattgctaatgccaacctaattgatcacttctatttatcaccgaaaatattgggtgctaacagatagtataggaagtacaacttgccagtaactacagatatgcgatatataaaccacggaagttctatattacgctgccagtacaaggatgaaaactaatagcccagtgttaacatcgttggccagataataatatctcactctagttcttaaaaaaaataaagatatctcactctcactgtaattagattgacagaaactaagtttgtttaatgctttacttcttgaaagattcgtgatatcagaagtcccagatagtagcaattagcaaagcatacaaggagtgtatcactcaccggttgaaaagatcgacccggtactccatctccttctccatcatcccgaacatctgcccagccacagaaccacgacttcaatcgcaccacgaactttatatcgacaaaaaaaaaagaaaaacaaaatgcagaggaaagatggacgcacacacacctgctccttctccaactgggtcggctcgggtttcgccgccataattgctgctctttgctcctcaactgcaaagcaggaaacctaaggaacccatacccccaaattgcaggcaaacgaaccgctcgaggaaggagaagaggagggaagcttacccggaaggagaaaaggccggagatctcgcgatgcggcggtgggaattgagatgccgcgaagagcagcgcgcctccagaagagaagaagacctgatgaacccttcccccaattctagggttttgttctcaagcggaggaaccaaaacagccacgtttttatgggccgcatcctcatgggcctcacggcccgaatgatactcaccgacaacttgggcccacctgtgagcaccgggtaatgttttttaagtttttttcagaaatccaaactcttctcgtgtcaaaaaaaaaaaaaaaatccaaactcttctctctcgtctcgtcgcggaggaggccatgagcttggcttatccgctcctccgcctcccatgccgctgctcgctggcggcggcggcggtgccggcgccgccgagggcgtcgcctgggcctactatatcggtgtctatgtccgtggatgggggtgagggggagctgacggggagggagaggcggaagcagcggggggagaggcgggagctgcgggcgcgggactggaaggaggaggtgcaggagcggctcatccacgagccggcgcggcggcggaagaagccacccaagaggacgtggagggagaacctcaacctcgacttcctcgccgagcacggcccgcagtggtggctcgtgcgcgtctccatggcgcccggcaccgactacgtcgacctcctcaccaaggcgatctcacgacggtacccggagctctcgttcaaggtctctcgtctatcctcttctcctctcagaagttaacaaattatttgcttctgtgcagcggaagcattccgctgaacattgtacattcgaattatatctgcttgttggtctgtgcaatatgttgttagatgtcagatgtgccaattatattagattatgagcaacattaggacgcaaattactggcattgttagaaatgttagatttaacatgaaaaatcttatcgttacactatcatgtgttgtaggtgattggtcataagatgcctgctgaaatgcatatgataaacttaatctgttggtagtgaaaattagtcgtttgttatatccatttaaccttttccggttcctgttaatgtaaaactgtagctgtggttagttcggtaacttagtacccccaatgtgcagtgttgtgctactgaatggatttatttgcatgccttgctttcagtactatatgtctgacaaaatatttgcagatttataatccatccatccaagtcaagaagagactgaaaaatggttcaatcagtaccaaatcaaagcctttgcatcccgggttggtctttctgtattgcaccttgaacaaggaagttcatgacttcattagggacactgaaggttgttatggttttattggagctacagttggctctatgtgggtattcttcatttgatagcttctgaattagcatttatatttttttagatgttcctattcttgttgaaattagctttgattttatggctgttttttttttttttggaaaaactacctcaatatctcatcctggatttctttaggttaacttgaaagttgaaattttaggttgcagatatgtcaaagcaaatattacttgccatctataagttgagagtcatcctttaaccccacaaggtgactgacatgcatcacaccatgtttcctcaaaaccataagctacttggttagttattatctggatttcatcagagtgaaagtagcaatcttcgttcaaaggcaataactgactgtagttgtaaaagtgcaaattatagaagatggaaagtctaagatcagaatatagcaaagtacattatccatttccttctttctaatatcatcttttcatttgtgcctaccttcacgctatatttttgtaatgcagcaaaaggcagattaaaaagcctaaacctattccagttgaagaagttgaatcgattattagggaagaaaaggaggagcaagagagagttgacagagagtttgaagaaatggaaaatggaggaattgtcgagtctttcaacaaacccgttgaagattctgaactcatgctaatgaataagatcaagagacagtttaagaaaccaatctcaaaaggtggcagcaaccacaatgcttttacgcctggtgctagtgttcatgttctatctgggccttttgaaggcttcactggttcactcctggaagtgaatcgcaaaaataagaaggttaggctgatgataattccatctaagaacatcgcaaaaatcagtgaattaattgtatggtaattttccattacctattcttccaatattgcttgattatctaagaacatgttatatatgtacctcccacaggccactcttcagttgacactttttgggaaggagagctttgtggatctagattttgatcaaattgaggcagttgatacttgatggtgaaaaaaagtatgatcactgacccaatgaattctggttttcctagcaatagcattatgaactaatactttccaagaatcatggctcctgagtaatgagcatgcctaagcgtctgccattctggttgcatcaggtggtcaggaaagcaataacttaggaagtactagtagtacttctatagcaagcaggaagttagcatacaagttagattttcatatgtttcatgtacgaatgggctgagaaagaaatgatttacatgcacagtatgtgattttatcatttctgtgacagactccagagtccccaggttataggatagaacttatgttctattattgtgctgcaattattcatgcaacccaatctaagtaaatcaagtttagttacgatactaacaatacataaatttactgctctagaaaatgttaggacatctccaatttccatcatataggacattgcttcttggcataatattttgccttttttcttaacagccattcaaaaagaatattttgataactgtttagctcccccacactatagccgcaggagaggttgtttctgattttatgggtttatatcctccttccataagtttgtgtttcttgtctgagcagaagtcttgcggatcattagctttgatcaatacagctggggcctggaggaaatagctaagattgaatccatttaactttgagtaactaccgtgacaaaactgttagcatacgggctacctcaagaactgacctgtaagttttcttttcactaacaagtatagtatttcatactaggcgaccgggttttgacgtttccatttctgatgaaagaatatttataatgttttacaggagttacatgaccacatgagggctagatttgtcggacaaggaaagtcatgtagaaaacaaggttcaaactttttaggttggtatttttagatgcataggctattcatttcaaaattttggttcgtacctacatttatcaataaattcaataaaagaagaacaattctttgcacaagggttttgttcttatgagcatttagatccccagtgtcacttcaccatgtgtattaggctatcttcgtgttccactttgcttctttctttgttgattccttagctacgagatcactttggagaaagacccaattcatcttttattaaattgtttaggcaaaagcttctgagaacaaagggatctgcttcttccccttttcttttactgtagtttctggagatctgtttgcgaaagacaaactgtgcatttcttcacctgaacagctctatcatgcaacatgttttcatgcttttaaaaggcacaataccttgatctgaacaagatacaaattcattcttttgatgaatatacattgagcaacatactgttctttccttgtgtaccatgcctaatgtttttaaattgcagaaaatctatctaaacagatctagcctgtcctctgcccagcaagaatgatctagtagccttcaacttcttcaattaacagactaatagcaacacatcataaatgccaattaaggatagtacttctttgatgtcatgtgacaactactaccacatcttctgaatgatagagtgccttcttaattatccatcatactcaagcccacatcttgcgatgatcatactgatagtacacatgacccagctaatactccagtaccaacccctactttgactaaataatagtaatagtacaacatgatcatacacccaattctcttacccatggattacttcagataagaggttgctaaaatgctaaatagaacagtaagtagactaaatggttcatccttcatttctggagtaatccaagtctattacacatgtaattaagcagctactactacaacacttgcttccaccaatcaactactccagctaaggaagaggcgatccgtgcattgcgtatcctgtcacggtcggccaccgcgcggcacgaggtagacccgggctcgcaccacggcgccattgcccagccggaagccgggcgccacggcgaacccgacgaccatgccggcggcgccgccgccgcgcccgccggcgacgctctccatgtaatccgggtggaactcggcgccgcggccggcctcgaagtggctgggcggcgtctcgagcgcgaacgccagcaggtgcagcatccacaccgccttcgcggcgcgcaggaactccccgtagaatggcgtccgcgggtgcgcgccgccctccaccgccctccggtgctcgccgtcgccgaggacggcctgctccacgcgcggcgggaggagcgccgcgaacttgctcgcggcgtagcggccgaaggggcaggtcgggaggaggcccaggagctcggcgggctccatgccccgcatgtcgcggaactgcgtgtaccgctcccgccggaacgcggcggggtcgagcagcgaggagagggagccgtcgaggtagaaggattcgtgctcgaagccgacgaggaggacgcgggtgacgtgcgcctcgagcgcgtgcttggccagctgcggcgaggacaccgggatcttggtgagggaccgggtcgccgccgcgaggtcaagccccgccgcgcgcatcagctggaggaggtgccccgcgaacgcccggatcgcggcgcgggcctgctcggcgcaggcggcgaacagctccgcggtcggggcgccgccgccgccgccggaggcattgtgcttggaggggtggtggcgtgagttgcggcggttgctcgcgacggcgagcttctccttgaggccatcgacctcggcctgcttggcttggagctggcggcggaggtcgtcgagcgcggcctcgtacggcgcgacggcctcgcggagcggcggcgcggtggggatggggccggggatgtgcccccccgtggcgacggagcggcggaagcggtcgcggagccgcgcgaggtggcggagcttggcgacgacggcggcgtcggcgctccgcatcttgtcggggtcccaggggcagtgtgccccctggaggtcagagtacgcgcggcgcacgccggagaccgcgtcgaacacctccgccatgagcgtctccgcctccctcgcccgctcagccccactcgccgccaccgccgccgccgccttcaccttcctcttctcctcccagatcttcagattctcctcatcctcctcctccccaccctcaccaccatcctccccctcatcatcagcctccgcctccgcctccgcctcctcggaagaagagggagtgcgccgccgctcgccaccggcccccgagatggcgtcagcgaaggggtcgtcgtcgtcgtcgtcgtcgaagtcggtgtcgccggagtcgctgaccgcgtagctgccggggaggcggttggagaggcaggaggtggcgacgcggtggatcagatcgccaatggtgacagccttgttcgccatttcttgattgatgggcaaacagccgcagcagctgcgactgtgcgagacgagacgagtgacgaggtggggcgtgtgtgaatttaagaggaggggaggccaagccaaacacccgaacaaaatgggagacagatgctctgcgcaaacatggaggtcagccagatgcagacaaggcagtgagctgggaagctcaggctcaatactatttaacctcaccaccaattccctcggctaaacaaccaccattcaaacgatgctaatgagccactaatctccactttaaaaccagcattctagtaccaacacacatcagcataggagtagtagtgtactccctccgttcttaaaaaaaaagaatctaggactagatgtgacatattccagtataacaaatctaaacagacgtatgtctttttgttgtactagaatgtgccactttactaggttgattttttatgggacgaatggaatagtgtgttagcaaggggcattgcttcggtttccttgatgcaaactactgcagtaaatatgtaggctacactgtaagtttgatcatatgtctccatgatcaaagtgcgagtcaaccgaagttttatgttacgagctgtgataatgtggtatgactttcttttctttagtgttatggtagcccggattatgcggctgagcatgtgatcaatgcattcatctaccagacgcctgcttggtctgggcaagtggatagcttaacctcttttgacctttccaaccgtgaaaagcacttgttgtaatgtactaatcgagaccatttgctctgcgaaacatgcagaccagccagatgcgaatgaatgtaggttttcacccagtatggtgatgatgggcaccggcagatagagcaccgtaccagcgaggaaggccccatagataaggcggagcgtgatgagacaatggcgagtagcaacacctaacgccataggaggagaagaaatagatggagagaggggttaaagtacaaaaatagatttcctgatattttcgttaaaatctttccttagttccaactaattttttgaattcaaatccaaatacgttcagatattttccaaaaaaaaaaagcacactagtagaaaatacaaatgatgtgctgaatcatctctttcttcgacggcccgcttttcctctctcctttttcggccctagcgaaccagctggctcagcccatctctcctttccttcaccggcacggccctagcgtggcctttcatctgtttttctttttctgcacgggccacatgctcacatctgggctggagtaacacaggatgagaagagaagagcgccggcgcatggtgtacttgttgctctcgcggtctcgcctcttgcgattggagcgtcacaaacagcacatctctggatcgtcatccatgccaatcagatggcagcaccaacgagtagtagatccaatagaataataagaagatgagagccacgaacaacaacaaaaagaatcggagagaaacaatagtatttgatatttaccatctctactattataaaaattaaagatgtttttaccggtattttggtacgtcctccatatttaagtcggtttttaagttcatttgcttttgaaaatatagatcagtgtttgagtcggtttttaagttcgtttgcttttgcaaatacagaaggagtcgtataagaaatctctttaaaaaaaactcgcatgttaatttgagatgatcggactcctaattacatctcatgattttctaacaaggtatatatccaagcgaatttaagacagtgaatttcaccataactaaaccatataacaataataggattaaaataacttcacccgttgcaacgcacgggtattttaaataaaaattctagggggatcctatcaggatccctccggtcaggccgtgcattaggcgaattgattgtatcaagtactaattgataaaagctaatctgataacaatagaacactattgcgtactgtccaatcgccgctccataagtaagaagcccccatgatcgtctcactcgatgaagatagcatcctccgatgacgcaggaaagatataccagctcggttccgactctatctccagagtatgcgtgctgatcccctactcgaggcatcagttatatatgtgcaacagctatagctagaccaacctgattagtagaacgacaaaaattagaattgaataaactcagcttggttgattgattatatatgtctttcttagattgattaattatatatcaacctctgtacgggaaaaacatcataatccggaaaaagaaattaggaatcaagatacgtatacgtacgtaaaatcctggatacggtagatcactgggaggcgtagacgaaggctcctgagggacgagttggcagagcaagagcgaggatcgaggttgagacggcactcgtccttcggtgaggcagaatttatatattgagcacaaatatagttttcgatttttcgaattcaacttggagtagaagaaaagaggacaagtagataggacacgtaccgatcttttgtttttggaatcagactatcgcggcgttgcccggcacaacacccacgcgatgccgagactgtgcacgatcccgggtcccgaactaccctgattccagaaagaaaagaaaaatctggcattactgctgcaacgatttgttgttccatattatgagatctttgcagttgttttaatctgaaaaatacaagtttgaaatcacaacgagctatctaaatcgttgatgattttcggagccaccgtgcgaaacggcatatttgcaagtgaaaaataatttataaataaaatttttatatacgtgtttttaatgatctaaaagaaaacactaaaaaataaactctgaaaaaaaaacctcaaaatcaacttcaaatctaaagttaaaaatttaaatttagttgataaacataaacgtctagacgaaaagatgagtcccattgatgctacagagagtccacgtcaccctcgtctgcctgccccgctggcgttcgatccgacatgcgggccccacatgtaagcaagcacgccatccatcccatcctgaacccactcgtcagcgagcgctgagacgatctgacccgcagtttcacagaaaacccctcgtctctttcgccatttcggattccccacccgacgagtctccgaccacttcccacaccggcgcctccacgccgagatctccttccctctccaccgccggcgaccgccgcggcgcggcgaggccctcggggtctagggttttgtactcagatgcgtcccctcctcgccttcgcggcggtatgcgcccttctcgtggctgccgcagcgccggcggccgcggaggaggagaaggcgaacaagttccggcagcgcgaggccaccgacgacatgcttggatacccccacctgtgagtcaccgcttgcctctctccttcacatgggttctcctgtcgctttcgatttggaactgaactgctgctagatccttgggactggaagcgatcttagatggttggttgttttctgtggctcctcgtaatttcttagtagttaacgaccttaatcaccttattatttctgtaggagtgttcaatttatgctcagaatgacacgatgtgcagaatctgttaaaacctctacacttttttttttgcattggaaaatacttctacttcattcgagcattgatgtatcagggattacacaaagcaattaactcattttatggaatagttaatttgaatatggaaatggtgatttcgtccttcttttcatttaggtcacccaatctagtgtttcataatctggatttgtttcaactgttatgcaggcttgtgtttcataatctggatttgtttcaactgtcatgcaggctaatgtcacaaaaaagaagaatatatgcaatttctagagtgtgaagatttactcttctttttaaaaaacttggatcgcttaatttttgttccatttaatgggcacatatgatacatgtggtgattgataccctgcattaagtaataggccttattgggattagcgtatttgtgaccaaccatactatgcctggcagatttgttcattcagttgattctttgtagtgtgaaattattattatattctcttgtatcttaaaagaattagtactcactgatcccctccaccacccacatacaataaaatctacatttataattggttctgtaggtaaaaatggatgtaaaatctgtacatcgcttgaggtttctagatcagttattgtagttctgttgtttttgcgagtgctgtaaaagcgcaaacagctcttcagatgtgttcccttcagagttaatcttagtgtcctttgaaatagatttgatcatatatcctctctttagataaaaaaaaagagtattaaacctcctgtgccactgacatatagggtcatctaaggtcactgacatgtagactgaagggtaaatcctcaatttcaatctaaaagcaggtatatgatcaatcattacttgaatctttgataccatttcactgtcaacctgaatttcattggcgtgctaattcttaaaatatctgcacaaatatatatgatatattagtcagccatacagggggcaaaaaagcattcctgttaaatataaattcttattgatgttttcatctgcaaaaaggattaagagattaagagtaagattggctgttacaacatgtggatcatcaaattgttatactgtagtattgtagtttctcagagaaaaatcacagcctaaagcataatgcatttatccataccactaatttcaactgagcacctgcaaaatgccacaacttatggagcaagtttattaattcagttagctaccatgatccccgtgttttcaatttgttcagggggacatatgaaagattttactattgtggacactacatctttgaaagttacctagacaaataatgttgatcatctgtacggatagatgcattcatcgatgtaataactatatattctccgcagtgatgaagatgctttattgaagaccaagtgtccaaaacatgtagagctgagatggcagactgaagttagttccagcatttatgcaactccgttgatcgctgatatcaacaggtaaaatatcctgggaaatgatttggcttttttttggctttaggacatgttaatctttgtcagatatccttctcattatcttcttctatttgacttcatgtttccatcattatttgcttgtataaagataaatctattgttctatgctctggaacagcatccacttctgaataaaccttctgttagttactatagattatgttcaaaatcaaataagtacatcattgccataaactgaattttttttcctctgtatgattttgtgcttcaaactatggacactgtgaaatatcatatgcatgtttgctttggatttttaaacgtggatgacttttttctagttattgtcttaatttcttctttagtctgctctgggcacactttaatgataatcttttggtgtattagcgatggaaagttggaagtagtggtgccatcatttgttcattacctggaagttcttgaaggctctgatggggacaaattgccaggtgtgtggtttcacattaccgattagcatgttatagtggtcatcattagctctttgctataaattctggaaaaccatcaattgaatgaataggtctaagatgttctaccacattttaaaggtcctgaaagtttgtgctataattaacaaaagaattggtttaatgttgtttatttattaatatatattgttgtgaaattgattccaggatggcctgcatttcaccagtcaaatgttcattcaagtccacttctatatgatattgacaaggacgggacacgggaaatagttttggcaacttacaatggtgtagtgaatttcttcaggtaaggaacttggtgcatatcttcttatgttttcactgaacatgtaaaattatttgttgagtttgtttgacatggtaatttatttgtttgttatgtagggtatcaggttatatgatgatggacaagctagaagtacctcgtaggaaggtacacaaagactggtatgttgggctgaatacagatcccgttgaccgctcccatccagatgttcatgacagctcaattgcaaagaaagctgcttctgaagaatctcacccaaatattcaggacaagccagttgtgaatgaatcttctaaggaatcccagtcacgtaagttatcttataagctataatcacactattcactggtcaatcataagaatcccttcttttcatctgttgctttagtagtttggctgcaatgcttattctctagtcactagtattttacatgctctaccttgaaagtctgtggctctgcgcgctgtttaggttaaatggtactttaggatcattagttcaatattgatgtttgttgaacatatttgtaggctgtccttagatatatagataatacagtggagcctggatattataactagattatgtgatgttaccaaccagaggatggaaaatgctctaaagagagtggtgcatgcacgtagtaacgattatgctactccagtactctgattttagtaacagagaatccacactccgtgtgtagtctataagatcatttacaagagatgcattatagttttatttgtttatcactgtagggagcacaaatgactcaacaacacgaggagttgattccatgaaacatgcgtctaaggaagagccagttgaaagtaaacctaattctacccgaggacaggagaatatggatgtgttaaacaatctaaacagcacagatgctgggaacaactctagtttaagtactacaacagagaatgcatcacatgttcagagaaggttgcttcaaacagatgagaaaagtaatcaagcaggaagctcagaaactgatgcaagtgataccggaacagcaaaagcagctactgttgaaaatagcgagcctctagaggctgatgctgatgcatcatttaatttgtttcgggatgtagaagatctgcctgatgagtacaattacgattatgatgactacgttgatgaaaccatgtggggagacgaggactggaaagaacaacaacatgaaaaggcagaagattatgtgagcatagatgctcacatcttgtccaccccagtgagtgtaccttctgtttcgttttggctatttctgcttgttcattctataaatattcatgaattattttccactacaggtgattgcagatattgacagagatggcatacaagaaatggtgatttctgtatcttacttctttgaccacgagtaaggctgctttctctgctacaagtgcattttgataacataacaaaatatactggttatttatgttatcatgtgatgacatttgttgttatgtagtttaggttacttttttaaaaccagaatccttttattctccctgattttgggtcggttggtatgtggtggtgctttatgacagttttcacttctcagttaggttccaacaatgaatcaaaatatgccgacctaaggtgtttgcttgtaatttcccttctgtctattggttatgattgaaatactctctcaatgcaaaacttgtgaccataatatgacttaatgatttcttgcctaattcctgtgttgttgtgttggtgtttcagacagtcactagtaacttgtcttttactgacaggtattatgataaaccagaacatctaaaggagttaggagggattgacattggcaaatatattgcaagcagtatagttgtttttaaccttgacacaagacaagtcaaatggactgcagaacttgatttgagtacagatagtggaaattttactgcccatgcatattcttcgccgaccgtggttgatttggatggtgatggaaatttggatattcttgttggaacttcctttggcttgttttatgttatcgatcatcgtggtaaattcttaacctcataatatcaattctgaatccataaacagctttaagctgacttattgttttctatgctgtgtatatctagctcccgtagcataaagttttttttttctagaacaacagaatatgttagtgtagaagtaacagtatgtttcagcatgcttttctttgctttgtttggacaataaggacatgttcactgaaaatcctcacaaatacaataaaatctcactttcagttctgttgctttcatcaatatgtttcagcatgcttctctttgcttcgtttggataattaggacatgttcactgaaaatcctcacaaatacaatatattctcaccataagtgctgttgattttatcaatctaggtaaggttaggaacaagttcccacttgagatggcggagattcatgcaccagtcattgcagcagatatcaatgatgatgggaaaatcgagatggtcactgctgatgtccatggcaatgtagcagcatggactgcagagggagaagaaatctgggaggttcatcttaagagtcttatcccacaggcaagttcaaacccgtttcttttgtgggttctaactgattgtgtatatatttttggttgtctatctatatctaaacatacccttacctttggcagtctatggactgcaaattgctatatgtcctgaagctgcttgcttgtttagctcggtagaatactatggaatctttcttgtcagattgtcacaatttatttccatcttgttctattacctttttaccgagtcagaaatcagaatatcataacttggtttagtattactatatgctttcactgtcttcactggtgcattcagttttatttgggctatgcttttcataccctctgatttgccattgtcatatgatgacagcgccctactgttggtgatgttaatggagatggtcgcactgaagttgtggtcccaaccgtgtcaggaaacatatatgttcttagtggaaaggatggctcaaaaattcagcctttcccatatagaacgcatggaaggatcatgagtcctgttctattgcttgacatgagcaaacatgatgaaaagtctaaaggcctcacccttgctactacatcctttgatggttacttgtatttgattgagggctcaagtggctgtgcagatgttgttgacattggagagacctcgtatgacatttcttgtctgctttgcaattctgtactctgtacaatttctggattcaacaaagtggctcacttctttgcatattgacaggtacagtatggttttggctgataatgttgatggtggagatgacctcgatcttattgttactaccatgaatggcaatgtcttctgcttctccactccctctccgcaccatccacttaaggtacatagcatgtttttttatgtcaataatttagagtaaattacacaaaaccataggtattgtgtccaagttacacaaaaccacaggagttttggcacgtggcatagaacccctattgttatgttaccaatgtttcagaaaaccacacaattgccaaatttttcttaaatttgacatgtgggatgaaacttttatatgctcatagaaccacggtggatgaaagaactcataatcccacgtcagatttgggtcaaatcatgttcagatttgggtcaaattggtcaattgcatggttttgtgaaacactaacaccataatacccatggttacgtgccacgtgtcaaaactcacgtgattttgtgcatactcataatttaactcaagtcagtagatttttttgtgaatcctccgtaacttatgtttaatctggtttggctgagagttgcatatttcctttaaaccttatattttttatggatgttgaaacaagatagtggaagtactgctgacaataggataacaaaatcacgtgattttgtgcaatttactcataatttaactcaagtcagtagattttttggtgaatcctccgtaacttatgtttaatctggtttggctgagagttgcatatttcctttaaaccttctatttattcatggatgtttaaacaagatagtggaagtactgctgacagtaggataacaatataattccttccaatttaatggtaggaatggagatcatcaaaccagggaagaaacaatgctgcatatcgttacaaccgtgaaggtatttatgttaaacacggttccagaacattccgtgacgaagagggcaagcatttctgggtagagtttgagattgtggacaagtacagggttccttatgggaaccaagctccttataacgtgacggtacattttgtcaacccaatggcttgtctgatggatattccaaatatttttatttaacttccaactaccctcgcttaccattggatttcaggttactctacttgtccctgggaattatcaaggagaaaggcgcattgtggttaatgcagcttataatgaaccaggcaagcagcggatgaagcttcccacagttcctgtgagaaccacaggaactgtgcttgtggaaatggttgacaaaaacgggttctacttctctgacgagttctcgctcaccttccacatgcattattacaagcttctgaaatggctcgtgcttcttccaatgcttgggatgtttagcgttcttgtcatcctgcggccacaagaaggcgctccgttgccatcattttcaaggaatattgattagtgatttgcacagtgaaacgtcaggtcctcatagaagcagataagcagaacaagatattagcagatatccaatcacccatgaaggagcttgtccacatcatactgcatcggggagctcaatctgcacagaaaaaacccctcacgatgctgcatcccatcagttagctagttcgggaagtacagcttttagtcatgcaaaaagaattttgtcacacttgagattgttttctaacttatgatatttacacaaggaactggcagctgtctgatcctggtttaacatcttgagaattttagccccagatatgctatcaatctttcttgcaccatcatcctgactcctggaagatgctatgctctactgctatgtactactcccttcattccattttaagtgcagttatgggtttctttgttcaacgattgaccgtctatcttttttgatttttttatgattaatacttgtactattgttagatgataaaatatgaatagtactttatgcatgacttatttttttaattattttataaattttttaaattagatgaacggttaaacgttacatacggaaacccacgactgcacttaaaatgggacggagggataaacgttacatacggaaacccacaactgcacttaaaatgggacggagggagtaattggcagtgatcagcttgctatgattgtgattgaactcaacctgagatcattgaacataggtacataacatgatagatgcaagccttccaagaactgagaattttcaagttaactttacaaattacaaatgttcttacataatataatcaacctatagtacagaacaatctttctaactttcataagaaagattgttagacccaacccctcatattttgtattcacaaagcatggcggcatggtagcttaaagatgataaattaattaccaacaataattaattcatctcaaaatctcaacctaagtaggaacttaggatcacatcgttgcatgctaaactaccttaacccaatcggagctcctgtcttgagtcggcgccgcggcgacggcggcggcggcggcgggcgcgtcctgccggcggtggtattccctcctgaccgaccacagcgcctccgtgcaccgccgcatcgacggccgctccttcctcgccggcgcgacgcactgctcggcgagctccatcaccttctccaccgtcgccaccgacgccgggctcctcctgatcctggggtccatggccaccaccacctcccctcccctgaacctctgcaacgcctgcaatctcatcgcatcgctgtgagttttccatctcttgcggtgtgttcgtgcttgcgcgtgcgattggattggattggtttggcttggtttcttacccatttcgtggtggggcggggatcgaggtcgcggcggcgctcgatgggcgggcggccggtgacgagctcgacgaggaggacgccgaaggagtagacgtcgctcttgtcggtgagctcgtacgtgctcaggtactccgggtccacgtacccggcggcgctcttcccctgcgtgtcctccgactccgagctctcgccgccggccatccgcgccagcccgacgccggccagcttcgccgtcagcgtgtccgtcaggagcacgttcgatgaccggacgttccggtggatgatccgctgctctgcaaacggcgagtttcagtttagaattcagacttccacttctcatatcatcttcatatctctgaaatttcagagaatatatgtcacttacctttgaattcgtgcaggtatgtgatagcatgagctacgtcgatcgcgatgttgagccgttgcgcaagttctaaaccatttccacaggattctgcagtgtgttgcatttgcacaaatcctgatcaattcctcctactaggtactagaattatttcgaatagatagtaacagtggtactattacagactagaatcttcttggcattgtagtttactgcaactgaatgaatcgatcaggggcaaaacgtaccatctaagtgttcccttaaggaaccattgctgacatactcaacgacggtcaggctctcatcttcgcgctcaaagaatcctaggaacctcactagattcttatgatcaattttctgaagaatttcaagctctctccgaagctcagctgatgcatactgactgtttaactgttgcaacagaagacatggttactacttattaccaagtaccaatctccaacctacatacctcatgaaaaattgctgaatatgcgtattccctttgtttccatacctttctggcacatttgatggcaatttcagacccatccctgagcttccctctgtagatgctgctataacttccctgctttattatgttcttgtcactgaagtttgaggttgccttaaatatctctgcaactgtgagctctgtgctttcttggggataccctgtccctgctgcacttaaatttgtcatttctccattctgattttcacacggtgggggatattcatgtttatctagtgctaaaataaaagtaaattgcagtttttcacactaattgtttgctgcttgatatttccccttttaacaggtgacctaagtacagttaatctgcaattaaatttactctacttaaccagcaaaacaaccaagaactgaagaattggaaggcaccagaaggcagaattgctgggcaaattcctcgatagaggaatagttcttacctggatcaatcgagacttggtaacctgtacttctgctcccttgagaaatcgtcgtccgagaaatctcaagttcatcctcatttctggacttcctgggcacaaagcaactgaaaactccggcgagactctgcgccgccgccctgaacgagccgctgctgcgaaccgagctcctgctgatctctgaagatggaacgctgtaagaggaagcctgacgacggtagacctcaggagggcatgattggtatctctggtaagtaggcttgcaagaactgatccctgaaacttctttgccctggctggtggtgctgaactgcctcttggctgcaggcaattccatggcaagaagatcgagaggaaaaatttcttggtctgattattgcttcatcgtttttcctttggatgcataaatatggggacgatgacttggtgccgttcaatggcacaagcctttgctgagcgtgatgttgctgtcctggagctaggtcaacggtgtgctccgacgacctgcaggtcgctactatgtcgcttcccaattctttaattgttgatctggttggacggtatatatagtgataactgttttccattatctaaaaagtgatataattgttttctgtatagttgtgtaatcgtatgaattatgacgataaagtatattggttccagaattgtaactttttaattgaactattgaagttaggttgctgttcctggaagggttcacatctggtccgtggcatcacaagttcatacaggaagacgggaagaagtggaggactttctgtgatgtcatggtgtgattggtaaagatttaggtgccagaattggtcagattattagcggtctactcgctccgtcccaaaaaaagacaaaccctgggtttccgtgtccaactttgattgtccgtcttatatgaattttttttataattcgtattttcattgttgttagatgataaaacatgattaatattttatgcgtgacttgtctttttaattttttttcataattttttcaaataagacggacggtcaaacgttggacacggaaaccagagtttgtcttttttttggacggagggagcatgcagatgaaattgaatattgttatctaggatcaatcagtttaggataggaatgtatgacttggatttcgtgatgcaaggaaaaataaatagtactacctccgttttttaatagatgacgccattaactttttctcacatgtttgaccattcgtcttattcaaaatttttatgcaaatgtataagatataaatcacacttaaagtactatgagtgataaaataactcataacaaaataaattataattatgtaaattttttgaataagacgaatggtcaaacatatgagaaaaagtccacggcgttatctattaaaaaacggagggagtacaatattgtacctacgtgtccttgacaacaactcagcagaactccaaatgataccttgtactactgttatagaagttccataataaaagatcaaaatttggtagctgaaacaagaacaaagccttgtttagattccaacttttttcttcaaacttataactttttcgtcacatcgaactttcctacacatacaaactttcaacttttccgttacatcgttctaatttcttcaaacttctaattttgacgtaaactttcaattttggcgtggaactaaacactagccaagttcgttctgctagctaccgacaactttttacatagtaacaagaggtcttgtgataaaagaagtttttgttcattcgtctgctgaaatttcaatttaaaaattaattttccttattttctactacagttttcatattcaaacggttaggaatagagacgtaaaagtatttatcaaaagacatttctgattgcttcgattatttttgtagcgctcatccattgttttcctatatccagtcgatcaaacaaggacgctttgcatgagcctgaagaggtattagtacagtactacttgacgtttccttgtctttgaaatttcttcagaaacctgcatccgtctgcttccatggctgatctgctgcttatataggcacacccgcgcatgcatgtcatgcgtgaggacgcgctcctcttgaggccgccatagctttctttaatttgggtttggttcattgattggattgaattatccataaccaggaattactcgaagaacaacgtttctttactctttgcatacaacatcaccagagatacaagttattgacatatgccaaattgccaacggtttatgatgagataaccctcaatccagcaatgataaataccgcaaagtaccatcaccaggacaaaatttcataaatcagtttggaacaacatgcaggtagcaatccctgcaagaatgataccgagccaaattgaaaattccccaggacacttatgcttcagcaatatttgaatttaagatataagtgctatgtcaaaatgattccaaaatgatgaccaatacatctggccagttctgtaccaatttcccacatctttcattctctttcgtattatgcacttctctctcaaaagcgaagcaaaactcatgaatacatcacgcaactacacaaggtctctgtcatttacttcagtagactaattcatctcggcttgtattttttcctcgggtggtggtgaaacctacatccaggatcactggagaaccgtgactgtatctagtcagatatgtaatctgcaatagccgactactactgagtactgaaaagaaaagaaccacgtcgaattagacatcaaactcttctctgaattttctacttcctctgctacaaaaaatgacccaccatccaaattcttttgatacttctacttcctggacctgtcaaagaaaacagtggtaaaatataattatcacactagcaataataaaaagatcaacaaggattaaaattgcagcggaaaaagaacaattctgaactttcacaatgaactactgtttctatttaaaagaactttctgacaagaagtacatatgttaacaattaacgtgcacacgcatccagcattgtgcaaaaatgtgacagtcattttccaagaagttcaaaagtactggtacagcaatagctacagtgaccatccaccaatggaccctttgatatatttttttaaggaaactatgaactcttggattaattaaaagcaatagccagtgcccaacattattggtttcctaaaattccattgctgttacaagggagccaagaatccctctgttgacaggtcacagaaaccacaagtagaacaatattcagaatgtattttctttttctaaccttttcaaagatcccgagctcttcttcttctagggcttctgctgtttatagtaagtgaattagatgcaagctcgagtaacttttttcttacagatatgtcaaaggagaaaataaagtactagactaagataaaaaaaaaaagcatgtggaagccatatcccaaaacaagcagtaaaaacaacagatattcttatcgatactcgtcaatccactctagttcaaccaaataaactaaaatacataggatgcattagaaaaacattgcattttagttaatcttgttgaattagactagatcgacggctatccataaagtgactcgcgtccatccctactccatagagttcatctctacacaaccataagaaagctagacagaaaataaataatgaaaataagcacaataggaacaatgccttgtccacgtgagcataagctccactattacataactaatgaagaccgaccacagcaagaccgtcaaaacaaaaccacattcaacatcctaaattatggcggactccgttctgcgcagtcatcatatgaaaatggcagcaaaactgtaaaactaaacaacgcagcattctagaatactaattacaatcagctcgttactttatacacgtgacactatcataagtgttgaccctgaaaattgtgaaaaagtacagatataacaatgcagtaaaaacagaagatgcaagcaacaatttaacatactgatcagtggaattccagttgataacctttcataaacaacaatatgtcctaagaaaatcatgacacaacggaaggtgatattggaagctaaaaactgcatatctcactcaatcgtcacaaacatcgtacccaagaagtcacagactaaagtacgaaaagctgtcgaaactaacaaaagagacaccgatttctacagctacaaaaatcttagcccatgaaacaaagacaggtcgtcctagcatgcaagacatgagcagcaaactaatgaataggaaggaatcccacatgaagaaacatataagcaactgcaattccctaacagggcaaacccatgcaaaggtggcgagtacgagacaccaatatgttgcctcaattctacgttagattcatccaagattaacataggcaaaaggtccgatcaagaccaccaagaaactgcgtaatcaacaacagcatcccaagaactcaaatgtgccgaaccagaactggacgcgtgccgaaaagctcacctccaggtacggcgaggcggggtcatgggccggcgcctgcaggaccgcttcccgcatcgtcttcgcgctccggggtgtaccacagcgcccctgcacccgcgctccgcacccaactcagcgtggtagccgcggccaccctcggctcgttgtacggcgaggcggggtcatcggcggcgaggacggtgcgctctcggcgcgcacccaggatcacttcccgcatcggctgcacgtgggcgcgcgcgcgcccccgggtgttccacagcccccctgcgcccgcgctccgcgcccaactcagcgccatggccgcggccaccctcggctagttgtgcggcgaggtgaggtcatccggcgcgacgacggagagctctcggcgcacgtacaggaccggcttccgcatcgcctcctgctccgcagcgtccccgcgccccgaggtggtggtcccgcgccccgaggtggtggtccggcgctgcccctcggccgccttcctcaccgacaccgacacggccgtagtcctgaccggcgcggttgtgggcgacagcgacgacggccttgcttccgcggggtcagccgagacgcatcagcggtgcgcttgctcttctcggccgacgagggttgccccgatcccttggggatagccggagacttaccagcgctgcgcttgctctgcctcgcggttgtcgacgacggcgaggtctgccctgcttccacgggggtctccggagcctcaccagcgaggcgcttgctccgtctcgcggttttcgaggtcggccctgctgtcgcagccgccgggggatccggaggcgcaccagcgaggcgattgctccgcctcgcagttgtcggcgatggcgaggtcggccctgctgtcgcagccgcggggggatccgaaggcgcaccagcgaggcgattgctccgcatcgcggttgtcggcgacgacgaggtcggcggtgctgccacagccgcggggggatccggaggcgcaccagcgaggcgattgctccgccttgcggctgtcggcgacgacgaggtcggcgctgccgccgcagccccgggggtagcaggaggcgcaccagcgaggcgactgctccgcctcgcgttcgtcgacgatggccctgcttccgcggggtgatccggaggcgcaccagcgaggcgcttactccgcctcgcggttgtcggcgtcgacgacgaggtagccggaggcgcctcagcgccgcgcttgcccttcctgttccccggcgggccgcccggtggcttctggccggagccgccgggcgggaggtcggaacccttcatctcgggggcgctccgccggcgaggtgtttgcgggaatgcgcgggcgcggcaaggcgaggagaggagagggttttggcgctcggggttgggtatttccttgctccgccgaaatgttggtttgtttggtgggatgctttgcttcgtcggggtgtggggctcgttttgtgggggccacgtttagggagggggaacggcgtgacgtgactttctttcttgctttcacattttcttgtgtaggtcgtggatgccgctgacatgtgggcccaactgtcctcttatgtcagggtggcggtttacgggagaggatcacgttactcttgcgtctatgtatacgtagtagtaggagtaatatgctgtttttagatccaaagtttgtatccaaacttcagttcttttccatcacatcaacctgtcatacacacaacttttcagtcacatcatctttaatttcaaccaaaatctaaactttacgctgaactaaacacagtcatagttgcttgaaattagttgaaacattttaaggtggggttcttgatttggggggcttttaactattttccacttttagatttggcaaataactatttgccacccctatctcaatgacacgtgggtccacatgtgtctatgacatgtgggtccagtgtcaaaaagttaattgccacatctaaatgtggcaaatggttaaatatctcttaatttgggacatgagattctaaaataattagaggataccgcgctgctgcggaatatttgtattaaaataaaatttaaaaattcaagtacactttgtgtgataaaaaaaagtaagaaaagaagggaaatagaggctaaaattctggatgatattgtagcaacttttgcaaggaatataataatagcaatgcttcactttgagtacattgagagtttgagatctcatataaaacaccaccatagtgcttgacagaaaataggatcatatttaagcacggtgaacaaaataggataaggttaatggcaaagagcaagcttgttatctgttgcagaggtaagagttgagggcccctttaaatcgtaggattgagaaaacgtatgaataggaaaaacgtaggattttgataggaatgtaagtgtaaaacagaggattgcaaaacgcaagaaaaacacaggaatgaccgtttgattgaaccacaggagaaacacaggaattggatgagagatatagactcaaaggaaagttagcaagaggttgaagctcttgctaaatttcctccaaaatctctataggattgtccattccatagtaatttcaaaggattaaatatgattcaatcctttgtttcaaagggctttataagaaattttcctataggattaaaatcctctaaaggcccatttgaatcgtaggaatgaaaaaaacacaggaataggaaaaacacaggattctaacaggaatacaattgtaaaacagaggattacaaacacacaggaaaaacacaggaatagccgtttgattggaccataggaaaaacgcaggaatcggatgagagagatagactcaaaggaaatgttccaacaggttagacctcttgctaactttcctccaaaatgtgcataggattacacattccataggaattttaaaagattggatagtattcaatcctttatttcaaaggtcttcattggattttttttccataggattgaaatcctccaaaaatcctacattttcctacaaatcaaaggggccctaaaattctatgttttttctccaaatcaaaggggccctaaatggttttttatgtattttttctcaactactgtagcttgctattccgaaactcagtttattattgatcaaaagctaacttccaaatctatggggcaaggagaagaacaataagagctaacttccaaatccagagcctgaagaatcacacaaaaagaactctgaatgagagcaccgtgttgcatatatgataaaaaaaatctccatctaggtcattgcttcattgaatcatacagttgcctgtgtattctcatagagttgaccaaggatcaccatactttttgatatattgggaattatctgcaattattttttatcttactccctccgttttataatgtaagtcattctagtattcctacattaatattgatgttaatgaatctagacatatatatctatcttgattcattaacatcactatgaatgtgggaaatgttagaatgacttatattgtgaaacggaggaagtatcatttagtatctcaagtccgcaagataaatcatgtttacaaaatgagctgtatataaaatcattgattcactaaatgttgcttagtgataaaaattatttgtagtcatgtagtgcaaatactgttgtacagggaaaataaaaagggactgatttgggatactgaattcggttgaaaattgatatataattgaatcgaagaaattagtgtgactactcaattagcatcaatcaagatgtattataaaaagatttagctgaatggggaaagaacttacgctggaacatctgagatcagcaagcagtggaagtggaacaacccctttgttggccgagcagatcaatccagggatctgtgtatggaggagaagcttcttgctggtcgagcagatcgatccagcttgttggctgagaagatcgatccagctgctgtgtatatcatcatacataaataagatgggaaagaaaggccggagtaatgcaagcgaccgtttgaaaacatgaagaattgaagatgaatagacgggactaatttcttcgggcagtttaattcagtttcttgccctgtgcggccactgatgcttccgtttcttcatgcacacgcctaggaggcgaagaggttgggaggcgggtgcttgggggcgcgggaaggcagctgcggcacaggggtgcgacatcgcggggagaaggggaagtggcgactacagcgccggagccacgggaggcgatgcggccgtgaggcggggtccacctgtggcgttggtcgctccgagggcgctacggagatgcaatgaggatcctcgagatgtaatcgaacggctgagaactaaataatgacgtggcttaaccacagctcaggaaattgcacttagtggggatgacttgtacagatatataggattccatttctacaatctatgttacatccttaaataacttcatttatatcatactccctttatcctaatttaatcattatatttacaaacgacgctaagaccaagacaagaaaacattgttccttttaaaattaaacatcattgatcaaagtgttattctatacatgaatatgaggcatgcaatgatgccatttatcactgcacagataagcgaacaaacatacagcaatatcatttactcctacatacaaaacgaatagacatgaaacaatagtattttatttctacacatacaaacttatagacacaagttatataatgatcaatttggtaacacccaaaaaaatcttagaggatgatcaaattgggatgaaaagagtatctccttatccatcctcgagctatatttgcaagtgcaacttaaaggtatgtttggggcgggcttaagattttgagaagcagttgattgataaccagcttctgagaatctagaaaaactggattttccagcttctgacttttagtttattttctggattgtacaactataggttctcagaatctaaatcaaaagttatactatttatgggaacttctgattctaggtgaagctgtagcagttagaagctcccccaaacaagcccttagttgggttagtaaggccctctttgtttaggcttaggcttattggcttagacttttaagtcagcttattggcttatatgatttataagccagtgaatttaatatcctaagtttagtggtggagtcatacatctatctcatataagccaaaaaaaacttctccaacctagcttttggcttaatagtgtaagagtggcttatggcttcaaaaaagccaaacgaaaaagctgcttgtttgtttaggcttagacattttggcttataagttggcttataagcctaaacaaagaggacctaagtagcacggaaaatatagtggaatttatgtatagcaacttttagttatgaatctaaataatattttggaacggggagtattaattattataaacttaaagaacgaattatttattaaaaaaacttatgtatagtttttttttcataaaatgcacgtaccgtttaaccctttttatttgagaaatcgattttgaaatttaaaatttgattctcaaagaatgatttggtttttttttgtttctcttttgaaaagagaggcgaacaacgaatatgactgaaaaaaagccttaaaatcaatattaattgaacttctataattcattatcacccaaccaagtaggcactagataaatattttctttttaaaatagttaaaatgttttcatccctaacctctgccataaggcacatggccgataaaaaattaatgagatgtttgtatcgtcaatggtatcaaaatatttatttgtgatcgcagatttcgtatcgaacataaattacaagcattcatatgatgttggtttcctttaaaatgtgctgcacatttgccttaagattttcaaaaacaatttgaaaccccgataacaagcaaaggtatcctagagaatcacatttctacacatgttatggtgttgtgcatacatcttcggccttcaaagagttatgaaatgttatactgagcctctatcatggaccagaaaaaaggcaacatatgtgcacttgaaacgctgttacagacaccacccaatgtggttcaagtttcttcaggcaaaatcctggctcgtcattgcactcgactactgttactagtattgatgaataacacgaagtacaaactaatttgattaattttcctcatgaagcaacaaatcctgagaggaattccagtatgacatcatccaagagatcaccatgtaacatcctggctatatgccatcccaccatgttgatgccctcaccgaattccagccattctggatcaagaatcttgtcatcaggatgtgctacagcaagctcttcctgctgcctgaccattgtttgccatacaacctcaacaggtccttcagggccccaaacagggcagcaatttctactcaactttgcccacggatgcgtgtcgatgcatggtgcgaggatctcagaaagaacagaattcgcaagatcaaacagaagcctcctttgtggtcttggccatgtagcaaccttgctgtacttcccctcaagcttgtcgaagacatgaggaccaacaaggtaaccagaagattgccatgacttgaacaagagctgtgagtccgcgactatcacaccggagcttataagtatgtcaagtagataagagaattccttttcctcctcaacttcaaatgcttcaagagactggtcagaagaatcattgtcattgtcgctggacaaggatacttcttgctcatatcggagctcacagccatatatttgtttatcgatgcctgaggccaacataaaagattcaacaatcaatttagtgctctgaaagttcattgatcagaggcaatgaacatttcataactagtaaaacattcaactgggtagaaaattcctttttaagagtatgttaattacaaactaaattagttaaactaaaatccttttcagtgtatgctaattacaaactagttaaattaaagggctgaactttgaactttccaacttttaactcagtgatactacaaaagaaatttatcattagttagttaactagtcatatttactagatagcaaatgcctttctagagtatgttaatcacgaatgatgctccagtcatgtgctatagactacagaaatggtttagcttaatttcataaatatttgtatcaacttcaacattgttaggatagctgataaacgcagtacagacttctcctttgaagcaataaaattcttttatgaagaagggaatgtttctttgttccaaatggtgctggtctgtctcacttactaggcatgacttgcgagtcattttttaagtatccagaacaacaactgtcttcatcagttggaggctcaagaatagacactgggcttggtcggtcaacctctttcaagcttctacgagactttgccgcacaagtatgatcagaaatagttatggcttcatatacaccgcaatggaaaggcgatgctgaaacctgaaagggggagcactgggtgagtggtaaccacaaatttatgcatatagtatgacaacaccagacgttttaaggctccaaagatgtcaacaaatgaaaattggttaactcccagttcatcattatattggacaaaatgaaggctaagtaaggtattgcagtatgtacacaaaccaagtacttagtaccatactagaatagcacatgtccgcactcaagaaaaacttaaacaaagaagccatactattgataaagaagaaaaattaagaaaagagcaatgtctatgtttctgggttcacagtagagtgtactttcttaagtgcttactgctttgaaaaacataagaaagaagcgatctaatgttaaacaaaaaaaaggaaataagaaatgatacaggaacagcaattgaaccctttttaaaattaaaattagagtaaaaataaatgtttaagtttattaataacttcatagtagagcattcttgtcatttcagaaaattcatgatccttgaaataagaaaaataccatgaaagtacgccagattgaagcaaatttcccccaactaactctctttctgttttggattactgaaatgtaagggcctactgaccttttgttccccagataatcgtgatccaaacgaagaatgcactgtttcagtaggttttctcaacaagtcttcatctgttgtgaaaagtactttctcatttatgcaggcaaaagttgaaaagtcatcagttaaatgccatgagttgtttctggtattatcataagaagggaaagaagatctatgttgctccaaggtgtgatatcttgcacaagaagcattcctcaagtcatcttgggtgggacttgaaatttgctgccgtgttggtttatcccagaaagaatcgaagtgaaactgaccactgttgtgactaattgatgtatttgagaaaaaaatatcgtgaggggacctttcacaggaagaattcttgtccaacaaactgtgaggaggcaatcgaggtgcatgctttggcaacactataaagcatccttccttgtcattgttgttgccccggttaagtttattgtcttgaatctgcacatgtgagtctgaatccctcttcaacctctctgaatcagataaagcaaacatctctgcaagagtttttgaaccaatggcaccttcctcatacttgcggcggattttccagggtgagctatttgatgatgacctgttgctttttctggagttaacttcactgctaacacacttctgagatgatccagtgttatccgtatccactgtgttatattgatcaagtgatgaatcttgtcgctttaacagtgaatctacagcattgctagtcaagtgtctttctccttttattctaggcacattaatatctttagtgcctaaaagattttgcgaacccctgttcgtagtagaaaactcagcctgcttcatctttctcctgaaattcttattgacatcagagggttctggtgtagaaaaggcattacctgaatgttggacttcccctaagcctagctccagaacaacaatttctttaagtgaagagttacctaaaccaacagggtacttcctgaaagtacttgaagtactatctttctcatatcgataatttggggaacaattcacatcataggggtgcttctcaaacaaaggattatttatctctagcgagttcaagcgatcaaaaccatcttggttcactacattgttatcaaatgtttcatcgccgtagggagactttgatggcataagctttcttagctttaatgcacttcgcttcaagcttggcaaccctttagggaaattatgtgatctctctttcgtgacggcctcttgtggttcctctgacacttcgaatacatccttgaattcctggtgctgattgtgggctacataagcaggtggcaacacatcaagtcccatcagttttgcaatcacactaggtgatggtctcctgtgctccaattccttcaactgatccttcccgacaagtgttttggttggacagctgttatttcttcgtggcctgcactccttgtaccgatgctcaagctacaaaagttattaaaaacaaaaaaggatacatatttctcaatctttacttttgacatttcatcgcaagagcaatacaatgaaagagaaagaattaactcactgaaatctgttccatcttggagattactgtatggaggatcagttgagataaaatgttgctacatcatcccacaggtgaagagaacttctgcctacacatattcatggaacatttataaagttatgggggttctatacttctatacagagagaaaactaataaatgcgcataaattttcccttaactaatgaatgctcgcagagagcatcttgtgctgaactgaacatcacaaatcacaacacaacaaactgtcccaagaacatagagcgcactagatctccaagtacaacgccaatatttcttgcctaaagcaattcaattaaatcagtagtactagaacaaaaaaaataataataatatcatcaaaataataataatatcccataatggataatgcataccataacaaagtcctcaagatacacatagacccacccaactattgcatttaaacgcactttctacgcaatacgcatcaaaaggccagggacggacctaacgtggggctccccaatattattattattatgattattatatcttttgggaaacaaagtgctactattcctagacaggttaaggcaaaggaggaaaaaagaaaaaagcttccagatccagaggagatgcagaggttaatttaaacagggaaaaaaaaggttaggaccgtgtagaaagagagatgagaaagaggatgcctcacgcgtgggtgctcaatgcagcggcggaagaagatgccgccgccagtcgtcggagggagatcggcgcaggcggcggcgggcgagtcaaaatcgccagccgacgtggggacgggaggatcctcgtcgagtcgggaggggaggagaggggagtagtgagtgagtgttgttggcggtcccggtattcattcaattacggtctgaaaaaattaatgattcaggccgtgatcactcataattacggacgggatttggtggtagcactcgtaccagtagctgcccaattgcattaatgggtaaaaataaattcatcattttcctttctggcagaagggtaggaactaggaagacaagatgggccttagaataccattccagaaagtatattttgtctcccttaactatagcccgggtaagattaatgttccccaaccataaaaccaggtatttcatgcttccaattagtgaaactggtgcaaaaggagttttggaggcagtttcatcttacatggcttgttgactgtggcggagccagaataaaattatagcggggctaaaccaaagtggccaataaaaattgaaacatgtctcatataaattggctatatttctaatacatagtataaatatatagattagaattttaggaatattatgggggctctaatggtatattaggggtaggg

SEQ ID NO: 29257 - DNA, 39567 bp, Oryza sativa
cccccccccagcccccacgttgtctctgccgctgcttgttgacttgatccactcggctgagtcagcatgtgggcttacgtctcacccgttttgtgtttagagggcaagaatcatactcagatcatagtcgagagagcaaattaatgtctctcaatcacaaaaccgaatatttcacgatcccaactaatgaaaccggtgcaaaaggagtttttttttgagagctctccactttgagaacaagctgtagtaactgaacatacgtgcaaacgcactccaccacgcacacacactccacacacgcacccctacacgcatgctagacctatcaactatacacacatgtgctaatgagatacacaaagctacctaaggaccttgtgcgtgacgaggacgtcactctattattgtggcgttggcacgggagagctggaaatttatttgggaataaatcccggtgagacgcgcgggtatgatcccagggatcgaacccgcacgggctgctcgctcaccagcaatgctagccaaccgagcaacgctcggttctcagtgcaaaaggagttttgggggcggtttcatccgatatggctcgttgacttgatccactcagctgagttagcacgtggactcacgtctcacccatttttgcgcttagatgggaaacaatcatactgggatcatagttgagagagtcaaagtatactttatatttcctaccatcccgtcaggggacccaaaacacccggcccctccgactagatgtggcccaacccaactcgtggccacgtctcgccgtgcatttcagccgctcttgccgtgccacgcccactcccacccatttcacaggacgcgcgcggcgcgcaacggctggcctctcgcgcgacgcgaggcgcgcgccgatgccaacttggcgaggcgagcaacggggcgcgtggagttggtggcaatggaggcgtacgcgtggtgtggataagccgcttgtggccgcctcacacacccgctctcctccaccacacgccgcccaatcaccacctcatatacctcgcgatccctctcaccgccgatcgatcgagacgacgcatcacccatctcattctcatcatcgtcgcgtgagagagagctagagctgagctaagaatcatggcttcggtgggattcgggagcagagtggcggcggcgggcgtggcgccgtcggcgtcgtcgtcgtcggctgggcggaggcggccgtcgcgggtggcgatggcggtcggcgccacgagggggaagccggcgccggcggaggaggagaagagcctcgccgacttcatcttcggcttcatcttcaagaaggaccagctcgtcgagaccgacccgctgctcaacaaggtcgacggcgcgccgccctccggctccactgtctcccggaaggcccccgccaagaagcccgcggcgagcgccgccgacgaggaaggcggcggcggcggcttcaacctcggcgccctcttcgccaagaaaggctgaagaatcctttcgaattctacgtacgtatatactccaacgcagagcgtcagcttgcctacacgatcgatgtattaccctcctcctcatcaaacagtttgattcaaactccaagcttaatttggaggatgatttgcgtatacgtagcaacatgtgaggtgtgactcaaaagtgattaattttttatgtgaaaatgtggtttatatacttcatacaacacacatcatttgttatttcttttcaactcaacatggatgaatggattaaaagggttaagcctgctgatcatgttgtgttttgtctcacaaagcatatggtaaaagattgtgtatgttaacttagtgcctacgtgtgaggtgtggtccaaagtgatttttgacgtgataatgtggtatactacatcatttcttgttctttccaattcagtgtgaggaggattaaaagggttaaacctgaatacctgatgacattgttttttcttatcttacatacatatactccaatttggagtgaacttttctgtcaagaaaaaaaatagcaactttaggtgttggtatgaaactatgaatcaaataatctggagagttttgcacaaagattggcagcctcatcttcacatgatccctccggccggcctagagcccgcttgattggcgactcagattggaagcaccaagccttttcttttattttgcacaatttttttctgttcaacttcatgagcagacagattgcagagagttccaaccggtggctagttttgcagaatgctttctgcctcaccacaattatagaccaaaactgaacgcatacacaaagtgtgtaaccttatgaacaaggactatgcacaaaacccatgaatgatccaccaaaaaacaattgaacattgaccatatctctttacagtatataattgttgataggtaaagcggcagtgagacctcttcatgtcataaatacacattaggacatttttgcctttgcaaagaatatcccagcaaaaagacctgttaagtacaatcaggagacatgttatgtatacacacattcataaagaaaattagacagcaattcagcagtgatgaagcaagtactcaccaaaaattatgctaaacaaattttcaacactcactggtacgttgaaaagcaagataccagccaccgaaataggtatcttgttcagtgaaccaacaaggctgaaaacggaaaccaaataaaaaaaaatatcaacatgtagtcaactttgctggagtgacaactatgcaaatattattttaatgcaaatgcaaacatgttttattggcaacttgaaggaagagagttagtagtatcatatcacctgtaagttgttgggccagtccgatgtaaaaaccacacagatgagaagctaattgccagacctagcaaaccactagctgttgcaaaagcccagaacataggatctctagtaacttcactgcagatgagaggaaaacatcgtgtataagtacaaatggagaagcatggacaacaaccaattctgcctttgcagcaacagttacaggagaaatctaacatcagggttctcccctgatgtattcccgttaaaaaacaacatgtggaaacaacgaaaagttcattgatcatctaacttcatattcaagttgattgcaataggctgaagcttcatttatgagcaaaaacagaacatcttatttatcgaaacgaagccaagtttagaagcagagtagatgtacagcaagattttcatatgtccttttgtgttacttgcataactggtaaattttagggcagattacttttgaatggttaggttgggagtgaagattgagttcttacacttcataaacgtattgccattcgtcgaagataacaatcaaaatgagtgctaaaggtatggagagcgcattgttaagtaacaccatagaaacttcattgagggaaccggattttgttgattgtttggctacatccatcacacgtcttagtgtaagctgtaacaagaagtaggaaaattatgtacaacccatgtgactagtaggaggaacaagagaactgaaggattagaatacttcccaaaaaaaatctgctaagaagttcatcaatatattaattgtaaagaggcttgcaaagttgcaatatactgtggatgcaaaaactatgatcagaaaattcgactaaccgagtagcctgctgtcagaaagcaattgaaaagttgccacatgtagccaaccggatggaaagaaagatctgtaatccccccacatacagctgatataacctgcatagcacaacagagataagcacctgctcagttcaacaactatgctgttaaggtgtaaagttcttaatacaggccaacaattacataattagctaatatttggaagtaaacaagaggcacgtggagcagaaaaggacataccattagacacaaggcagcccaaacctttttgttctgacccttcctgaaaatatatatttctccaacagctgtcaaaatgtttgtcatgttctttaatatcgtcaccattgcaacatttatgtacttcaaactgaaaaaacaggaatatatagctctgttatactttgtgcaatatcataaaaataaagttcatttggattttggatattggagctttagggtgatggaccgattgtcatatatcatgtcgaagaattacgtacctgtacattccagttactaacatcccaacaaaaataagattcactggaatccagactttaatcaacttccatgtaagtttctccgttgaaatcacaccaaagagctcaagtaccagaagaattatcacgcttataagattctgagccacaaaaacagccatgatcagatcgatgatagaacttgtttgccaatgcaaccataacatcacaaatgcatatgaatgccgttatgtgtaagccactgaactaataaccaactcactgtgaatttgtgattacttcaatgtcggtttgtgattacgtcagagtgaatttgtgattacctggtacagcataagcgatatgccagcattgaaattatagttggagagtacaactttgttgagcaatatcatactgcaagaggcaatacagtaacaaatccccgagagtagaggtccagttttgtttccccacttgctttgctgcttctgaattaagctgtcaaaaacgtcagaagtcttcctcgacaacctggaaaatagcattcaaaacaatccaccagtcaatttctccttccttccatatgaagctgagacacaaagaaaacaagtagtactactaaattagattagattacttgttggaagccgctttcctggcgacattggcggcgaccttgatgatggagttgttcttctgcttgaggaagccgtggatgatcttgtagacggaggcgtcggcgttcttgactgcgacggcggcgacgctggtgttgggggacttggcctcctcgatgtcatcgtactcgggcctgtagtccagcgacatggacgccgcacctgcaaacgcgagagcagtcactcactcctcacagctcactcaccatgtcagacctgagatcgaacagcaagcgagccgccattgccgttacctggaagagatcctcggaagcagaggagggaagaacacggagatgatgagtcgatggggggagaggggaatgggaggagatgctaaaatggaggaagggggagatgcctttcgacggcatgaaggggcttggagacgacgcaaagaggatgaggcggtggaggccgcggggggtcaacggatcggggcgcggcggcgtgcggcggaagggaggccggagagaaagtcgcggggcggcgggagagccgaggaggagaaggtcaatttggcggcaatgggtggaggagaattgttggagtcaaacgcaagtcaagtgagacacctcaccctggagaattcacacactcatcacacgggtttgaccttgttattttagccttttagggtaagtacattgtttacattgttggcatatgattatggtgatgatagtatgtaacatgtccatctgaccatttcacatgtttcttcctctcgtgtaacgtgtaagtacatgtttttcatgtactttagagcgccgagaacgttttagctaattagctacatgtaaaatgagaaatataattaacttataattaattgagtattaatttttaaaacttaaaaataggttcatttgattgtttaaatcactttttatataaaaaattttctcacgaaatgtatcgtctagtagcctgaaaacatgttgacaacatgttgacagaatacgagcagtagctaagctcgattagctcttttgagtgcgctctaaattttttttgttatcatggtttagaatttcgggttttaaattgtaaacacgacaatatgtatagactatataggggaggatctcagtgtttccatcagttaaaaacctctattattcgtttgcgcatgtgtttgttcagcctctaaaaaatatttcgatcggtcactgtgcctacatgaagtttacacgcaaaatatagttgaaatggacaaagaaaacattcacttatttatcctgtttaggtaacttcactcgaatcattttacacggtgtttacttgtgaattaaaaagttaatccttcgtaaaaagctactacctccgtttttgcactttagatgtaatgaaagtaatttgatgctataagtcaaagttaaagagatgtgtagttcagggttcagaattccgataaaaatcggtcaagttccgtgaaatttcgaggtttcgacgatgctcaaaagtagaagccgtctaaaatttcgatgagtttcatccagatttaaatttgaattgataaaaaaaagaaaaataaataaataatataatattcgtaaaacctattaggatataaatttttgaaaaaaaaagatatattccatgtatttactaatttatagtaggaaagaaaagaacaacaaattaaaaaaaggaaatcactttcagttacctctcttttttccagttatcgattgaaatttcgatggtttcattcggaatttcgtcaaagccgaccggttttcgcaagcttatcgataaactcagtgtatttgcattcaaattttgatttatgaaatttgttcagaatctaccagcttctcattctgctagagcatgaaaaagaaggccatctcggaatcgtaaactggtgcagttgcatgaaagaaacggagggaatactgttgaaaaaatcgtaaaactagcaagacattttctgtccgttggatctgcaatcgacggccagacataggccaggtagctgacctccggacgggaaccgaccgaccttcctggtggtggatgttctagccaagaaccctaaaaaaaaaattccccatctcctcccaatctgattcctctcgagacggcggatccgagcaatctctccggcggaggcggcggcggcggcggctgacgagggaagatgaatcctctgacgcaggtgaagaggacgcaggtaatcaaccagaaggaagcgcttctgggcatcggcgaggacgggtcgtggcacgccaagttcaaggactccgcctacgtcttcgtcggcggcatcccctacgacctcaccgagggcgacctcctcgccgtgttcgcgcagtgagtagtaccagacccccccactttttatgtctatgttgctcttcgatcaatcatggatgcagcgcggaagatctgagcagtgtgtgctctctccctcaggtacggcgaggtggtcgatgtgaacctcgtgcgcgacaagggcaccggaaaatccaagggatttgcgtttcttgcgtacgaggaccagaggagcacgattcttgctgttggtgaggtttcttatcctcttatttttcacctaggtcgtttctgtatgtagctttttgtgcttgattccttatcgaattgaagtgctgatcatcttggtggtgtttgtgtaatggcgaagataatttgaatggagctaaagttcttgggaggattgtaagagttgatcatgtgagcaaatacaagaaaaaggaggaggaggatgaggaggagctgcagaagaagagggaggcccgtggcgtgtgctacgcgttccagaaaggcgaatgcaaccgtggagcttcctgcagatattcccatgatgagcaggtaggcttcctgcttgtgtattaaccaaattgttgtacattcactagaaaaggttgctgaacgaatcagaaatcactatcctacgtgtagggtgtagcactgtagctgtttgcattagccagcagaaacatatttctggatcagttattaggtagaaaatgggtaccgtgttgtttcactacaagttttttggggtaaatggaccaatgttttctcatggtgaggctatgctggaaagttacatttgcaagatgcaaggcctttagtaggttcttacatgactatgaaatcaaatatgatctactatttttagcagaatatttgacaaggcatatgttcttttttcttaattgttcctggactatgtcgtggtttgtaattgtagccaagacttatgtgcactttaattgattgagctgattgggaattctatagtggatatgtgaattaggaggaacatcattgtgtatgttgtacgctgttggaaatgcaagatcaatttcattttgtccaagatgcctagatacaactatatggtacagactatttccctgcaccagatttctgttgttttgcaagaaaaatacaatataggactgccattgtgcctttttataatgtagtatggaaatgttttccgttaatataggattgtcatagtttatgaatagcttcagtaattttactgtctcagtttatctgtctggtgactaacatggatgcacatgaactatattctatatatacctatacttgcagaggaatgcaaacactggttggggttctaaggaggagagcaaagcaagatgggagcatgacagacaccatgagccaccgatgagccacaagaagttcccttcgagtgctggggaacaaaggttccctgacagagctaaagaggagaacaaatcaactggcagggaagggcagtcctcaagatcggaggcatacaaagaccgtgattccaggcttaggcatagtgatagaggttcaaaagatcatgacaggtataggcatgatagatcacctgagagatcaagaggtgataggcagagaaacaatgacagatatgcccaaggaagagatgaaaaatcagaaaggtacagatctgaagtgaaacatgatgaaggagaccagaagcgatcaaggcgggacactgattctagtggacattatgaaaggaggggtaacgaagattcagaaaggtacaggaaatcacggagataaaatttggatttgttgttgcttcagacgttgttctgatctgttcgatgtttgttcttgtacgagatggataagatttttgtttgatccttgggtctgatattagtctaatagatgccatagattacatttgagatgattttgaacgcactggcccatagaccatagacgagtttgcaggatgttaactcaatacattaattaatcatttgtgatcaatgttaatacacttgtctgatgaatcagcagcttggagcctttttaagaaactttttttaaaaaagaaacttttgaatattgctgacgttacgaagagaacataacggcaatttccttctcttttgaaaatatgcatttgtagagcttgttcagttctttattttaaaaaaaaacttaccatttgttggtgaagtcaagatttaatgatgtgaagggtagtgtttagtttgacaccttatcaaattttagtatagttttgtgagtagaagtttctaaattactgaatataataatataggtagagattgggaaggttgtgatggtaaaatcatgtttagtttgctgtcttactaaaatttgatattgttggtgacactcaagaacacgttctacagctcatctccagctatcgcatcctgaacacaggttaaccagctgtcagacattccatctgctatacatttattgaatttattacgatggtttaatccaaagcagcgaaatcctacagcacaagggccggaatggtttctgctctactagaaagcaacagaacataaaacaaagctgtcctaaactgggtgatctttttttatctgaaaacctaagctggatgatctactcatctacgaatgtagactcggcaagatcgatggcacgagcaaggccagcagccttgttcaagcactcctgatgctcatcgtcaggcttgctgtcagcgacgatcccagctccagcctgaaggtgagccacccactcctgacgagcattcttgtcagtgtaggagtacatggtgtcgaagcgagatcccgtggggaagacgatggtacggagagcaagtgcgatgtccatgtctccacggaaagaaacccctccaaagccaccactgtacggcccacgcatcttcccttccatctggtcaatcagctccatcgctctcacctggttgaagacgaggatgagagattgagctcggtggaacatgaataatgcatggtagatgttactccctccgtttcagtttataagactttctagcattgtctacatccatatatatgttagtgaatctagacatatatatgtgtttagattcattaatatttatatgaatgtgtgcaatactataaagtcttataacctgaaacggaggaagtagatgaaacgaaggaaaggcagtggttaacaaactatggtcaacagtcatgtcaatatctgatgaatatgatggcgcatatagatatattgagttggcagagtgtttctcgttttctttctgaaacagcattcaggtgatgcaaccatacggtgccaacatgtatttccttacctttggtgcaccactaactgttccaacgggcaatgctgctcgaagagcatcccaacaagtcagatcatcacgcaactctccagtaacctacagaaatgcagaaacagaccttgtgagaactattaataagtaataacacagccatgacgaatcttagtagatatgacagtaagaaggatggttcctagctactagttactccaacaactgtacacaaacaatacttgattgtccaaggatattggatattgtcaaagctgtatatcatacaggtagacttactgttgagctaatgtgcatgacatgtgaatatcgttcaacgttcatcagtttctccacctttactgaacctggtttggacacctgaaaaaaaaaaggcaaaagtttatcacagatcagactagatgaagtcagaactcagaaatgtaatgaagccaattataatagcaacaggatgctcaacataaaaaatagagagtccaccttttctaattaaatcaggcctttgttatcactaatgcacagacctatttttctaccggatcttaaaataacgcattctattattctgttacctgttatgagggcgtcaaaaacagtagactctttagctgctctgcaaacctattgtttacataaaaatgcagcacataaactagtttaggtgagaataagacaagtgaatgacccttttttgtgtgtgtgtgtgtgttttgcgagtggacattgagacatttcttgtcacattctggtaataacatgataactatgctcctcggaagaaactagaccatcttagatagagaagcaagggtcatttacaatatcactgtattatagtgattgaaacaaaggcaggtgctgctataagttgtccaattgaataatattgttttttttttgtatgcagaaaacagaggaatggaattgattgagaacaaaacaaatgcatggaaaatcaaacctttccaacatcattccgtccaagatctactaacataatatgctcagcacactgctttccatcactcaacagcagttgttctaaaactttgtcttctgctttcgattttcctcttctaattgttccagcaagtggcctgttaacaattgtcctctggcagacagaaaattcactctgcattaatatttctagagaacttttacaggtgctacagttagggagatcatagtaccttcccttttggaaacacaaactgcaagaaatggatagttttaaaagggaattgcaaggagcagttctctgtttttggagaacaaagacacagaatagtaaacagttcagtatgggaagtccatttcagagtcactacacttgtttattattgttgttcttgcagaaaatcacacccaaagacccagtatttcatcagatactagaggttagtgcagataaagagactaaacacagaaagtgtctttgtcatggcacataagaagcaataattagatatgtgcatcccttagacaataatgtgttattcaattttgaaacttctcaagaggaataaaactaggagtgatggtatataaatactaattaggtgcctgttagctatggcatatcaaaaggaatactttaaacatcacatgcttctacccaacagaaagctagtcacagccctcattgcagtgtttcacctgagagatgccttttccgcatcacattaaaggactcactagttccttaccgcatcagccaactacacaaatttagaacttttggattcagtgttacatttacagctgaaccttccttataccaactatgggttttcatgtatcttttctgttcaaagatacaagttacatcacaatcattagatttagacggccacataacacatagaatagagtataagcccctacttcagcgtaccttttccacccgggtaagaatttcaggacttgatgctaccagaatacaaccacgagcctgtgacgatattataggatataaagcatgttgttcagcatgacacataatttaccataagaaatttcaacaggagtactgaaaatattcgtcacctgtagataggccatataaggactaggattgacaatacgcaatgcacggtacacctcaaaggggtcagcaaatgtccgcctctcaaaacgctggcttaagactacttgaaaaatgtcaccagctagaatgtgctcttttgcttgaacaacagctttcttatagtcctcccttgacattgatgatttctgtagtgctgacccaaattgcccaacgttaagttttacagaaccagcagtaagagttggcctacatataagttgattgaaatatgttagtgagaagcagaaatctaggacaaaataatagcactaatcaaaatggataaatggaaaatggaggttgatcagtcactgtaactcacacattaacactatgtaatcttgataacaaagcttccagctgattcttcccgtcctcatatgcttcgtcaactgactcatggcaatctaccctcacccaatgtataacatgtgttttctagaacaaacaaaacagaaaacgtgaagccgatggttacaagtaactatactcgtagttccaaaagtggtggttatagtagacacttagcaaaagctgaaaaaatgtgtcttattttttatggcgttaactatttcagaatttgttgttctctaaatgggccttgttcatttgtgaatagtaagagtctacataggttggtggtggtcaattatgaaatggtgaaattttgaatcaacaacagagggtggcataataataactaatcaaaattgaaaagtaatacaatgacataaaaaaaggaaaaaaaaattaccccatataagaacatgacataaacaaacagttgtaacggcatataaaagataaaaccagaaggcataactagcatacgttctttaacaatttaacctttacttcttaaagcatatttgtaagacaaaaggcaggatttgcggttcggatatgcttatgtctaaagtacaggatatatgattacctaaattacacacagttcataaaagtagtcagggtaattattcataccttttcaacatgatcaaacacaactatgtcattgtagaggcctaaatggatgtcaggaaggttcctatcatcctctggcgcgttagaaaatggaagcttctttgtttcaacataacgcactgtgtcgtaagagaagaatccaacccatcctcctgtaaaataaatcccaagatgcaacagaataaattatcatggctttagagggaatatatttgcaagaccactttgttagctgaaagaaaaagacaacaacgctgtacaaagccatataaatctcaactggctgatgtcgacaaccgtacaaagccgtacaaatccaaactgactgatgtatcattttcattgatctactagaataaaagcgatcggacaaaaagtactaaaacgaaacacgtgtaccagttggtttcggatgaaaatgggtccaagagaaccactcaatgatcaaccaccgtttatcgttatagcttttgtttttttgctgggacgtttaccgttattgcggttaccattatagcttcacagacaatcaccaacaagacaggtgcctactataagtagaaatgcaatatcacactattatagccaacaatcatcgcattctcattccaggattccagactaggacagataagttaccacaaaatgcatcagggaggccttcaacaatctgtgggttccactgttccataatgctccttggtatcttcatcgggtcaggcgcaaattgctccctcctagacttcatcttatgatccatgacagtcacatggttggccttggctacgatctccatcgcaggctgtgccccaaccacactgtacctcccctgcaaattatccaggaaaccctcataacactgttggaacaaaagggaacagattaagcggatgaaacagtaccacattggtgccctcggatccctgctcgacggactcaaacaggaagctgggcgcctcgcggtcgtcctccctgacgaggcagcggtacgcgagcaccggcgtgaggtggtcggagaagatgcatcgcttgagcggcaggatgttgcaaccctccgccgcccccgccttgaacttggactcctcctccctcaccgctgcggccacgagaacacacatttcaaatcaaaccaccaatccgcaaaccaagacatgcccccccacatttgatacggagactcaccgacggcgtcgagctgctggaacgtggcggcgcggcaggcgacggcccctcgtcggccgcggaatcgccccccgcccagccccagcggcggcgtggacggcgcgatgcgcagggagagcacgaggctggccataggtgggggataaactctactggaccgagccgttggtggggactagtgcagttgagagaatgcgggatcggggccgcatttaaataggtgcgcggcgcgccgcgcggaggcggcgaggggctcgggcgcggcgcggcgtgcgcgcgcggtgcggtgggacacgtcgcggccgagccgggcgtttcgccgagcaggtggtgggcgaggtcgcgtgcgcagccgccgtgccgctccaagactccagagaaagggattgagttagccgcggaataccagctacggttacctctgcttcttggaaaaagtaagggctttatttctaaagattattttttccttttctttttttcctttttgggacggatatgcttatccgccacgacattttgttgttgccaaatcactgaattaatcgtttcggggcagcaagataaacacgtgcaaactctgacacattatacattttttttgccacattatacggttcttttaacgactagataacacgaaatttatattgataaacatgaaaaagtttataagatcacaactatgagatatgagatatcgtaactagaaaaacgaaaaaaaaaaactatcacccacacactgatacctgaatacatacctgaatgaatgaagactagcatcggaccgatcgctgctatgtgtaaccggccgccgctaggccacccacattatacgtatattattttataaacacgtccaaataccattgtatcatgaagcgttgatggagaaatacaatgcattaaccagcaaagctttatcggtgacagtgacactcaatacaacagatagcataattatccacttctacaattcctaataacgtcttctcaatgaaagtgtgccactcaatgacaattatccagggtttattgggcccttctaatgggtgctcgatcgccagctatcacgctgggcgatcagttcatccccccctccccatatactcctccctcttctccctccttcctcctccccttcttctcttcctattacagtacaccacacaaattttttttaaaaaacaaaaagttagaaaaattcatgtatagaaatactctatataaaaaatttgaattcaaattcaaatttgaattgggtatgtaaacttttgacttataaactttgggtctataaactttaggtgtataaacttttagatgtatagaaatactatatatagaaaatatttgaatttaaatttgaatttgaattcaaattcaaatttgaatcggatatgtaaacttctgacttataaactttaggtctataaactttaggtgtataaactttagatgtatagaaatactatatataaaaaatatttgaattcaaattcaaatttaaatcggatatataaacttttggtctctaaacttcagatgtgtaaacttgagatgtataaattttaggtgtataaatttactaaaatagaaaaagtaatacggtaaaaaaaaaagaaaccatgtgcaggggtgaaggaaggaagggggaaggggatcgatcgctacccccatccccgtagcgatcgatcgtccatcagcattcctgggttttattagccgtaattaaatgttggtgctctaactcgtttaggcctcgtttagtctgaaagagatgctactgctgccgaagcaacatttcatggcccaagtaaggcccagtgagaacttgggctgcccatgtaaatttctgtttggggatatgggccgagccttgttgagtactctgtattttgggccgcatcttcgcgtcatgacatgaatggaacgatttttttttttgagaaatacgaagtcgaatgagcgaatcgctgatgtaaacaaggtagattagcttaacttgcacgatttggacgtggagcagaacaagcctttcaaaagggtagaaaaaaatttcacgaggcgtagaaaattactccagattgatcggatattctgctggccacgcatatgctgctcatctgacctttcgattgcctggtcattttcacagatacattttattcaatcttttgccgtgctagctgaattaactgcggacaaaagtaattaagttgcaatggacctctccttttagttttcttttaacaaggataccgtgacagccatgtggtttgtgcttgattaatgatgggtctcactcttcttttgcaagtatatgtttgtcggtcccttagaaaaacaaactaacgaacaattaaataattaagaacagtatgcctgcaccgactacacccctgattattggcatgcaccgttttggatgattggctcatattttctattacaacttgcttgccatgtgtagggtttagttttatatagctcttacaagaattgaactatttcatatgaaattacaacatttctggtgatttctagtctctacatcctctgtaaaaaaacaattctagctataaacctaccagagacacacgtgtcaggttcatagttagaattaagtttttctataagatggagcaagtctttgactgaacccattttaattccattggttatatgtggtgtttaaggggagaaaaggacgtataagtaaaccttaacagacaatagttacaaaagacttccaaatattgaataaaaaaagaacagggaatagttggtgtttcctactcctaatcattgtctttttactcaacaaatgctgatcagacaatctggaggaatcaaggagacgatgtttaattgtaatttaagaatagcatacatagctacttaaaaggcaagttacaaaaagacaaattctaactctcttttttagatgaaaattctaaaactctgttttttatatttcacaagtctaccaaacatgtggtttgtgagagatgaggcatcctggaatgaactgactatagtgtaatgttagaaaaatttcgaacaggtactcctacttgttacgcctctttctcaatgggaaaaaaaaatcgtacttgtcatgataagattccaaaaaaacacacagtcgtggcaaatcctaatctgcaatctgcaagtagatttttttttacataaatctgcaagtagatggttctaaggcaatctctcatctcatgactaaactttgacaagttgtattagtataatcgaaggttaaaaaaatgcagtatttgtaaaatccgaattaactaactgataaatactccatgaaaccaacacatggatgcgtgtggttgtcgcatagttccaatagaaaagagaaccccaagaaaaaaaaatctttagattcctgtaatagcatatgctttcccattaggtagagagagcaaaagagagaaccttctccgacactgctccccggaccccacagaccagtgaccccaccagtcagcgacacattcaccaacactcgtgggcccgcgttgcggtgaaccgtgaacgcagcgacccccactgactatgacactgggtcccacctgtcaggcggtaactgctttccaagtctaaagtccaacccccgcacgggtaggaaaggaaagaagaggagaggagacacgcaaaagcaaagcaaaccactcgccgaacaccaactcctcgccgccgccgccgaggaggaggaggagggagcgagcttgacgccggcgccatggcgggcgggggaggtagggagcggcgcggcggggggaggctgctcgtcggggtgctgctcctgacgctggtggtgtccgggcactgcctggagagcacgcaccaccgcgggctgaagcggcggcggcggaagcacgagatccactcgccgatcaagacggtggtggtggtggtgatggagaatcggagcttcgaccacatcctcgggtggctcagccgcacccgccccgacatcgacgggctcaacggcacgcaatccaaccgcctcaacgcctccgacccttcctccccggagatcttcgtcaccgacgaggccggctacgtcgactccgaccccggccacggcttcgaggacatccgcgagcagatcttcggctccgccgacacctccgccgtgccggcccccatgtccggcttcgcccagaacgcccgcgggatgggcctcggcatgccgcagaacgtcatgagcgggttcaagccggagtccgtgccggtctacgccgccctcgccgacgagttcgccgtgttcgaccggtggttcgcctccgtgcccacctccacccagcccaatcgcctctacgtccattccgcgacctcccatggcctcaccttcaatgcccgcaaggacctcatccatggcttcccgcagaagaccatcttcgatagcctcgaggagaacggcttgtcctttggcatctactaccagaacatcccggccacgctcttctaccagagcctccgccgcctcaagcacctcgtcaagttccaccagtacagcctcaagttcaagcttcacgccaagtggggaaagctgccgaattacgcggtgattgagcagaggtacttcgattgcgagatgttccctgcaaacgatgaccacccctcgcacgacgtagcgagggggcagaggttcgtcaaggaggtgtatgagacgctgcgagcgagtccgcagtggaacgagactgctctgatcatcacctatgatgagcatggtggattctatgaccatgtgcctacgccggttgtcggggttccacagcctgatggaattgttggccctgatccttactacttcaagtttgatcggcttggagtgcgcgtgccttctttccttatctcaccatggatcgagaagcgcactggtaagtacttgtgctgtttgcatctattccctttcaagaagttattccttgaattttgatgtctataagtaaagactattgattagcgaacttgttaagattagtctctgttagtatgaattttactgcaatattcgagggagaatttgtcattcattctccacagaaacattcatcgagtaacataggtgtgtaggctaggtaatatagaccgagcctttgagtttccatagtagataacatttcaaaaagttgcatatgaataaaaaagtgcaagacatttttagctaacttgttctatgtagcaaacatgagttctatgtttgctctttgcttgtaaagttgtacttgacaaaccaaggaacttgaacgttgaaccactgtaaggcacaactgtacaagcaaagagccaactagcatgtatcatgctgttttatgttggaagggccagttgtgccttacacaaccatagaaatattttaatggtgttctgttttgtatatctcttagtattaactggtcttgcttttcatttctgcagtgatccatgaaccaaatgggccgcaggactcctcacaatatgagcactcatccatccctgcaacagtaaagaagctatttaatttacattctaacttcctgacaaagagggatgcatgggctgggacctttgagaactacttcaaaatccggaaaacacccagaactgattgtccaggtatatagttttgtgttcattatgttattattagaagatatatgtactctactacaccaatgccattttgttgacgctgacaattatttagggaaagtatcacaaagttcagatattgtagagcattctgttctggaagctcccaatgcttacagttgcttatcaatgcagagttttggaacttagttaattattactgaaattgcattgcaacctaattatatatgttattgtttcctaacagagaaactcccagaggtcacaaagtctctgcaaccgtttggccctaaggaagattcatctctgtcagagtttcaagtggagttgattcagcttgcttctcagctcaatggtgaccatgtactcaacacctacccagatattggcaggactatgactgtgggtgaagcaaaccgctatgcagaggatgctgttgctagatttttggaagctggcaggattgctctaagagctggtgcaaatgaatctgctttggtcaccatgaggcctgcactcaccagcagagcctcaccgtcctctgatttatcatctgaactctgatggattgttctcagatttatccacaattctgcatcatgatttgcaccgcgtcagcttttggttgatgagaactcgtacaatgtgctaagaaaacataggtaggttggtgtacggcaaagtgtgctagtattatgtaattgatagatcttaaacatggctttgtacatagacatcatgatacttgatatctcaagcttttacttcagctgtcctctgataacgctgagatatcagctcagaagtatctgataagatcctactctggataagctggagagggaatttgtaaaccatcgatattcagctctgtacctgcttattcagcagttgaactgcacttctgatgaaatactttatgtacaccagttatagtggtattgaaagatttggcccgtatgaatgtatgatgtttgtaccagtttgcatctgttatttctagctttaaacaatctgtgcgttaatctgcccaactgtagtactgtactataggcatagtatgaactggttgttcaatgctgattttgtcagcttgtcaggtgaaaaattacaatccctcccttccaaaatataagaacctaaaattggatgggacattattcgtaatactgaaaaatgtcctattctatccagatccgtagtattaggaaatgtcatatccggtcctaggtttttatattttcggatgaatagagtactatattcctgaaaccatatggtattagggcccgtttagttccccaaatttttttcccaaaaacatcacatcgaatctttggacacatgcatgaagcattaaatatagataaaaaggaaaactaattgcacagttatgggggaaatcgcgagacgaatcttttaagcctaattagtctgtgattagctataagtgctacagtaacccacatgtgctaatgacggcttaattagtctcaaaagattcgtctcgcgattttcaggcgagttctaaaattagttttttcattcgtgtccgaaaaccccttccgacatccggtcaaacattcgatgtgacatccaaaaatttccttttccccaactaaacacacccttagattcttaatttcaacagttttagttgcttgcaatttaaaaaaaaatgaacttaggactgaacggcattgcttcttgctcatcaagtcaccagccaaacataacaaaaacgtgggatggaaaaccaagcaaaatctcaattgcaccttggctccagttgtacaactccagtacatccctgatgaacacaatgtcgagggaaaataaaagatgacacttgcaggctctgctgccaaatgtttctgttctggcagtcggaagagacattggctgggctggaagaggagttttgcattgttcaaaaagaaaaaaaaaagcatcaattgatcaatacatggccaagcgcatttgcctggtttctaatccatccataattctcgatgtatagcatttcagtgtttcaccatttctccacatataagaatgtgtacaggaaagcagtataaacccatcagcgacaaggggtgtatagaagataaattctcggtcaaaactaatgtcaacggaaaataagacgaaataccagtttcatgctctaccaaaaaaatccatgtttcctttccattttactggcgtgtgactgaatttaggccttcctctgttgccatttgagaaaattccattttactggcttgtgactgaatttatgcctttgttgccatttgagcaatctaaccctaatgatgatccactggattttcgctactgcttggtgtagatgaggtacacaagagcgcccagatgctgtacttccaggcctgccttttcgcattcttcgaagaagagggactggtccttgccaattcttctacggcagctcatcagaaaaatgggaaacttaacaggcacttgagttcctgcaagtggagaaactcactaaaggtattcttatgtaggcaatatgtacaagttagaagaatgcattatgtaggcagtacctgatttgttcgtgatggctgtactggcacttgaaccagcattctgactgcagcccttgtattctttcaggagaaaggataatgttctggttaggtttggatattgtttgacatctaaaagcagaagtgtatatcatattagcatacagcaccaaagtaaggtatgatgactcgagatattaacaatgaacacttacacaataaaatgtcactggcgataacaatgtcccaatctggtatgagaactggaaactgatctccccatgtatctgagggtacaaaagaaacaataggaatcaatttttcccttttggttggtgcatcttccctgcacctaaaaggcataattacaagtctagaagtacttagttttcttacgccggatatgaggaaggacacccaaatcattagctttgcagttgtaagctatattctcctggatctccccatcatcgtaatcagtggttgtgatgtctacttgaaatgccttccgcaggaagatggccaaagctcccgtcccactgaacagttaaatttacaccatttatcatgttaataatctttgagaaacagcctagttattatcaagacaggtatactgaatctcataggcaatacaatcacaatcaaactaactgcttagttaacttgcatactccctccgttccaaaatataagggattttgaccggatgtgacacacccaaccaaaatcccttatattttgggacggaggaagtacatcacaccgctacatcttggcagcatgataacatagatgtttaaattattatagcaggaaaaaaaagagagaaccattttcagatatagattaaatatatgatatatttattcattggttttctggtgacaactaacagaagtctaataaatagcccttcagtaatcacctagatatagaaaccactagccaaatgcttatcaatcagtatgagcagaaaggaaacaacacattttcatacagcaaggcatagcctccataccttcccaattccaggatccgccgtccatgcagaatcgatttattctttaccagccaatcagcaaataagaacgtcccaggccatagcatgttagcattcagctgatgacttgagaattcccttattttcagttcctgcatgccatttccaaaaggtgaacaaagagattgatatcctgcctgcaagcagtatgaaacaataatctacaatgtatgaagtactacataaggcagggatatcctgcctgtcacttcatgtacccttaactgatattgtgtggtagcacatagaatcgcaacaactattaaactatacaatacaaacatgagctccattacatgcagacaaaggcttatcttgaagagagaaccaaattatcttgggaaaatttaaacggtagttactatgctcctatacctttacaaaaacaaatcagctcaatcccaacaaagtaatagaatggactgctttgaactattcagcccataaaaaatgtaaaaagtttgacaagctattcatctacataacagaaaggccttgagagtgatagtatttaggccctttctactagtgcatctataggatgctcatccacagatagaaatttgattcccacaggcaaacagagatagcttgcctgttactttgttagcatcgagacacattaggccagtactggaaacagagacataaattaactagaatgcagctctatttggggggctcaatgatccttcaactttcaagtatcacaaatgccaaacaaataaatttcctacttgttcaattcatgtactacctgaatttttagatgatgcacaacagattatgataactagtaactaccacatctaatcttctttctgagatgcactgaagagttgggaaacctacacgagatgaaggcattgttggttccagcacttttagtttttcctttcaaccatcttctttattgaatttgctacaggcatgactcatggggataaagcttagcaatcaattatcaaactaacaaaataccaaggccgaatccagacatgataagaacaagccagttcttcacccaaaccgatctaccctgtctttacaagattaaaccctaaataaaccccagaaattctccaacaagtcaaaacatgtcccgttcatcaaatctaaccaacacaaccgaatcgcaaaatcggagcccccaaccactacagaaacacccgaaactagatctcaagacggcaagaacccaaccccgtaacacaccaaacactttcttgattccataacagcaaagattaccacgagttgcaataccaaaccagaattcaagaatcgctaagctcttaccatgccggggaacttgtgggctctttcctcgtactgcaccgactgcacctgctcatcggcgtccacctgcatctcatcttcagacgcgtcgcagcaaagaaccaaacaaacaaaaaaaaaacaagaaccaaagcgaggcggcggtcaggtggaggaggagcacgggggaggacgcgaagaggagaggggagagtaccctggtcgtcgtcggcgtcgcggaagagggaggcggcggagaagagggcggtctccatgggcgtaggcgtgggcgtgggcttgtgcagctttgggtctcgctgctcgtcttggctttgcaatgccctcttcctcgcggtcgcggggctccacgacatctcggtctccgagggcaacatcgacatttcctatctggttaactagtatctttattattatcttccgctaaataggagattactactactatcaatgtgcgatggtttgatactcctagagttagttttcttcgtttatttcttggtggcctacttgttcagatgttgcttgggatgggagattttgattttgtaaagtggaggcagcttcactttcatgattttgttctctacaaaaaaagctagttgaaaagaagtatgaatgaaactatgaaagaagctatccacgttttccagagtaacctgtgttctcatatccacaatcgagcttaaatagattataaattatattattttgtgtgtataagcctgtaagtgagccaaattatactgctagacttaaaaagtacaaaagaaaatgtttacataaaaatattccccctgtttttaaataactgacaacgtgtgctattcacagtttctctttcttttcttttcaaaatatttaccagcactgacgtgttattaaagtgtattatgtcctaaatataagcatgaaattttattagctatggtctaactatttaaaaaagtaattggtggtcaaagtttaaacggaaaagacaaattcatcagttatttgtaaatggacggagtgtataaaaatactttaaatgctcagatgcatgtgataggttgagtgtgtgcacgtgtatatggatatgttttgaaaagaaaaatcttagttactttcagccccatctttttgctaatgattacacttatcagctaaaatttgaatttttaactttaaatttggagttgatttttggttttttcatcgaagtttatctttcagccttcacttttagatcactaaaaacacatatataaaaggtttttattcacaaattatttttcgtttgcaaactattaacttattaactaggttaaaccccgcgcattgctgcgtgaatttagtatgataacaataaaaaaaatagcatgtaagatagctagataaagattaagtaaattaatgtggtttatgataatttaaatttaaatagtatgtagaatggtgattcaaacataaaaagtaaaatggtatgactttatggaaaaagaaaagtagggagatagtttggactgtagattaatcatttaaaggctaaaaacaattgtgtgatatgacttaattagaggaaaaaaagagaaagataatttggaccatagattaatcatttaagcactaattaactaagtgagaattaactatataagtatatagaatatcataaaacacaataaagatatacattaaaacattatgtgaattatgttggatgataatttaatatgtttgtatttgaaaagctctggaattataaaaaactataatgatataacatgtttgcatgatatttaaatgtgatgattgttagtagatgatgatgtggtatcttgttaattagtagatgatgatgtgacatcttgttagtggatgatgatgtgacatctttgcatgttaagtttaaagagttagtcggagataactttatagtaagatagataagccaaatgacggggggcctttgcaaacagactgaagttatctccgtacacgtacgcgcaaggaagagactggtggacccaaaaggccctccgtgggagagataggcttaacgaggctcaaatacacctaattaggctcaattggacccatcctaaacgagccccctaattagtatccttagcgaatacatggctcccatgagttgaatggtgaaatttcaggcccaaatctgacaattgcctatagaaaggaagcgcacgtatgcgtcttgcagtatcagaaattcaagagaactttctcaaaaacaggaaattcaagacaaaccagcacgtgacaatggcccaagaaagatcctgcaatatgcaaataccattacatggtagcttcttttttacacgctgtcttaacagcttttgcatacataggacgacatagcggtatatgtacatatacggatgcacgtatgtacatacactgatgcaaaatgacccaaagaacgcaaatttaatttactagtaccatcatatctctctctagtcctactctgctgtagcgtggggtaattatcaaacgtaatacgtactatgaacacacaccaagccaagccccacgtcactcgcactggctgatcgattgatcaatactactactaatttatgctatatgcgatggtcgaggggttgtggcgttgttcatgcgttgccggtggcgatccgggcgacgtggaactgcggcgcgtagttctgcgccttgccggcgatctcctcctgcggcggctcgttcaggaacgcccagttgctcctcgtccacctatccatccatcacatcatcagttcatgaattctcataaaaaactcaaaatataagcatttctaatttaaatttagacaactgtgagtttaaatttatagaaaaaactattatattttaagagggaagtagtatatagatactactgttgtgcgtaccagtcgtggctcttgctggggctctcggcggcggcggcgtcgtcgtggggaaagaagccctccacgcgagtcgccgggtcgatacggccgccgcgaggcgacgaggcgtgcgccttcgagcggctcaccggggccgaccgcgccatgccgccggcggcgggggagccgagcggcgagcccgacatcatctcgccgccgtgctgcttccagaacgcctccacctcctccctcgtcagcgacttgttcctcctcgcaagaactacacatatatccaaaaatcaaagtcatgagcaaatcatgcatggattgacacacatctgcaggtacgtaaatgaaaactacgtacctctgttctcatcgccaagaacgggtgaatcccatccagccatcagagaccccatcttttaattcactactcagagataatttctctgaatttggatcgatcgacaaagttggtctgatttgttatccagaaagaactgaagatgaaatcaagctgaagctactagcttgtatgattagttatcaactttaatttgcagatgcaaattgtagcgaatggataaacaacggagagagcagtgcagtgaatgatggctaggcatcgatccgatccagtcgttttatatacgcaattgacgcttgactttggagcgattaaagcggcactagtgcaggggcaaagcacacaggttttataaatcagagtggtttcatctccaaaaccttggactactgaatatgtcgttgtctggttcttgcccaacttaatctcgtggccttctcccagccgtccgattgtggttagcctttgatcggacggtgcgtgaccgagttaggaagcttaatcggggacgaaacatgatcgagtagccagctaggcccgtccaattaggtggtgtgtaagcagcaaggagacatgctcgtactgactgatcaataaacaaagttgctgggcctatctctccacgaaatatctatcgaactatctagccttttctgagcgagaaaaaaaatatctagcatggccttaattaaattcacggggttttggtttgattaggatgtgacgacgtgtacagtagtgaagtccagtggacggatagacttgacagtccatcgtgtagcctataaccgattgcaagttgtaaaaaaaagttgtaacatttattaacgactaaggataaattatgagcaaaactataataataatatttaatactatttttgtttttaatataggacattgttgattttacatttatcttatttaaaaatatgtaattactattttttcctgtaagttatttataaaaaactctaaacatgatttatatcttatatatgcatttgcacaaaaataaaataataagaatggttagatgggtgaggcaaactaaaagtgttatctataaaaagggaaagagtatatgtgttattgacgactaattaagttcatgctacaaaataaataacgatatcaaaattaactttagaattaatatttagttttaaaattttgattgtgatcataatctgaaaatggaaaagatatactccctccgtttcaaaatgtttgacaccgttgactttatagtacgtgtttgaccatttatcttattcaaaaaatttaagtaattatttatttttttatatcatttgatttattgttaaatatacttcatgtacacatataattttacgtatttcataatttttttaataagacaaacggtcaaacatatgttaaaaagtcaacggtgtcaaacattttgaagcttaggagtacaaagtacagcgatggatggataggcgttatccgttgctgccgtgccggaggggcacacacgtcgctgcgtcagtggctacgcggcctcgtcatcctgtgctcgatcaataatctccagaagccgctggttaattacttaattagcagtgcgggttaaggtcgttcttatctgttagcttcccaggtgcatgcactagctgtctaccactgtagcacgtacgacaatgggttagtatatatgcggcacagctagctaagaatatgggcctttttgtttttactcggtgtaagatcgaattgatctgggttgtgcacggacactgttttatagcgtggcacgagtctatttgctggataatttgggactcacatctgtcacagaggcagtcaggcagtacgtacgtagtaggagagtataaattgggagtaccccatccttaaaaaaaaatttaatcgtaactataaacctggacacatgcgtgtctaaatttattgttaggattggctttttttagggagtagtacttgtggacaagactcggcaagtgattatatcgattgaaatttttcggttttctcaaattttaaagaatttggtcaaattatgttaaaatttaaaaaaatcagtaaaaaagtgttaaaaataccgaaattctggccattttggctctaccgaaatcaaaattgaaaaccctgatagagagtattgaaatgtaagcccctaggccatggctagggaataattaacctcttatataatactagcctcaatatctcgtgctaaaagaaaatatttaccatatggccaaatagcgtatgcctatatatactactagtactcatttagaattttattctaatttttcacctggtccccactgaaactctcctttgggatactatttttatcttttcatccatgttacgcccgtcttatatatatatcagatgagatgaaaagacacaaattaccataaggacccacatgtcaactccctgcacactcttcttccttccccattctccttcttcactcatatgtacagcatctcttaaaactagcttaagattaaattcttaataatatataatatcacattaattcgagctacacatggagagaaaaggactacgtaataatgaatccaattgtgaaatcaagccaacgttgtatatactttttctccttatgcgtacgttcattgaatttttgacattatattgcacgtttacgaagagatttatatctattatatactaaaaattcattaaacttcttacaaacgcttctaagccgccacgtggtatcctataaacgctactaagtcgtcacgtagcactataatttagaaaaatttataaaaattctctagccattgattttcattaaattaggtggacccattatttaccaccattagatttatcttttaaaaaattgcctaacccccaaaccgagtccaccatgggccgtacgtattactatatgtatacatacgtatttttaaggatagtacgtacgtacgtacttccatcccttccctcaatttcttcatatttttgcacacatttattctcctattatcatactttattagttagaaaaaaaactcttgtgctgaacaattccacaactataacatctaaaaatcataccacaaatttttaatccgccattgacaatatagtttaactggcttacttattgataaaattatggttcacgttcaccttgaagagcacgactatatcatgggacacatgaataaggcattagagaaaactccttagcggctatagtcggcttcacccgattgtcagaggagcattcatatacaagtttaattgttttatcctattaattggtagaagcggtatttttaaatatttatatataaatttggacatctgtgagacatgggcacttgggtatgatgtggagattaactttttatggtattaatgatgtatttggtttatttttttgatacaactgcaattctatctattaaaacgatactcatgtttcaagacaataaaaataagttgtggtgaatgccgaatttatatataatcgggataaagtgatttttggttggatatgataaccattctgatcatttagtacatatcaaaatctatggtctatttattatagtgaatatggtgagatattgcttcttttagtattgtttttatagataaaaaataaattgcccgcgcatctgcgcgggcatccgtcctagttgtataaatttaatttcgacacttttagtaaatatttagacggcatatacacatgaaataaatacaattgccatttgagatataatccaaaatagtttctggacctacagtacgtgttccctcgctcatattattgctgggagtaggggtgaaaacggtatgaaaatttccgagattttcggttgccgtttccagtttacactgaccgtttcagtaaccgacagtggtggaaatggaaacggtaatatcttctggaaatggtagcgggaatgggatggaggtttttccgaccgtttttgtcggtaaccgtatttgtatggtaatttccatcaaaattccggaaaaaatccgaaagttctccagcgactcagcctggccaacccatcgaaagcccatgaatgaagtctggtaggcttgcaatccataaaaaaaggagaagtgaccaggaaaaatgttgttaaccctatgacatggcatgtggattttgctgaactttggtctcctcgagttatcgatgttgaagtattgtagaactttgtttatattgttcgtcaagcttattatcctatcattaaccatcatataataatgttatgtggagtgtgatgatgcaagaataatattaaagacatttacgtgcatagttaaatgtgtgctatgccacactccgctgattccgacatgaatttcgactttccgatataccgatattactgatcgttaccgttttcgagtctaccgttccgatttcgttttcaagaaaaatatctgaaaatgaaaatggtatatggtttttccgaccgttttcatccctagttgggagaagaggaaaaaaaaagaatgaacagtgtaacacagttgaaacagtgcaaatgatttttagttttttacatatatatatatatatatcatacattaagaagtcacagaactactcacacacacacacacaaagtacagtcttaacacaattaactatctatataggagagactagagagagtatatacatgagcagtatctgtatttacacggagagctgaaggattaaaagctctcgaacgccggcccgatcctatacacttctctactgctctttgtatagtaatattctacacatacaaattgcatgcgtacttaaccactactacagaacacactactctcttagaggatcaggacgatgcagagctgcaaagctaagctagctagctaaccagcctaagtactaacgtatatacgtacgtacatacgtacatgcatatgcattccctgacatgtggctagctataactagctgaggcctaggcgttgccggtgacgacccgggagacgtggaactgaacgcaggcgtacgtctgcgacttgccgaacatctgctgctccggcgacggcgtctcgttcaggaatgcccagctgctccgtgtccacctataccaaattaacatcgtataatcaattaattattggccggtgaaacatcagctgttaattaaataaatttaagtatacgtaccagcactcgctgctggtgctggcgacgtcgtcgtcgtcgtcgtcatgatcggcagcgaacgacgaccgctgatgacgatggtcgccggcgtgaggagccgccggcgacggcggctcgctgtgggagtacgactggtacgggtgatcgtcggccctcgtcatgacggtgcgcgccagcggtgacggcatggagttcatcctctccagcctcctcaacgccaacgtgcaacgactactactcatctcctgctgctgcatgagagaattaattatattaattgattaattcagtccaagaatatatcgatgcatgtttaattagtttaattacataccgcgcggccgggagaggcggcgagcggcgagatgtcgccggcggcgcggggtgatgcgagcggcgagacgacgttggcggcggcgcggggagaggcgagcggcgaggtggtggcgttgggctccgacgacgtcgacgacgacggtggctgcttccgttgctggcgcctccagaacgcgtccacctcctccctggtcagcgagcggttcctcatcagccgaactatactcaacaaaaacagatcaaattaattaattacagatcgattgaccgatcaatacatattgaattatttgtgtgggtatatataactaaggaaataatcttcccattcagttcgttatcgtcgatcgatcatattgttaatttgttgcatgtacctttcttctcatcaccaagaactggtgagttccagccagccatcagagaacccatctctgataggagtattcaattctcaggtcgagatggacaaagaaagtgatggatgagaaatgatgatagagatgatgatcagccccagtggatctgtaccgttttataggcgctcgcgcatacacatccagtgttggggctcgctccactaggagctgatggagcaacaagtgagctgtagcacacaggttgaactgaaaacctgcggcgtacgtgcagctagctatactcgtagcactgatcgcctaatttggcaatcgtatcgatcgcaacgacgatatatacgtgcaggtgcgcataggtacgtgcactgagcaaatccatatcacttactcgatccgttctaaaatatatgaaacacatggtagtactgtccaaattcatagtaataataatatgatgtgatgtctatctatatctgttaattattatatatgactgctgttacgtttttttttataacgaaccgctgttagacagtgcacgtagatatgaattgtacagtaactaagccagatatagataacacggtgacgaagttgtaacaaaaaaagagcgatacgtgcattgcatgcaacgacgcaagctggagggggccaaatgaatgcatgcatgtatgtttgtgcagagaggttggttgtgacgatatgggatcgcgcgcgcgcgccgagtagagtggagtggataggcttgagctggattagcttagcgcgcggccggtcgcgcgcagcgatcgatcgatcgtcgttatcccgaggtggcagcggcagctagctagtgcgcgtgagcgtgcgcgcgcgtggcgtaagaccctgcagattacgacgagacgagacgacgtctctgtgcacctggagagccccatgccggccggtgccccggcacatggcggcgcgccactggttgggttagcgtcacgcgtcacgtcacccgttggcgccgttcttatcgatcagctaggagcccgtaccataccgggccgggccggacaggacggcccgcgcgcgcgcctatcgtatactagttgtgttgtgtagtacgtacgtgttcagtgcaacggtgcaagacgccaactaagggcgaaaacgctaatccgccaccagtcgcgcgactggacacgtgttgcgcgtggagagaaacggcggacggcgcgtgtacggtattctttttttttgtttttttcttcctgcgcgtgtacggtttcttttttttttccgttttttctgttttcttccgtatttttggtttctttttcctttgttttcgtttttttgttttctcccgtatttttggtttctttttctttttttcttttttatcgttttcagtttttttcggtttttataaagtttgtatacgtgtatataaagtttgtatatgtgtacataaagtttgtatacatgtatataaactttatatacgtttatttttttgatttttatatgtatgtgtacaaagtttgtatacacatatataaagtttatatacaggtatacaaagtttatatacacgtatacaaagtttgtatacgtgtacataaagtttgtatacgtgtatacgaatatacgtgatgttttttttatattttttaatatgtacgtatataaagtttgtacacattgtatataaagtctgtatacatcatatataaagtttatacacgttgtatacaaagagtttgtatgtgtgtatttttttatacataaaaaatatacatataaatatataaataaataaataaataaataaataaataaatatataaatatatatatatatatatatatatatatatatataatactagtagtagtatagaagtagtagtactagtaatagtagtatagtagtagttatagtagtagactactagtagtactaagagagtagtactgtagtaccagtgggggctggtcatgcgcctgggggccgcgcgactagtcacggattagcccccccccccgggggcccctttgaatcgcagggttgaaaaatagaggaataggaaaaacacatgattctgatagaaattgaagtgtaaaacagaagattgcaaaatacagaaaaaacatgaatgatcgtttgattggaacgcaggaaaaacacaggaatcggatgagagagatagactcaaaggaaattttccaagaggttggagctcttgttatatttcctccaaaatccacatgcaatgtgccattccataggaatttcatgggatttgaaaatcgtcaatcctttgaatcaaatggccaaataggaaaatttcgtataggatttgaatcctatgaaaatcctatataaatcctttgattcaaagggccctaagtttcgtacgtgtgcaactgtgcatccagcacgtactactacgtactcctatgtacttgtagtggtgtagcctatacatatgcatgaagcgttccaggaaaaataggagtctcagtaatttgtgcaggcatgcggcccatggagtaatagaccatgctgaataatttcagttcaaatttcatactccaactgtaataccatacgcaaaccatcaacttacaatactgatatacttgacatttcaaaataacatagcctttggttttagctgacgtagcgactgagtaagctagcacgaggctcatatgggtcccacatgtcagcggcccaatcttcttccacatctctcctctcttcccaatcctaatctctctccatgcctctagggtggtgggggtgggaagaagctcgacagcggtggccaacacatacgcaaggagaagctcgaggactgcaagacgactttcttttcgcctaccactggaaggcaacaccttgtttccctgccttctagttgagcgaggacactgaatgcatggaggtgttgtgacccaaatctacggcagaatccctcgccggaagttcgccggagatctagcagagaagaggcgagaagaacagggtagaaaggggaaacacgaggaagcagctggggaggaggatatttttcatttctttcatgaattgttttctcaatacagctggagtatatatactcacgcactccacccctcttgcccttagggcccaccttgtcatagacacttctatctataaagagtagaagatgtattcacttctgaaaagcgtcaatgtagaatacgccttcaccctgttgctcgccattgccgacacgctgatcgcttcacacatcagtcgtgacattcgcccctccttgagtcggagcttggccccaagcgacggcagatggaaacctggtgtgcaccacatcgaagtcctcccaggtcgccaaagcagcaggcaaagtaccccactgaaccaaaacttgaaaaacggcagcattgccctttttcaccatgtggcgatccaaaattgccgtaggcaccaactctgcaatgtccaactgagcagcagacgacaattgagaaaacactggagaatacttgggaacatacttcttcaactgagagacatggaaaaccggatgaattaaactaccagccggcaacttcaaacgataagtcatcgagccaacagatgcttcaatctcaaaaggaccaaagtacttaaacgccagtttaggaaatggtctggacacaacagacttatatgcatacggttgtaacttaagaagtactgacttcccaacttgaaaagcacgatctgagcatttgacatcagccatttgcttcattctattttgagcacgagccaaatgatgtttaagcaaagcagaaaacatatctctttcctttaggactgcatcagcttcagatgagtcagaaacatcatcctcagattcagtcacgggaacagccggcaatatcccataagttggctcactcccatataaagttcgatgaggagaacactgcaaagaagagtgatagctagtattgtaccaatactgagcaagagacagccatgcacaccacttagttggaactgcagcaactgcacagcgtaaatacatctccaaacattgattcacacgctccgtctggccatcggattgtggatgataagcagtggtcaaattcaaaggaatctcaaaccttttaaacagagtttgccaaaacttgctagtaaaaatcttgtctctatcggacacaatagacttaggcatgccatataatgccgcaacatgagtcaaataagcttcagccacttgtaatgcagtgaaagtgtcaattaggcctaaaggggggggggttgaataagctaattcaaaaattcaattaaaagcggaagcagtaattttcggatatttccgaaattttcgaatatatccaaaaattttcggagtcagcactgaaagtgcatctaggcccctaatgattttggtgattaattacaatgcgattagagaggactaacatttttatttaagcaaatgtgaagtttgttatgttctcaatgagttaccgtaatgcatatcccgccaaatacgttgatgtgatgtgatgcggcaaaggagcaaatggtatattgtaacttttcttttcatttgagtcaataggaatgccgcactattaagagggatgatgcattgacatatgaggagtgatcaaagtgctcaaaatctttttttaaaagtgtttcccctcagtttgatatgttctggaaatttttggagttttccgaaagtcattttcggactttccgaaaatgcacagaaccaattttcgcttctggaaattttcggatatgtccgaaagacattttcggacttcccgaaaatgactgtgaaggcaaatgtggttctgtttagtttcgtacttttccgaaattgattttcggagtttccgaaaacttcagcaaaggcaaaaatcgcttctgtgtattttcggacttgtccgaaagtgattttcggacttttccgaaaacatccagaaccatgttttggtggtggaaatttttggacttatccaaaaaattttcggaatgtctgaaaaatctttcgttgactttgctgtggtgctgagctggaaatttcgacaagtccgaaaattttcggaatatccgaaaaatctcattattgtgcataacggcagaatttggctgtggcaaaaatagccccctcccc

SEQ ID NO: 29258 - DNA, 7493 bp, Oryza sativa
tttgtgaaggttggatctcacctccgaaagggaagagatacctttagtggaaggaggagtgcttagtgcaacctcttgaggaaagggttagctaagacccggctcttagtgagctcctcaacggagagtagaatcccctcaaggattcgaactttgagaagaacttcttgagcttcatctttggtgactttacttcctccctctccactagctttgcttgtttgagccgctataggtctagtggctgtttgtgctagcatattcttgttgtaggctcatccaacatggtcctcgccatctcaatgagagtcctattcttcctctcggctactccattttgttgagatgaatatggagccgagaactcgtgcttgatgccttcttcatcaaggaaactctcgatgcacgtgttcttgaactccttgccattgtcgtttcgaatgttcttgatcttgaggtcgaactcgttttgtgctcttcttgcaaacttcttgaagatagtttgtgtctcactcttgtcatgcaaaaagaacacccacgtgaagcgtgaaaagtcatcaacaataacaagaccatatttgttacctccaatgcttagataagcaattggtccgaagaggtccatgtggagaagctccaatggtcttgtagttgtcatcacattcttgtcgggcgatgtgctctaatttgtttgccggcttgacatgcactacacaccctatctttctcaaattgaacatttgttagtccaaggatgtgatcgtgctttagaagcttgtgaagattcctcataccaacatgggctagcctccgatgccaaagccactccgtgttggacttagccactaagcatgtctcatgtttggctttacttgaggaaaaatccacaaggtaaagctttcccttgagaacacccttaaagactaccgaggaatcattccttctatagacggtcacatccacatcggtaaaaagataattgtaacccatagaacataattgagaaacggacaaaagattgtagtttagagattttaccaagagagcgttggcaatggaaagatcattagagattgcaatcttacccaatcccataacatttccctttccatcgtccctaaagactatgttatcttgtgaagtgccatttggatcaagagttgaaaatattgattcttctccggtcatgtgattggtgcatccactatcaatcacccaacttcttccaccggagacatattcctacaagagatcaatttctagttttaggtacccatacttgcttgagtcctctcatgttagtaacaagtgccttaggcacccaaagtactctcttgatagaaatattcttgccccttagactaacatacttagcaacaacacgaccactagcattcttcctaagaacataagatgcatcaaaagaacaatgtgaagcataatcattaggaaggatacttttggccttaacaaaattgctaagaccttggggcctcttgatcatcacactcttgtccacctttccttttggtggaggaacatacctaagaccctcatggttgaagttgtccctttgatagcctaggtactcctttagggtcttactacccatatgccacttaagtaggccattgtgaaggagtcccataagcttctcattttgcttttgcaaagcactcaaagaaatagagttagtagcataagcttcaatatcaatatctttgcatctcacacatggttcattgcttgggacaattttggaacaagatggctcgctagggagagagacactattctttaaggtttcgaacttctcttcaagagtgaggtatgctttgtccaagccatccactctctcttgaagttgagtgttcgccacctcaagattagcatgagactctttggtttgcttgtaaagccgtaccaatgcctcatttttttctctctctccttagcaagctcactcttgagttcatgggaccgctctttctcacgaatgagcaaagcctcttgcctctcaagagttgcatattggtcttcaattctcccaagcaactcactcaagtgtggtagggattccttagttatggacttgaacaattcatcatccataacctcatcctcctcatcactaacaagatcaacattaaatgacttgagaggagaaggtaccttaggctcctttgccatgaggtaaacgggagcatcctcatcacttgagtagtcgaagagtctcggtggtgatgaaggcttgacggcgaacgtggcgactccttcttcatcacttgagcttgactcggagtcagagccgtagatcatcccaaagtgagcttggccataatgtaccctcttgctatgcttgtgcttctccttcttctcatccttcttctcactcttcttcttatcttccttgatgtgggaaccatccttgaggtgagggcaatccgcaatgaagtgcccgagctctttgcacacgtagcacactcttgcggagtgtcttccacttgacttgttggagtagtgcttggaagatcctcccttgaagaagccgcttcgcctcatgaacttgccgaacttcttgatggctctcttcatcatcggtctccaccttgctcttacacttgcggttctcttcttcttcttccattgccttcaaagccaagtcatccttcttgatgcttgcagttgagctttggttgatgtattggatgacatccttggactcttgcacgagcatgtcatgggcaaggatgcgtccgagcaaatcatgaggtgtgagagtcttgtagtccggacgctcacgaatgatggtcaccaaggtagagtttcttggagtgattgctcgaaccatcttcttgaccacaacctcatcggtcatgtccttggagccaagtccttgatctcattgacgatcttgctcaaccggtcgtacatgtcgcttgggctctcaccatccaacatcacaaatctctcaaattgcccctttaggatctccaccttggactcacgaacactatccgtgccttcatgcaagttccgaagcgtgtcccaaatcactttgtcactctcaatgccatccacacggttgaactcacttccactcaatgcgctaagtattgcattagcggcttgagcgttcttgtgctcgttctcgtcgtcctccttggtgggatcttcgggattctgcaaaacatagcatttttcgactattctccaaatagatgagttaatagacttcaaatgcatcttcatcttatgcttccaagcggcatagtccgtaccattgaagtacggagctttgccactataggtactcacataagatgtagatgtagggggatagtcataagggatcttagctcccttatcactatcgatcccctcccccgcttggcccgacatgatctctctaagcggttaagcctaattaggagattaggctctgataccaattgaaagtgtcaattaggcctagaggggggtgaataggctaattcaaaaattcaattaaaagcggaagcagtaattttcggatatttccgaaattttcggatatatccgaaaattttcggagtcagcacaaatagcaaagtaaatcctagatctagttgcctacaacaagaatatgctagcacaaacaacaactagacctatagcggctcaaacaagcaaagctagtggagagagaggaagtaagtcaccaaagatgaagctcacgaagttgttcccgaagttcgaatccttgaggggattctactctccgttgaggagctcactaagagccgggtcttagctaaccctttcctcaagaggttgcactaagcactcctccttccactaagggtatctcttccctttcggaggtgagatccgaccttcacaaacttctcccagccaaccacaagtagatcggtggctcgggagtgacacctagccgcctaggagtccttaacctccaagagtaacaaatgtagcaaagaactcccggagatgatgcaagtgctcacaaatcttcacgaagtcaacaacaagcactcacacaaactcgaatccacaactctcacacacacaccaaatccaaatcgaacacgggtgagaggggaaacaagaaagcaaggctcaaaagtgctaaagagagagcaagccaagggcacaaatgattggaatggaaccagcagccctcacaagtgaggggggggctatttatagccacagcccaaattctgcccattatgcacaataattgagattttcggatattccgaaagattttcggacaagtccgaaaattccagctcagcaccaacagcaaagtcaacgaaagatttttcggacattccgaaaattttttggataagtccgaaaatttccaccaccaaaacatggttctggatgttttcggaaaagtccgaaaatcactttcggacaagtccgaaaatacacagaagcgatttctgcctttgctgaagtttttcggaaactctgaaaatcaattttggaaaagtacgaaaataaacagaaccacatttgccttcacagtcattttcggaaagtccgaaaatgtctttcggacatatccgaaaatttccagaagcaaaaattggttctgtgcattttcggaaagtccgaaaatgactttcggaaatctccgaaaatttccagaacacatcaaactgaggggaaacacttttaaaaaaagattttgagcactttgatcactcctcatatgtcaatgcatcatccctcttaatagtgcggcattcctattgactcaaatgaaaagaaaagttacaatgtaccatttgctcatctgccgcatcgcatcacatcaacgtatttggcgggatatgcattatggtaactcattgaggacataacaaacttcacatttgcttaaataaaaatgttagtcctctttaatcgcattgtaattaatcaccaaaatcattaggggcctagatgcactttcatgcagaaaagggatgtttcagaggaataaaatgttcatacttagtgtatctgtcaacaacaaccaagatcacatcaaatcctttggaaacgggcaaaccttctataaagtccattaacacaacttgccaggctccagaaggaattggtaagggctgtaacagaccagggtaagcacaattttcatgtttagccctctgacagatgtcacactgttggacaaagtcagtcactgatttctttaatcctacccaaacaaacaacttcttgactcgctgataagttgcttgaactccagagtgacccctcacagcagagtcacggaaagcagatatgattttggtttgaatagctgaattagctcctatccaaaccctgccattcttcttaattaatccttgagacaaagtaaaaccctggccgttaggagaagaaatggccaattctatcagcagtaattgagcctgagaatccacaacataagaattcaacacttcttgtatccacacaggctgcacaacagaaatagcctggagagaaaagaaatgtcccacccgagacaaagcatcaactgacttattgtccactccctttttatactgaaacctatactaaagaccaattaacttggtcatagccttcctctgtaattcaaaacccaaaacttgatcatccaaatggcacaaggattgatgatcagttttaataacaaatggtccccttaacagatatgctctccatttgtcaacagccatcattatagccaagaactccttctcatagatggataacttctgattgtttactcccaaagccttactgtagaaagccacagggtgcccctcctgagaaagcacagctccaatgccagtggaacatgcatcagtttcaatggtgaatgacttagaaaaatcaggtgatatcaaaacaggagctgtaaccatatcctgttttaaggccaaaaatgcctgatgagcttgatcagtccacacaaacttagcatttttctgaagtaacatagttaaaggtttagccaaaatcccataattctgcacaaacttgcgataatagcctgttaaacccaaaaaaccccttaactcagtcaagtttgttggaattggccattgccgcattacttgagttttatcagggtcagtggccactccctgagctgacataatatgtcccaaatactctaactgactagcagcaaaagtacacttagataatttggcacatgattgatgttgctacagcactgcaagacacatttcagatgctgtaaatggtcttcccaagattttactgtaaatcaaaatgtcatccatgaaaagcaacacaaacttcctcaagaatggagcaaagatggagttcattaaacactgaaaagtggcaggtgcatttgtgagtccaaagggcataactctaaattgaaaatggccatggtgtgtcttaaaagctgtcttatactcatcaaactccagcatgcgaatttgatgatacccactgcgaagatccaacttagaaaaatatttagtgccagccaactcatctatcagctcatccccaataggcaggggaaacttattcttcacagtgagagcattcaaacgccggtaatcaacacaaaacctccaggaattgtctttctttttgcccaaaagcacaggagaagcaaaaggactgcaactagtggtaatcagtctagctgacagcatttcagacacttgacgctcaatttcatctttctgagcaggagaatagctatagggacgagaattaacaggaatggcattagggagcaaaggaatagcatgatccaaagctctatggggaggtaaatcagaaacattctgaaaaacagactcaaattcagatagcaaagactgaatctcaggaaattcagacacaggtatagtcaccccaccagattgttccaacactgcaatggcccacacatcattgccctttgtccatttcacaacctgttcaggagtagcttcttgaggagtggttaagtcagaagaagactgaattccctgcagcttgatgagagaaccctgatacgaaaactgcagccacttagcagcccaatcacatgtcatagggctgtattgagttagccaatccattcccaatacaagatcatagccccccataggtaaaaccctgactggaaaagaaaactgatggccttgcacccaccaatcaaattgagaaatctttgcatcacaaaccagaacttctccattagccactctgacagaagtgggtggaattggctcagacagaaggtgtaaacgatgacacagagcagaattaatgaaactatgagaactcccagaatcaaccaaaacaataagcacctgattgctagacagagccctgagttggacaatgttggtgtgagaagtgccggccaaagcatgaagcgacaaattggcactgtcttcagacaactccaacccagtaacagcatccaaaagttcatcagtcagaacaattgcctcctcttgtaactccat

SEQ ID NO: 29259 - DNA, 485 bp, Oryza sativa
aaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcaaatacggatg

SEQ ID NO: 29260 - DNA, 697 bp, Oryza sativa
ttggtaataatttgcttagctcctggtttggaatggaacattcctatttggagatagagctgtacaatcgggtatggttgtccaggtttggttgggcttgtgcagcatgtgtgtcatgttcagtgttgattaatagtgatgattaattactttactgttttacaattcttaaatgtttattaaatgctgcttttgcaaatgagcctatattataccatcctttggtatccttgtgcacttgtatatttgctatgtggcttgcggagtattccatgtactcaccttgtaataatcaatcaaacctcagttgaagaaaagttgcgaagaagaagacgtttggcttataccccagttgagctgcctgtgggagtggagccggagcttcgctagaccgtaattccaatgttgtttacttttcttttgtaagtatgtaatgttattattttgatgaatctgtatattaaattgtcagtttgtgtatcttggctgattcctggacgaggattttatcaaacaagttagttcagaaattactagtgaattcctgggcgtggcaataatagagagatccatactaataatttaaatattacttgtaataaccaaagtctaggcatggattaatataattcgagggtagagtgacactaagcagaagtatttatactcattcgggtaccgagctcgaattcgccct
